United States Patent 9,328,346 (POLYCOMB-ASSOCIATED NON-CODING RNAS) - sequence listing, part 67

SEQ ID NO: 12700 - RNA, 147885 nt, Homo sapiens
agggugugugucuggggggaaggguuagggaggggaaaauagaacccuuuucuucuaacagccuuucuuaaaaaauaaaagaaaagagaaacaaauguuuguuucuguuauuaagccccaucuaugcuuaaaaguuaaaugaaauagggaaaguucaggcacagagacgcguguucugauuugguuguuuaccaucaaucagaccguugcuuggcagacacuggaugguuaugagccugaacaagcugaaaaggggcaggaaaagaaguggaggcagcauucuuccuauuuaaagcugcaucgcuugaaaaaaguuuucgcagacugugcuggagcuggugcugaaaaaggggguuugcagaggcugcccuggggcuggugcugaaagaagagcccacagcugacuucauggugcuacaauaaccucagaaucuacuuuucacucucaggagaacccacaugucuaauauuuagacaugauggcaaacugggcggaagcaagaccucuccucauucuuauuguuuuauuagggcaauuugucucaauaaaagcccaggaagaagacgaggauggugaguuugccauuugcuuugcuuguaguguuuauugcacgguuugggaaauagguggaauguuaagccucaggaagagcgugaagaggagguucugguuugaaguuugagaagggggcugacggauuugcaccuggaaaacgacuugaaagacaauugggauguuuguaaauccggagcuucuagauccaccguuggagagaguacacuacuaaauuuuucugggaaagccuacaauaaguccuuuuggcugagugugagagugggacguuuaaaauaagaaaagagugaaugcuuaaaacggagcacuaaaggcauuuuaguuagaggagcucuguucugugggcuggaguuuucagagcaaggaaaagucgcggcagaagcuggguaggguggagucuuuuuguacugaacuucagcugcuucauaaaauucuuuguuuaguaaaaccucugcagcaacucugauagcuuugauuuuucuuugucuuuggcuccucauucuuuccucuuuaacaauuuaaacuucuuuuuaccauuuucauuugugaaaaugugaucacuuuugcuuacugggaggcagucucguuuguuucuccaugacagaggcugauagaagccagauuucuuaaacagugguauuuucccacccuacuggcuugauuaacaggacaguggugguucccgguuggauggcggaaggcaggaaaucagcaugucuuguauauaucuuauuuggcauggaauauuugcauggacauuaccccuuagacccaagcuuuuuuuuuuuuuuuuuuuuaaagauaaaucuugccuggugaccacauuuuuuuccuaugcaauuuucauauguuacaguuggguuauaugguaugguuaagcaaaaaugcauagcuguuguaguauauaagaaaauauuuaaauugauuccucuauuaaaucuuuaaucuugaggguugcaauuucaaauacagacauguacuccuuuaaaauaagccacuguagauuuucaucaacucaaccauguaacaucaaacucaagcuuuuaaaacuuuggacauucauuaaccuuuucuauuacuuucauauauagacacauacauacagguauauauguauauauacuauguauauaucuauauuuuuagaacaaauaucugcuucuguguguuuuugguuucaaaaaguuuauaaaauuaaucuagagaucagaaguucuaaaaagcuuaaaaagugaaaauacgaauuuguaaaugaauauccaacaaucugucaggagucccauagagggggcacuuucuaagacuuggagcuuuuuauguuacguuuuauguuuuuaaaauaugagguaauuuauaaaaggugaaaacuuuugaguuucuuuguaauggcaugaaaagcauguguuguuuggaaggguggcaaaaauaauugaauagaaaguagaagaaaacaggaggagaaaaacacagaaaaauuacaauagaaauugaaaauuugacucuagaaagaacaguuuacuccccucccccaccaaaacaaccaacuuuaauuuaaaaccuuuaauaccacuuucuuuguuaauuuauguuaaaaugaauaaaguacuuuaauaaaguauggaaauaauugaauaugugaauaaaugaaaggacuguuucacaagguacaugaaauaagccauauuuuaaaagacauucccaaauaguuauaauuacucuguagguguuuuugaaaaaugagcagauaauuuuucuuaauaguaauugacauaaauguaaggaaugugaugcuugaugcaaaaaaguccccaacuccaauccaaccccaguaccccccgcgaacaguauaaccaaauagcacagaaaauggaauuccaaacaucaaauuuuacagaauguguaauugcuugcauauguguuguaaaaaauuccaguauuuuauuucucaacuuaagagaauauaagugauaaaaauucaacagcaaaagaaagucgucauugcccuaaucaaacauaauagagaaaauaauuccagaguauaguauauucagagcugcuuaacuuauauuguacuuacuuacuaugcauauuuugguuuaaguugauauuguauggauacuuggcaauacuuucuuuuuccuguucaggccuaucacaagcuuaauaaaggugucauaauuuagaaacuccauuugauuuugaguuuggggaagaguaagcuuagaucgaugcuuuaaauuaaagaaauaucugaggcacacaugaaaagcaaguacauuuuucaaauuuuaucuauaacagucacauaaugugauauuuacauuuuguacaaauaugucuucuuggaaauguggagaucuguuuuugcauguaagugcauauuaauaaguuuuuauuuuuuucuuucuuuuuaugacuucaggguauauuucccuuuacuugacugugguuauuuaccagaaauguaaaauguaaucugaguaugccugccugauagaaacauaugaaugagaagauaaaaguaaauaaauaaaguuuuaggcauuuuaagccaaaaucaguuccauucucacugaguuuuaagaacugauuugauuuucuaaauuuauaagaaacugaaaggagaaaguuugggaguugggcugacuuuaguuaaaacuaacguaacaaaaauuagggaguuaaaaugaaaaaaaucagcuuuuaaagaguuuguguggguguaugugugugugugaaaaaucagggaguuaaaaugacaaaaucagcuuuuaaagagugugugugcgugugugugugcguguggugagagugugugugcauuggggugguggucuucaaaagauuccacauuuguguuaaggaaaaugcuagagcauuuacaguguauuuauauuccuaaguuaaugccuagcaucuagugagcuauauauauucuuguuauuagaaguaggcaugcuuaauuuuagaaaauaaucuuuguuaugaaucauuguauucaacaugggauaagcaauggagaagggaaggugcagaaauguaucauuuuguuuccaaauacuguaaaccucaaugcuuucagaggccaggcagguaauauaaacaagugaagcaagccaguguuuguacaucaauaggugaugauggggccuguggagaacugaaggugcauguccacuuuaaggcauucagaauuaacauuuucagaagauauugcauaugacaaauaaaauauaucugaguauauauuuggcucccggcccaugaauuuacagccaucauguugcaauccuacacugauauccuccuggacccaagcuaacuuuugauuacugagagaugaggggcucacagucuuauaugucauggucucuugcauuuuuaugauaugucugccauuuaucucauuguuacgauacaaaaaucaggaagcagauauuuaacacucaguaguauuuggaugacaucauuuuaaaggagguacagaauauguauaaauauguauacauagcuuaagaugcauguuaacucauaaauuguuuuaaacucauuacuguugaaauacaugcuaugaaacauguaggacauucagacuuuuauaguggguacauguagcagaacacaguaguuuaaacaaacaaaaaaagguuuucuggccaggcgcaguggcucaugccuguaaucccagcacuuugggaggccgaggugggcggaucaccugaggucaggaguucgagaccagcccggccaauauggcaaaacuccgucccuacccaaaauacaaaaauuagguaggcgugguggcacaaaaauuagguaggcguggucccagcuacucaggagacugaggcacgagaguugcuagaacccgggaggcggagguugcagugagcugagaccgugccacugcacuccagucugggugacagagugagacucugucuaaaaaaaaaaaaaaaaaaguuuucuuuuuuaaauauaaagaaaugcuuuuaagcagguagugaaaggcuggcauauuggcuccacaaagucaucagggacugagguuuuuucuaccucuccuggcucccauaucucuagguauuuuuuuuuaaauuuauuuuuaugguccuaaauggcugcugaagcuccagccauugcguguacuuucuaggcauguggauagaggauggaaaacaaaaacugugagccauuccccacccugcccccuuuuaugaagacuuuaaagucuucauaacauuuaaacuuacuuacaguuggccggaauuuagucauauggucacacaaaacuucaagaggggcuaggaaauguagcccuuaccuggguggugcuggcaauauacucuacugaauugaguucugcuaugaaggauaaaaggaagcaccacuauuaggaguuuuauggucccuaccucagugagcaaaaaggucagcuacuuuuaguggccuagaucuuacgguuucaauggacaaaauauaguugugugacuagauccacuuugguuauuguucauuacugaguagacugugaagccaagaagacugaauggcacauaaauauuaggcuacauuuucuuugcuucuugucuuuagauaaauuuugacaccuauaacuucuauucaaacuaaacugaagcuuuaguuugaagaguauaucucuuucuacauauguacauugguagauucauagauuuagugaauuuuuaauauugacuaacacaauguauacuuggaccaugacucguagggucauugguaagcaagccacagaucaguguugauaaaaaaugguauaaagaaucaccuaagaucuugugacuaauauagauucuagaccccucuacuuuccaaauaucuaggaaguuuggauggggucugggcaucuguauguuuuuagagcucuccaguugacucugauuuacauuggugaaccacuguauuaaaucuuugacugacacucugaaucuuguuguggaccuguuggcuuuuauguuccgaggcuacacauuaagauuuugguaauaacuugcuauucuaguuauucauuuuacuuauaaggcugcuuaguugaaguuuguagguaaaccauugcaaagucaccaucacuucuggaaaaauaacucaaggcccaaauaccccucaugguggauuaggcgaaucauucuacuaugcagaagacacaugccauuugcauguguuuccaggugaaugcauguuuuucauuuucaauauuuccucucucuuacuuucugcucuucacacuuugagcacuaucgcuacaggccugaaauucauuguguucaucauucuagacagguaccuaaugcaggaugugaggcaaaagcagaaagaggaagcuuuguuuuaagaagcuggaaauuagaagauuggaaucguguuaaucuauggccacagaauguaguuuuuaaaaaucauacaguuuucucugguuugaagaaugauuaaugcaucaucaccuggccuuacauggcauucuuaaaauguauggacauggaucaacugaucuuuaaucggauuuucuucucugagaucacaacauugaaaagcuuagauuuauacauuagagauauaguaagggugggggaaaagacuggaaguguugauuauuaauugaucuauuguauaaauuugggcaaguuacacaaguuuauauaagacaaaucuuggaauuauauaaagauauuccuugauuuaauauuuuuuauuauuuauauccaugaaacuauaauuuucacuaaaaauguagcacgagacaguaucaacuuacugauaaauaugaagucuuugaacuuuucuuauaucuaaaagucacagcuugaguaggcuuuuggagucugaaugaaauuaucaggaagauacugauaaucuaguuuucuuaaauuuaucuccauauaaaguucauauauauuuaucuaaauuuuacguaagaugaaugagcugugauauucaauauuuaaaagacuauuuacucuuggcauuugcaugggaaguacucuauccuauggaaaauuuugcuuuaaaggugugaccauauuggcaaccuuaagguuuuuauuucauuuuaucaauguuuuaaaaacuaaacccuucaaauaaaucaagguggcuucaucuuauacuaaaauauucacuaagaaacaauguauaagggaaauuacaauaaagcaagauuauuccuaucuaaaucuugccuucuacagagaagauagaggcuggguguguggcucacuccuguaaucucagcaguuugggaggcugaggugggcggaucaccugaggucaggauuuugagaccagccuggccaucauggugaaacccugucucuacuaaaaauacaaaaaaauuuaucuggguaugguggugggcacuuguaauucaagcuacucgggaggcugaggcaggagaaucgcuugaaccugggagggggaggcugcagugagcagagaucaugccacugcacuccagccuaggcaacaaaacgagacuccgucucaaaaaaaaaaaaaaaaaaaagaagaggaaaaauguuaacaauauuaauuaauauuaauuaauuaaucaaacuuuguuccuauagccuucugguguuauguucaaacucaaaaauguuuacaugcuuuuuuuuuuuaaguuuaggauuaagaaggaggaaagacagucucacaguuuuguaccccuuuuuaccuuuuauuugagaugcccaaucagaauugugaauucagcuuuaagaugacagcaaacuauauuauugguggaaacacuacuugcaacguaagcaucauagccucguuguagucuauguaguauaacaaguauaauaaagcuugguccagccaucaugugagagaacagcuggguucugguccucguucuauuuagcaguuuugcuaccugcagaggguccuuaaccucacugggaauuuguguccucaucugaaauauugaggaaauaguaugcaccuuugucaucugaugggauucuuaggaggaccauuuaagaaauuuacuuaaaaguaauuuuagaguacuuaaaugagacacggaaagugacauuacaaucuacuucacugaccacagauauaaacccuagugguguauuuuuaaauugcuuucaccaaaucuuugaauuguuuugaagcaccuccuggacuuguucuuuuguguuuuauuuguucuccaucucccugaggaacuuguuccaucagucaugcucucuuuucuauaacuucagccacuuccuuucuaucugcucuuucccuuuagcuuguaaacaaguucagcucucucccacagccugugucuagcucccacccagucuuuauucuuagcccagcugcuuuaaaaggagcagugcaguuuucugucucugccuccuaugcccucacuuggccucucuuuccacuuaagcuggucuagcauggugaggauuaaaaugugugauauuccaagggucccuuuucaucuuaucuuaucaggccuuucuccuuuauuggagaccauugaccacuccagcuuuccuaaaaugcuacucucugaagguucuuccuccaccucccugaccuuucccucucagcuucauccaugggcuccuucuucucuuuuccuguagcauuuugcuuuucuuacaagauuuaguucauugguucucucuggauauucucuuccuaggccaccuagaauuaaggguuuuguuuaacagcugaaugcugauaauuauaacaucucuucaaccccaaucuuucacaugaacuuuagauaaauaaauauauucagcugucccaaaggcagccuagaaccacaugaaauucaguguauccaaaacuuaauuuauuggcuucccuucaagacuuggucauuuugcuuauguagucccccuuaugccaguuaauggcaacaugaugcuacccggucauucagucagucauucaaucagcacaauuccaaucguucacuaagaucuaccauuuuaccugcuaaauguuucucaaguguaccucuucuccaucccuacuacaaaugccucaguuuaggcccucaucaucuaucccucaguuacugugauagcaucuaaauucaucuccuugccucucauguaucugcuuuccaacaaacacauauauuggugccuucuguugcuagugugauauaaaacuaucuaauuuuguauuuaccuuccuuaacaacuuucauuggguccuguaacuuguagaaagaauaagguucaagcuucuuagugugacauacaagauccugcugaucuagcccauuucugaguuuuagucgcaucaacugucauucucagccucaaaauaaggaauugcuugaggcugccacccccaacacacacagacacacacaaacucucucucucacucucucucuauccccuuucauucucuacuguccagauuccacccagaacugacauucucucauuaguugagcuaagugcuccucuggccaucucacaacagucaguacaccucugccaugcaggaacaauaccauacugagaaugcuuucuuuccaugaauccguuuuacacauucccaccagauuaggcuaagucccacuuuuauaaugucacucuccagugacauuauaauuuauuaacauuauuuauuaauuauuaauauaauuuauuaacauuaacaauuuauuccaagcugccauugacuguugcaucacacuuaacacauuauacugaccuuacuucugugugacuuuuuuuuuuaccuaagagugccaagaguauccagcugccuugcaagacugcucauguucuccuccacuguaucuaaacaaauacuaugauuuccauuauuguccuuaacacuacugauugcagcacaccaugcagcauccuuucucacuucagaucuaacuuuuuacuguucccacaucuaacuuuugcgauuuagguacuucagugcuucucuuuuuaucuucccucugccuauugauguuuuccuccaaguucugcuucaaaucuuauauccucuaagaaacuaagagauucuuaucugcaauaaauauccccuuuccuuucaagggaugguccuuauguugcaaguguguuugugcuaaccaagaauaaguuuccugggagauagggacuaugucaugaagucauuuuauauuuuagauccacccaugcauaaaugccaauugaguacuauuugugaaaaucuagaaaaauuuuuuccacaauucguucacucaaguaugagugauccgaauucaaauuuagguuuuggaaauuguauuuccauauucucgggcaauuuuuuuuauuucucuguguuacaguuucuucaucuaucaaauuggaaugauacuucaaauaauuaugaugaauacuaucuaucuaucuaacaccuacaugauagcagugacucccaacuaauaauaggaacucauuaauauggcagaugauuauuauuagauuacuauuuaauaauaacaggccaggugugguggcucacgccuguaaucccagcacuuucagaggccgagcuggguagaucaccugaggucaggaguuugagaacagccugaccaacauggugaaaacccaucucugcuaaaaauacaaaauuagcugggcaugguggcacaugccuguaaucccagcucccagcuacucgggaagcugaggcaggagaauugcuugaacccgggaggcgagguugcagugagcugagaucgcgccauugcgcuccagccugggcaacaagagcaaaaauccgucucaaaaaaauuauuauuuaauaauaauagagauaauaaaugcuuauugggugauuaugagaaccaagauguuagauauuacagagaaauaaagaaacaacuuuugcucucagagagauuaagccuagcauaaaaauuuuaaaaugcaauuuuuauauuuuauucuacuaugaucauuuugguaauauaucagugauuuuaucuguguguuaauaagcuuuuaaaacccauuuaaaauuuuuacuguucaaauaaaaaggccauauuguauuauuuccuuuuguagguuuacuaauacaaaaaaagaaagaaagaaaaacaaaaggcauuucccaauggagaguuucuaauggccccaugaucugaagcaucacugccccuccccuguuucgcagccccacauacauuuacuuugugcugguucccagugugugagcaagccaagcaugauccacuccaugccccagugccaccucaugccugucuaccaucccugucugcuucagaguuuaguuugugaaacuaugauaaucauagaagucucuauuaaaaacuggaaaccuguuuuccacucugcauugcucugaguugcauuuggaaugagaggcauugcuucacugcacagggauuuacaaagcagcucccaggacuauucggauacaguaguaggggugaccaucuuuucccagacucuguagcaagucucuucacuuuccaaaagcuguuaauuuaccucacucccuucacucccaggagauuuuuaugaaauugacuccagaaagcagaaacuggugugggauauuggcacauuuuucauacucacacuuuccuuacuuugcugcacuguucuuucuuuguagguuuucaaauucauaauaaaaaaugauggguuuaacuuggaaggagagaugcagguggaauuuuaccagauaauuuguagcuaugaaauucuuuaauuaaauuuuugauauucaauaugguuguucuguggucaucaacuuuaaauuuuuuuuauuauggaauucugaaaauauggaugguucccauagcaaauacaauuuauuuauagagauuuaauauuuucauuuagcuuucauaguaauaggcuuauuugcucuugagguagaagaaccucucagauucauuuaugcuaguuuggaaguauuuuaaagcuuuuuuuuucucauucuuucguucucagauuuuuauauuaaauaaauggaaaguuacaguuuaauucagggcacuaugguuuucauguugugaugaaguuucagccagaauuuuuggugaaguggauuggacagugagguuaacugacuaccauggaaagauuaacugcaaaguuccuaguuuucugaucuuuggcuacaaacauaaaacuucugagguuucagcaaaaagggcuauauuugcuuugagaggacagagggcacugaccauuccauguuaagcgagagauucuguuguaagaauuaaaaaaaaaaaaaaaaacccgggcacaguggcucacgccuauaaucccagcacuuugggaggccaagacgggcggaucacgaagucagaagaucgacaccauccuggcuaacacagugaaacccccgucucuacuaaaaauacaaaaaauuuagccaggcgugguggugggcgccuguagucccagcuacucgggaggcugaggcaggagaauggugugaaccugggaggcggagcuugcggugagccgagauggcgccacugcacuccagccugggugacagcgagaguccgucucaaaaaaaaaaaaauaggaguuuguacugggaaaaaagagacuugaggcugaugaaugaagagcaacugcaaauucuaucagggagcugguguucaagccuuuaaggugcuacaguguuaugcccuucuagguguuauuuugugaaacuaugauagucauagaagucucuauuaaaaacuggaaaccuguuuuccacucugcauugcucuggguugcauuuggaaugagaggcauugcuucacugcacagggauuuacaaagcagcucccaggacuaaaaaaaaaaaaaaaaaaucacuucuuucuucaauccuucccuauuuuuccuuaaguuuugauaauuguugaugagauuaggcaaguuuuuuauuuguggcuuuuguuguucucucuuaagcauaguguagcugaacugaauuuugcuuagacacaacucauagguuuauaaaccaauggaguucucauuagccuagaaauauuuccuuauacaguacuuagaaucauuuuuguuuguuuguuuuaaaaaauggagugggggaguguauucuguuauguaaaggaugacaacaaauugaauuagaauuaguucuauaaagauaaaucagugaauaggcucuaaguuucacuguggguguuuguguuggggcauaggaaggaugacauaauaaaauagaauugguaaguuuuaguauauucagcauauaaauacaucuuguaaaguugccaagugucccgcucaccugagcuaccuugugccucuugacuuuccuugggugcaacauuugcuaaaguccuaggaguaagagcagguccaguucuaagaaaaaaauuuugaauaccuggcuuauuuuuaguuuuuaagggaaauaugcuuucauucaccuuucugucugaaggaaaggcauuuuucaggauugggaggccauccuugccuuuccaguguuuugcacuaagcuccaucuggaugucuuuuucccagauuuucuuucaaauuucagacuuuuccuuccagccugaccucuuaucacaauuuaccuguuuggcauucuuuucuuuccgagccucauggggagcuaauauaguccagaugcccuauaguuagcguccuaggacacagauuuaaugauauuaugcucuugucauacaagcuuguuauaugguaauuugccuuuuaagaucuuuuucucaauauuuucucgccacgagaaucaacugacauacuggcucuggguaaaagccccaguaucccagauggacuccguggcucacacuacagacgaauaaaauucagcugucauagacacucuacuugcccacggaggguuccacaauccaaauguuaaaauuacuucaagucuuuucuaauagaaacugaaagcugucugguuauaaucaaaauggaaauuugccagccagauuccuacuguuucugaagagggauuuugaguuucuucaggauagaacccuaaaauugccccaugguauaugcccaaagugaccuaacuuggccagcugaauuucagggagaugcuuuccaagaugacaauuucacuggaauaauuucagaauagguaguucucugcccauaaugucccuuuccugucuuaggugauuuaaaaaaaaaaaaauucaaccugucuuucuucucuucaaaagcaaguuucaagucacaccuggguagaaccuuaugccucuauggagacugcaggauguggaagacaggagagaggguauggagagcagcaagagccugggaagaagggcucuccaagaguauauaagugauaccaauggacagguggcucacauagcaucauugaaaugccuaaaauguaaggcuccaugcuaauuuaguaugaccauaucuaagugaugucuugggggauuuauuuagugaauuucaaaaaauuuggaaaaguagaugacaucucucaacauauguucuuugacucuucuauuuuuuacccuauuuuuuaaacauagucauuuuagaauaaauaaauagauaaauaaauaaacugugucacaauacuauauucuuucggcuaaaagcacauauuccgucaacuaggccuacaggcaguaggaguaggacacugacucagcaaugaguuuuuguuuuaaauuguuauuuugggagcuucccaagaguuccuguuaccauuuuucuacauauagagcuuuuuacaguuagcacuucuuuuccauuuacuuucaauacacaguuaacaaaagaagggucuuuggauucacaucuuuggguccagacuuugccguuugcuaaccuugugaccuugaacaaguuccugaucuucuuuaagauucaguuuccucuccucgucugcauauugaggaguuaaauuaaaaugcauggccuuaaugggcacugaagaaauguggauguuauuaguacuuuuagaauggauucccugauuggcucauuacagacuuuuccuccaauaacuaaaacaauuuuuaucagauuauucccaguuacuagguuugauaggaggaaggauaagggagcagugaauccuaggcaccugggacaaaauuggggagggaguggaagaggaaaaacuauaacugggagauuugaaaugacaauaguaaauuuucauuuacuauguauuuauauuuauaauuauuuuuacuuaucucauguuuuucccuuugggcagguuugugcuuagcucuugauuauuuacaaagcauuucaggaaaagcaaaccagcaaaacccccaaaaauuauccuuugguauuagaaugcauuuggcaaauuaagugguacauauacacauuuaauuuaauucuuucuuucuaauauaaaguuuuuggcaauuguuugcacauuugccuuugguagaguuguuugagaaaaguggaaauaugcuuaagauaugaaacaucuguuuauuuuaaugauauuuuacugaugucaagacagacuuauuugagcccuggggcaguauuuuugugagggauggcaugcaccuugccugagcagucaaugaagagaaagcagcuguuugagcuugcucaacuucuacuaacucaacguggauagaguccagauagcaacuggcccugugucagaugacugcaauaaagcucucuuuccuuauaaauucuuuauaaacaugauguguuggggucuuaauuuucucauuuacaaaacagagauaauacuuuauauuuuucuaccuuauugguucaaaagaaagaguucauaauuucuguagaaauucuuagucagcuguaaaacccuauuacauaagcauauauuauauuacauaaagguguuauuauuuagcaugcuuuuacuguaaugaacaguuagcuaaaugcaaaauaaaauucuucucugaaguaaacaauaauaauaauaaucaaaaggaauauaagacucuccauagaaauaaaagaagguaaaguuguauuuuuucaaaaucauauuuaaaucuuuuauuuagcaaaauaaaauagacugcuuauauaacuaucuagaacaucucccaaagccccagaauaggaauuaaauaguaaaaaaaaaaauaagaauagaggcuuugacuugaggaaaaacagaacagauagaaaaacaaaaugugauuuuucugcuauaacuggacuguagucucucuacaagugaaauguagcuuccuggcagaagccugaaucacuauuauuauuacuuuuucuuuauucaucucgcaucaggaagcuugucucaaauucaaaguuaaacgcuaaaagccuguuuguagcaugguaucccuuuucucugggucagaaggugacugagagcuagaaguuuaaacuggugacaaauauccacaggcaucugagccaaacguuuagaaaaaaguccuaucaucccucaggccugucuacauucugguauuuuaagacucucuacuuguguagagagaaacaugcaguuaaagauaugagggccuugacuaaacaggcuguuacuuucaugaaugaauuguugaaauaauuugaaagaaaagcuucuaaauuaaaacuggaccaggacacaggaaaucugcaucauaauugcagcucugucauggacuaacuuggugauuuuguggaagugacuuaaauucucuggaccucaguuacuucuguugcaaaaccugugauacauuacccagagcuacugucugcuuugaaagccugugacuauagaauauuuagauaaagguacuucacuuaagucauauuugugcuguaauacaguggaaagucucaccuacacauuuugguaacucgaagcaucacacauaaucucuaugguaauacauuucuguacuugugaguuugcauuugaaguuuagaucaauucagauuuguaguuaugucccuaaauaugguuuauuuaaggagcacagcucccaauuuauaacuuguaaauugaucugcuuuucagugagugacucuacaauaaaguuccuagaugcuguuauaaaagaugauuguaaaaaaaauucaaaauaaucugauaucaaauuuuucauauuaacugaauuuuccaauuagagagaaaauauguaaaugcaucauguguuguguuaugcuguuuagccacagacucaguguucucuaaauguuuuuggugagaagggaugucagaguuuagcagcgugccuucuugcccugaugcuggcggauucaucuuugcaaugcuuauuuuuuccaacaauccuugaacauaccaaacugcuauuucauucagaauaagaauaagaauaauaaugaggaaaagaaggagaacaaugggacagguggagaaggagcagaauaauggggcgagagagaaggugaauuauuauuauuauuauuaaaugguugugggcuuuuaccugaggaguagaucauauuuguucuugauuccuuauuuuuugccucuucuugacuucuuauuuuucuuggcaaucauguuugaugggagauacauaaguguuuacuaugaauauuuagaaaauuugauuuauuccauugauauuccuugagcacagaauuuuuuuggaauaugcugcuugcccuccuuuaucuucugggaaaaugggacuccauuuuuguguuuguucccccauuucccuccuucacuaguacugacugaguccugcaaacauuuaucuucucaaguccugcuagaauuccucucccagggauucugggcagaaaacaagccucuuuuuuacaucuuuacaaguaguguguguguggaauucaagugcaugaaacauucagauuaaaaaucugauaauauuuuagaaauuccaguauacccacaaauacucacauguauguuuaaaucagggauuccaguaggagaaaacuguuagauucuagcuuaauguacuccucaauaaaugagguauacuuuggucaucguaaagcacuugcuaauaauuuacuacuuugggggauuuaaaucccauucuaucuucagaagucauuauuaaaguguuaucaguaacauuagaauuugcuuuggaugauucugacaaauucaacguuuuauuaaacaaaaugaugcucuggucucaaaugauggagauuucaacuugcuuuucucuacagaggaguauaucccccaccaugcaaguuaugaggcauuuaccuucauuuauucauuaauuugguaaacaugugcugaguaccugcucuuuaucagguucuuuauugauugauacagaaacaaauauuuaauucuuacucccaagaaguuaaucgucuagugggaaugagacaaauaaaacaaggauaauacuuuguggucugugcuguggcagaggcagacaaagaaucaggggaauaacagaagacuucccucccacauacugccugagagguggaggacugggaugggagcucagggaaggccuccccuggagggcacaccugagaagucauuccgcuacaugaacucuguuauuuuccuuaucccuuauuuuuuccuccccuucacauccaaaucuuucaaguccgccaucaagucugaugugcauccucuuugaaaccuuuuugaacaucauagacauauuuuuucucuuuucucuaaaagguagcacuuccucuuucuuuaacacauuuagcacacaauaaauccuuuuauuuauugcccacuguuuucuaaauaacauuuauuguaaaugucauugauuuuuuaguuauaucauaugcuccuugaggguaaagaccaucucucaaacccagaaagucagauccagcuccagugcuaugcauauaguagaaacucaauaaaaguuugugacugauauuucaagcaaaauauauuuucuucauguuucaaaauuaagugcuuuuucucuguuguuagauugcugucuaauuacauugcacaaccuugccuaaguuuuuauauacauagcauugagcuuaaaaacauggaaccagcucuuaugcauaauuuagcuauauuuagcaucuuugguccaaagccuuauaaaaauauguacaucaaagcacuguaauuaaauggaaacaaaguuaaauuuauauuuuacuuguuuuauuuauagugacuugagucagaguauagggacacaaagaugauugacauauuaucuuguauuuaaggaauacauaaugagaggaauagauacauuaacaaauaacuauaaugcugucuaauaaauacagugagaaagaauggcauaagaggaguauccagcccacccuugagagcauggguugguuucuugcagauguauccaaaacauaaaggauagauguauaguaacuagcagaaaugacacaagaggaaggacaagaggauggcaucuagauaaaaaaaaaguacagccgggcgcgguggcccacaccuguaagcccagcacuuugggagaucgaggugggcagaucaccugagguugggaguucgagaccagccugaccaaccccaucucuacuaaaaauacaaaauuagccgaguaugguggcacaugccuauaaucccagcuacucggguggcugaggcaggagaaucacuugaaucugggaggcagagguugcagcaagcugagaucgcgccauugcacuccagucugggcaacaagagugaaacuccgucucaaaaaaaaaaaaaaaaaaaggaaaaagaaaagaaaagaaaagaaaaaguacaugaagaaauucucaggaauauuaauuagcauuguuuugcagaaaacuacaacuacuuuaaugucuuagagcauagaauggaagguaggaagacauuauuauuagaguuuugauuuuuuuggcaauuuauugauugauuaauuauaaacucagucuucaguaguaggaaagacagcagguguagaccuuuauuuuuccuucucugugcauuaaaaagcugaauuguaaagggaagaagagcuauaggacccuagucagaacaggauguagaguccagugaggauuuuuguuuuauuuuauuuucagauggcagaguaggcuguuuauaggcuucagaaaaaagcuccauaaagaggaagauguugaagauagaaaaaaaggggggauaaagauugcccaagauauagaaaggcuuucuuagagacaaagucaggguuuucugaguuggcuaguggucuauacucuguugacauuuauuuuuggugucuucugccucuacaaauaauaauaucacacuacauauaaguaguauuauacaauucaugaagcauucccacuucuuuuaugcauacauucucagaaccucagauuaaagaugaggacacugaaucuacaaggaaugaaugaugcagaggauguuggacagaaguauagagcuucaguuuucuggcuucuauuucagggcucucucaauuguaucuuacagagaggagaaaaaagggaggauggcaauuuuagucaccaagaacaacacucuauguuaccugaaaauuauuuguguucagugcugaguucuuagagacuucagugagaccaaaccuguggcaggcaauaaugaggaaaaaauacaauuuacuguuuuauuuaaaacaauuauuuauuuauuuuuaauuuaauuauuauuauuauuauuuuuugagacagggucccgcucugccacccaggcuggagugcagugguucaaucucagcaaccucugccucuuggguuaaagugauucucguaccucagccucggccuuccaaagugcugagauuacaggcaugagccaccgugccuggccaauuuaauguuuuagaaguuuagauuuuuuuaaauaauuuuuucagugaauaugcauaaagaggaagauagaaccacacaacuuuuaauuuacucaacuaauacauuuacuuguaauaaaagcagcaacauuguagcuggaaucuggaguugaaaacaaauguaaucacaggcugugugacagugcaagagccaaaaaugacuuuugagaaaaauauaaugcuuguucagcauucagugagacaauccuaauuguuagauuuucugccuuagcuuuagauacacugcugauuuuaaaaucgaugaaacagucaucggccaaauauuuauugagugcuuucugggucucuggauucuaagcaccauguuagacauuacaaguagaaagaagaauuagaagugggcuuacuuagauaccuaauaugagagauacaauuagcuauagauuccugugaagagaaccaauggguauauaacuaacaacaugcauguagaccagcuuaagcagagaccacaucugaaccaaauauuuucaguaggagguucucuaaugaaaauguuuguuugcuaagaaaauauuuuucuuccugauguagugacauagaugaucaauaccuuuguucagguuucuuugagggugguuaaaauugaguuaaaaauguaaucaucugcagaaauguuuuaccaauuuguaugaaugcugccuauuuauaauaaaucaauccguagaguauaaauauuugugugacuucggugcaccaaauaaucaaucuauauauuuaguaagaaauucagaagcagaauccuugguuccugaccuugggaaguuucaaauuuaguugcaaaauaaacacuugaaauaauuaggcuaagaaauaggauauauaagcaccaaacaaaaagacauuaaaguuuugguaauaagucuagagucaguucagggaaggggaaaaguuggaguuguugggaaaugagugaaagauuucagagaggaagcagauaggagaauauaguguuauggaagguaucagagauacucuuagaagagauugacaguuccuguaucacagagauccaaggaaggaugaagaaaagauacugaaucugguacugugguguuuucuaacuaauuuugagagaguaguuguuuuuacaguuaagaaccaaaguaaaauuuccagagguuaaaucucuuguauauucuaacauauugauuucugaacuaauuucacaguagccauuugguucauauauuugacuuaaauuguacucagcuaauuucuuuuaguuuuauauuguuucuuaauguuagggaccucuugaauacuaauaaaaugauggcuauggucuauugguauuugcacuguguuaauacuuuuagugcuaauaaauguucauagagcuaguaagcacuacaaaaauagaggacugugaucaguggcuuuaguaaagaauugcaaaaauguuuuggcuuaauauuuaauccuuuauguaauaauaauauugguuuuuaaccuaaauaaccccaaauuuccauaaauuacucauaaaagucauuacuauggagucggucauugcacauaucuguagcuauuacuguaaugauucuuaguaacucaucuacugauuacuguaugauuaccuaacacuaugacuuaauaauuaaaaugcagaaaauauuuauuggaccuguacuauguuucagguauugugcuaggcuguagggauaccacaguauauaagacacagucucuaccuucauugaagucuaucuagagagagaaaaacacagauguguagaaugggaauguuuugaaaauuuaguugccacaaaaauauuguuuccuguuuagaucaagaacaaauaauauauguaugacuaauaucagauuaaaaauacuguaguuuauuauugcagugauuucauugauaguaaaaauauuaaguuguuucuucaaaccaagacauaccagaggaaauagaacauuuugaccaaagccuuuaaguuuuauuucaaacaagaauaccacaaaacauuuaauuccacugaagaauuagcccacauuuuauuuuugucauccaaaaacauuacauuccaaucuuccuuuuacugguaugugggaaaaacacuuugaaguagauaauagucuggauugggauuccauguagucuacucuguccagucagguuugcagaguagugaaauaucaccuucucuagaagauaacagaacuauguguuuguaauuauuguugaagauauaugaugaaaucauauucuugcuuuuuuuagacuucuuuauuuaaauguccuuagcaugcucugucaauuuaaugaauauuuuaaauucuucuguaccacucuuuucuuuuuugccuuuaacuuuguuuuggguuaaacuuccagacgugugauuauuuguauaugcuuuaacacacuuggaagaaauauauuuaaaaaauaaagcaaauuuauacaacuuucauuuuuaaugugaaauaugaucuauaagucuuagcacuauuuguauuuggggcuucaugugcuaagcuauauauauagauauauauaugcuuagcacaugaagauauauagauauauauauagauagauauaucgauauaucuaucucacagcuggaaguuucauuaaauuuugcagaauauuuaacuacuugcuucaguauagccucagugcuaucccuuguggagaugaguaaaaaacacagacagguaguuagaacuauuacauagucauauuaacaguugccuagagugaauuuaccauuuugucaauagauauuauuuuucagcuacuguggcaacuaaucuucagccauauuuccacuauuuuauugcaaauucuuaaagugaauagacuauauaugcuuauuauauucgcuagugugaauuaauaguggauuuuaugcuagcuauuuuggaaguuucagaagauaaugugauuuuacacugugaguuugguggaacuuauuaucagauaacagacucaaauauucagcacaaaaacauaguugagaaaugucaauacauauuuuuggcuauagagaaauaauauuaauuuuucauacuaaagcaucaaugugugauaauauucugcuuauaaaagccuaugucuuauuggugcagucucuccaacaaagcuggauagccagacucuuuuaaaauuaauuuaugaggacaagacuaucaacauacagcaguaaacugagcauaauugaaacuuucaagucuugacaaagccuugugaaaaaguaauauauuaaaaagaaugauuuuauauaugaguuugucuucaaauguaauuuuuauauuuuuaaaauucugcaguugucaguauauaucaaaacuuguuccccaaagaagaaauuuugaaauuuauuuacuuaauaaauauuuauuuuuaagggcaauguugucauucugaggauacaguaaugaacaagucucugagcuucauggaacuugaauucuacugcagggugugaauggcaaaauaauggccauccccaaagauguccaugcucuaaucucuguaaccugugaauauauuaccuuauguggaaaaggggaauuaaauuuuuagaugacauuaugauugccaaucagcuaauuuuaaaauacagauauuaucuuggauuaacuagcugggccccauguaaucuccagcauccuucuaaaaaaagaaagaggcggaagaugugaugacaaaagcaggaaucauagccagagagagagagagauuugaagauaccacucuucugguucugaaaaugaagagaaagccaugaguaaaggaauguaguuggccucuagaagcuggaaaagacaaagaaauggauuuccuucuggggcuuccagaaggggugcagcccugucaauaucuugauguuagcccagugaaacccauuucagacuucugacauccagaacuagaagauaaugaauuuuugguguuuuaaaucacgagguuugugcuaguuuauuaugacagaaacuaauacagagaaauaaaagauaauaaauaaacaaaaauauauauuuuaaaaagauaauuuccaguaauaagugccauaaaggaauuaaaaacaggauaggauucugaaacagugcuguccaauauaauauacacuaacacauguagcuguuuaaauuuaaauuaauuaaaaucuaagugcuacuaguguggccagugacuacuaucuuggacaaugcagauaauagaacauugcuaucaucauagaaacuugucuuggacagugcuguucuggagaaugguacuacuucacacagaguggauucaguuuguaugaggaucugagaaggaaucaggcaggugaaaggccucccaaaggagcaaaauguagagcaguaugugcuauaaaauaaaugaaacagaugugauguaaagcauuuuaaaaucucccaaaggccuagugcaauggcucaugccuguuauccuagcacuuugggaggccaaaguugaaggauagcuugaguccaggaguucgagaccagccugggcaacauagugagauacugucucuacaaaaaaaaauuauuuaaaaaaguuaacuagguuugguggcaugcacgucuagucccaguuacuuaggaggcugaggugggagggucccuugagcccaggagcucaagggugcagugagcucugauugugccacugcacuccagcuugcacauuagagugagacccucucucuaaaauaaauaaauaaauaaucugucaggauacuuuagggaccuuauuauuauuuuauuucaagguacucauaaccacuaauuuauucauucauucgucaagcauuuaguuacaaccuaauuuuauuucgaguuuuaugccagguaaaauauauacaaaagugaauauaauggaggugcuaaacucauagaaccaaagucuaguagaauucuccuuuuaaaaauugugguucauuuuggacagcacgguggcucacuccugaaaucccagugcuuuggguggccgaggugggaagauugcuugagucaagaacagccugggcaaccuagcgagauuucaucuaaaaaacuaaauaaauaaaaauuaugguucauuuugacggccacagaggccauugauucugcagguggagaauuaaacugcaauuucucaucaugcuagggagggugagggaagagggaaaccagcaagauucugcuaugcuggggacugcccacuuguccaguaucagagccauucgccaggucauuuuguggaccugauuccacucugguaucaacccacaucauauuuguggaagaagaagaagcaggagucaugaauuaugauucuccuagcgaaugagcgcauccuuauuaaaccuuguuaaguccugugaauaaauuuugagcuagaacuuuaacuucauacuauaguuuuguugguguuacugcuaugcauucauuucauuacugcuguguaguuuauauuaaugacauugacuuucaaauaucaugucuuagagaauaaaaaauagaguuucugauauaguaaucuccuuuaagguauccaaagagcugugaguugucugcauaugugcaugcauauguguguaugugugugugccuuuuuuguuugcuugucuuaauuuuuuaaaaaauguauuacuucaagacacuauaacauugacucauaaaauguguaguuauuaauaugacugaaagugccagaguuugcagucaguagguugcaauuuuccauagccagggaauauuggaaagcuguuauucaaaggcaaugcagaaucuuagggggucuauacaggaacuaccuuuuaaggaaaaugcgucuuaccagugaaagugauggaggaugauuuccagauguucaaaugcuuguuuuggcaacugcuacagaaaacugaaacguguugccagaacaaccaaaagggaugugaagcacugauguaagagggaucaggccauggaaagcaaggcaagcagaaaccagagaguauauagagagauaccagagaggggagauaguugagccaagagaacaaacuuuagagccccaguaauuacauguaguaaaagcauaucugccucuguaugaggaugcacacccaagcuuaucaccccugugcaccccacuuacacuuuccugugcuuucuucauuaucuuuccuguaacuauugaugucauuauguuaauugggaaaacucuuccuggcuaauaugcuuguuagauauuauggguuagugaagcaugcaugacugggguuaagcagauuugucuucaaaucuugaguucauucuugacuaccaggauggucuugacugaaucauguaagcucuagaauguucaguuucuucaucuguagaauggagguuauaauauuauuaccaaauagcuguugugagaaccaaaugaaauaauguaugugaagagcaugcaagaauagguuucuucuccaucugacuccuuccaaccaauuuccagaaguaacauuacguuuuuugcccaguuaggaaaaauacauuuucagaagacaucugagaauugcauguaauguuggcagacucacagauugaaaauguuuagcuagguugacuuuuugugggcucuugguuuagaaucauauaggcaaccagauacugugucuacaaaucaggcagccacuugggauuguuuucuaaaagaugagaaaauacaaaaaauaaaaauccaaccuugauugaauauguccuuuuacacucugaauaucugcaguguuucuuuucccccaacuuuuuuuuaaacacguguugauuuuacagugcagacuauuaacugccaucccaaaccaaccaguuccaagcaguucaagauaaauaaaauuccccaucugccuucacaucuuggugagaucuuugaccuucauuucuaaaucauuuugauuccucgccacccucccccaacuuacuucuacaaugcucuccacccuagcucauuucugaaaaagagauuuuuccaaucucugugcuaggccugguccugggccagaaaaagccaggcucuuccaaaaagccagccucugcgggaguuggaaccuaaaaaucuaauucauacugcaacuauuuucccaggggguggagcaacaggagccaggauaacagaaagggaucgcuguagggaacuagcucauuccacaccuggacaccugacuguguuccacugugaauucucugggaaagguuuugaagucuguauuuugaguugagcuacauuguguguuggcuuucacauacauuguguguauggccauuucaacuuaccauauuaucuguccaugcccuuugacaucuuaauuucucugaggaaacaucacagagauacaauuuagaacucuuugguaucauaacuuguagcccggaaggcauggagugcugaccuuaccuauuauuguacuugaaguuagaaacucucaccuuaaauccuagauuuuucaucuaugagcugcaucaucuuguauuuuaaauuauacauguaagugucagguuccauaucuaaaaaauguaaaggaugagaauacuugcucugauuacuuugcaguguguaaggauugaaugaaaucauguguguugaaguacuuaaagcagaguagauggcucccuuccuaguucuccucugagauuuugaagaauucuguucauauugcauuguaauuauuugacucuuucccucuacugacucaaaaacagagauuaauuuuuuaagcuaugaaguaagcaaaauagcauaauaguuaucuuucuaauauaacuacuggggucuuagacccaacaguacacuuugaagugaacucuauaguuaugugauuuuuaaaguaaaguggcuuuuaaauaaauauagcuuguauauaauuucuuacuaggauagaguuuaaccaaaguuauugagaaguauauaaggugugugcagucaguugaagaggcuccauuacagcagaguuuuaagaauaauuauagagaguaaaauuagagaagguacacuaguggguuuuacagugaagaagguaagaaaaagaguuacagaugaauauguguuuuuauggccuugcuuauauuuuaaacacaccuuggcaacuuaucauggaagagggguaaacuaacugaaaugaauuguauagaagcaaaaacuaaaugucagguguuuauuugauuugccaguuaucuagaucauccuuacuguuuaaacauuuaccgucauguauguuuucagucauggauucaacagaaaagacagucaaaacccaauuauuaucacuauugcuuuucuugugaagaucuguuaucuagauugucuuugcucugaagauugcuucauuugucauuaugccuuuauuaaauauaaaacauaaacaauuuaaagaccuacuauaacaccauuugccauagaaauuaguuugcuuuaaagaagguacauuuuggauguauauccagguaagaauguguuuauucuauuuuaauggaaggggugaagggcaugaguucauuucaaagaauguaagaguaagaugcuggggguuagugugucuuaaaauguuugcagugauuaucuguguggaaauggguuacauuuauuucuuauuauaggccaugguagcuccuuaugguagaaagaauaauaagccaauuuuggcugccagguaauccaugauuuuuucaucaaauuacguuacagacuacuguccuccauauuuaugcauggaaacacuuucuaaaauguuaugugggauucccuguggaaaaucuuuuuuaaccuuugaccuaacugagaauacaauggguucccuuugagguaaugaauucucugucucuggaaguaaccaagcaggagcuuuacagccacuuauggaugcuauagaagaaauuccuaagaaauuggacuaaauagcuucuuguucucuucugaugcucuguauaaauuaauuuaguguuugaggaaccaaagauaagcuuccuaaguucauucuagaacaaagaucugaaaauaguagagguuccaauaaacaucaagaaacauuuauugucuacagaaaacuuuuuaucuuucacgguuuuuuaaaugggaguaggagguuauaucaagaaauccaagcuugauuuaggucgauuuuauuauaagauggaaaauaauagcaguccauggagacacuggcauuucacacuaaacauuuuaauuuuugagaauuuuuuuaaaaacuaaaauuuacauaaaaaauuagcauguccaagagaacuccaguugauuaaauuccaaacagcaaucaccucagcacuguguccuaaggacuuuuauauugauaugacagaaugagaguugcauuuguguccugauauuuggcaauuagcaggagcucuguuugccuugugugcucaguugauugucaucugagagcauucuggauauaauuuaaugccuguuaagucaucucuaaaguacgauuguaauacaguaaacaaucacaacuguuuaguguuugcacaauugcuugcuuucauuugaccuuauuauagacugugagccuguuaguuugauucgugaaggcacacacauuguucaggaauguuugccaguaaugagugagggcuaguuuuccauauugaccucauacauaauuacauaaauuaaagcaaaccauaacaacugagggucacauaaaauacacuucacagagagauuuuaaagcccuugcauuguaccaagcuugaaauuauauugccauaagacacauauaucauuuuugaaaaguguauguuuaaguuucuacuaagacuuuacaaagaacacuaaauaaaagguucuauuuuaauaagcauuaccauggagauuuucucuagaaaaacuuggcuaagaaagaggauugccaguguuuuuauucuggagguuaaugacuugaugauagaaauuucuaaugcuaggcuuccaaacagucuugaaaccacuaaacacuuaggaaaaugcaaauguggaauuuagaucuuaacccccugaaaacauuagugauuuuuaaaauucacuuauaguuucuucauucuugaaauuucagaauaauguugauguuuagccaaguucaauuuaauuuuauaauuaaccuuuuucauaugugacuuuuuugguuaauaguguagucgauuuuuaaaaauguaaaauauacacaagaccucugcaaaugaaauugcauuccaugugacuauuuaagaaaucauagacuuucagaguuuaauggaauauagagccaauauuaaauauauuuaccaauaauuucuuuuagaugguggaggccaaaguuuuaguuaucaaucagauauuaagguuccaauauuauuaaucagcaaguauuacuucauuuauuucacuuucuaaaacaauuuuguuugaaguuuauagaaccuuauuucuauuguuuucacuaguuuuugaagcaacauauaagauguuaucaugggaaaaucuucaccuaacauuagcacaucaaguuuucuuuuugauaagaaggaaguugaaaugucuuuggcuggaguauuuuucauuuuucaaaacuuuuauuggaguacaaugagucuuauucugucgcccaagugggagugcaguggugcgaucucggcucacugcaaccucugacuuccggguucaagucauucuccugccucagccuccccagugggugggauuacagugcaugccaccacgcccaauuaauuuuuuguauauuugguagagauggguuuuugccauguuggucaagcuggucuccaacuccugaccucaagugauccaccugccucggccucccaaagugcugggauuacaggcgugagccacugcaccaggccauaaucaguauuucauguugaagaccaugucaacauuaaaaugagcuuaaugaccacuaauauauuuugggaauuuccauuuuugguuaaggcuauggucuguaacuccauauaugagauuaaauuugugcuuuauggaaaaaugaagauucaccuaaaucuaugauucuagaauaugcauuccuagguuuagcuaagucuuuuugauuguuauagcauuucauaauuuucugacacccuauuggagggcaauauggacucauguuuauuacuaacuuuauaauguuuuucucuucuuaauccucuuuuuacaucuuuuaagucucaauucacacccuucacaguuuaguagacuucccuggccuaucgcacucuuucuugguuucaucuucccagcuuagaagaccugugucuucugcauggauucauccagaguucuuaccucccuugggucugugguugcccuuugcuugauucuuuccaccucuaugugucuuuucuuacaugugucaacuuaugccacaugauguuuuucuaaccugcccauauuaugacuuuaagugucagauacuacuauauauaugcauauuuuuuucuugacaaauaauuguuggccuauaaaacuagcaucuugcuuggcuaucucaaaguaugacugugcaaaaacucugagaucauuuucugggucuuucacaucauaauauagcuugucaucuaagugaaauuuggguuucccuccccccagugaauaguaacauaauuuuuugugaaugcaagugcauuuuccacaaagaaguucauuuguccucuuucuauuaauacuaagagcaucauggcgcuuuuuaaugauaaucauugacauuuuuuaaaugucugaaguuuaggauaauccagaaaugguucuaaggaucugugauagacuccucaagaaauucuccaccaacucauuugguagagucccgggaccaucagagaggagauaaagcuucucuuccuccuucuccaccuacuuccuuacccuugggacuuugcuggggcccugggguauuaguuaaggcauguagauggccugcaagguaaagaagcacucugauauuaucuguaagcccagaacauucucuggguaauguuuuuucuagagacguuauagcacuguaguccuaggaagcccucaguauuugaauuuuuccaccugaagaaauauuuuuuuggucuuuacuuguuucuugacucuaagacagcuccuuaugcauguuagaacaucuuuccaaaucccauggugauucaaucuucaagcaguuuuuguaugaaccuagucauacaaguauucaagcaucauuuucccucccaguaccaugauuccucugugaguuguauuguguuaagaagauaguuauucucuccuuuguaacagauuccaccagaucaccugguugaaaguaaaccuuagauuuccagggucuucgcugaauucugucuuuaugaauggggaucauauugacaacuugucuuuucugguuugcuuaauuuguuacugguaggucauaugucuuggcuuacuguucaacauuuaacccuuacguuuuuucauaauuuucguauagauguuauagcaucuuagguauuuaucugugucaaauauaacaaugcauuuuuggcaauuugauccaguauuuuggacacacauaauuuaauauguaguuuagguguugaaaucgucaaaagaauacauuaaaagagaaaagaacuaacuauucuuuuaguauuaccccaauaauacaauuuuauauuuaggauuucuuuggauuccggaauugguuuccuuccucuguuugacauuuuuaagggucuucuuauuguuggcuuugaaguuacuuguuucacaaucuuuuucacaaauauaguuucacaaagauaguuucacaaaucuuuuucuggucuaauuuccaguuaugucugaugugucaaauuuuagaggcuucccuuucuuccuugacuugggaaaauuugauuuagaugcuuguuucuuccuaugaaggcagcuuuuacuguaauaguuugcugugaaagcauuuuuuaaugcaucuggcuuguuuuuaugauucaugacaaaaaauucaucuugggcuucuaaugauguauuuuaaaauagucuccagacgucccgugguucauuuuauuuuaaacuauuucuuuuuacuucuuuuuuaauaauggccagauuuuccuaaguucccuuuacuaaaauuaaauuauuuuauauggcauuccuuuuuucuugccaaaugcuaggcuuaaucauuuugaauacuguguagacagaagugggcacccaugauacaaccuucaucaauuccugcucaagucugccuagacucggaaaauccaauuuuggcaaacugaugucuguaaucaucuguauucuuguacuccaaugugcauucuguaugucuaugaugggauuacaauauaaauucaccuuauuuauacuuuauccaauguuuucacuuucuuucuuguuauacacuauuuagauaauuuugcuuaaauagugucccuguagcccauagaauaaguaagguucauauuuuuuaguuuaacaaccaaugccuuucauaauuugaucccuaauuauucuaucuucauucacuucccacugaacuuuuucuuuucuuuugcaguacaauucuuacuaaaugguaaaauuucacaacuguaccuucucccagaucuuucuggaauaccuuucccauuuccuucauuguucauccgaucaauguaugaagauaucaucauucuaaucaagauguuaguuguaggugccuuuucaguuaaauugcauguaaccuuccuaaauccuugguccuugccuucaauguaauucuacugucuugcucuuuaugaguccagaugugagagucauuaccucacucauguacauggcaaacuccacucaugucaaguuuuuggaaauuuaauaauuuaacugaagauuuuugguucuaaagaaggaucacaguauuaaggacuaucuaucuauuuucuccuuuuuuuccuuuucagaaaauaauaauuaugccuuaucucauauacuuuuguagccugguuucaccuauuauaugggucuuccccuauacucuaaguagcuuagaaaaguauguauuuuucuuuaaaauaugguacuugcccaauaaaaauccuucugaauaagaucuucuucagcucauuaauuggccauaguuuuuaaagagcccagaaugaucuaggcaauauaauagacacugauuauauagcaagaaaauugcaggucagguuuuuguguucauaaaguuuuagugugugauccaaauagcaauacauaauuguaaauuagauauucaauagauauuugggguuaugcaagugaauauuuuauauuuuaagcuuaguuguauuauuuuagggaauuauaguauauuugcauuacuguauuuuacuauuuaaauaggaaauucagugaacgcugccuugaauccauguaaaaaauaaacaagaagaaagagauggucaagaaauguaucauucuuaauuccugacgugugcaauuuuucacauuacuuuacucauuuaaguaaaauuucuauuggaguauaguucccaugucauguuucuaacccuuucuaagugcaagaauccuucuguguucucacaucccgcuuacucagagucugaaguaagaaaguuuuuauacaaacauggaaacacucauggcuucuacuguuucauacauauaggaauuaagaaaguauuuugcaaugcucugaaggcaauucugguuguagacuaggucagcucgggcuuccaugagguucuaaacucuaagaagggcuaguucagaaaggaucauuggaacaagaggaaaauugcaugcuaauguauuccaggagaugaugaaaucucucaucuuauuaauuuggcaguguugaguuccucuucuguagaauguaauuuccuuucuaaaagauaugaagcaucuguucccacucagaaccaaauggagaauucuucaucuacauuagcaagucaggccugcuuagugccccaacugugcuuacugcucaggauguucuacucacgcugacugguuagugcaucugguguuucacauuauuuguuggaauuauaagcacuuaucaucuucccaguucauuaggauuaaaaaacucugauaaaaguauauauauaaaauauauguauuuuuuaauucaagaagauggcaaauggauuuuuucagucuugaaaaauauauaaauauaauauauacauauaacauauauauguauguaugcacauauauuuuuguuuguucucacucauucagcauuguauggguacaacaaggauacugcaaccuacaguguccuuaugaagcuaacauacaugacuauacaaacacagaccaguucucuaauucaaaauuuacaguaaauaagcacugauuguuuuucuccccucuccuuugagaagauucuugcucagaaacaaaacuuguacucuccuaacuagguaaaacuaagcaaauacccaacuauguacuuguuuacugaaacugugugucaaacuguaccuuuuuuuucucuuucaucugucugucuuuugaguuuuugaauuguucagaaaauucuuaaguacuuuuauguucacuguuuucagaggcccaagagucuugcaucacagcaacaugguuucuugcagggaagaauguguuugaauguccacaccccuugccauaaccaucugguuugcagaugauaaauacaaacacuacguuguuucuuuuuuuuccuccucuaaagaucugggaaacagauugaacuuaaaauucuacccuggcgaucucaauauauuaaucuucauuaccaugucuaguucuuuaagaauuccaguucugcagcuauauauuuuuuaaagacugaacacauaauacguaugauauaccacuuguaggauuuuuuuauguuauuauaaugucuucauuucuuccuacagucuaguaauaucuuacuccuuuuucaaaguccaguuuaagaccuguuuccccugugaagucuuuucuaguuauucuaaccuccacacgucucucuuucauuguuuggaagacuucacaccaaagcaagguauauauuuguuuaaaaguuucaugcaugggcuuagcucccuaaucagaguaugaguuguuuaauaacagauuguucauauguuuuguaaucauaguauaauggacacaauggauauuuagaaccuaguugucgaauuaauacuucauuaaugccaucaaagaagccucauucuaauagaggauaugagagagacuuuauuaggaugggauuaaguuaggcagaaaauuuuacagugggaaauauugaccucaguuacaggguuagaguaggccuuuauacaccuuuugucugaaauaacauuagaaacagaaauggaaaacagugccaccucugggugacuucugucugaaauagaaaacagugccaccuccaggugacccuaggcaaguggacaggagcaaaauaaaaggcauuccuucuuccaguagauacagccccaagcuaggguucauaguaugacaaggagagcuuggauugaaugucauuucccacuggcccccucaguuggagucuuugugaaguguacaaacugcaaacaauauacaacagcccuccaaacagugauauagauaaugcaggcaagucaaggcggcuugguggcuuaugaaguagcugacacugcauacucuguguggcaugaagcuagaggcuaagcaccuagaaauuuauuuguuacacauuaggagagagaucgaacaaucauggcugauguggaaaauauuuacuuaagaauguagauuuuucauugguauauaaaaauaauauuuaagagaaugaauagcccagagaauagucaaguaggucaaaaagcaguugaugagauuuguaaggugugaacaauaaccagagugaaaaaaaaaaugacacaauucugaaggugaggacaaaguuguuauugggccagagugcgacugagggcaauugcugagguuugagaaaggugacacaauugaagggccauuuaagaagaaguuucgauagcuauguuuaagauagauugcaggguaaucauaguauaaagaaaucugaaggaugucuguccuauugaaagcagaaugaacaggaauuaauuaagguaaaauauggagagaauuuuuugguugaccuuauauaagagugggcauaagauaauaagcauuuaaauuauauucuuuaguggacauucauuaauauaaugauaaucauuacuuugaggcuaccauuuauugagugcuuaauaagugcauucaauuauuaagucuauguauaguacauuuguauaaauaauguuagauuuuagucuaacaaaacacauaaauauugguaaaugauaugcacagauauaaaaaauuuauaauuauggugagcuaguuggcugcaguauggaaaauauaaucuaugguauacauauaucauaaauguuaagcauuuauuuuagaaauaaaaaaacaaggauuuucaagggaaguauagauguuuaaauauaccuaguucgaagaguaaucuuguuuugcacuaaaauguauuuuauuauuaaaaacauuuuguuuaaaauuauugucaaucauaacaugaaaacauauagauuaaacuuuaaauauuuuggaauaaucuguauccauuccaaugauaacuuaucaagucuauacaauguuaacauuuacauauaauagggaaaaaucuaguucuugauuauaucagauuuauauuaucucucaccauaggcauaggaaauuccagaaaagaauuugacauuauuuauaaaauuacuauccauaaaacaucuuaaauauuuuuccuuaguuugaugaagcucaaccuuuagucuuucauccuugacauacauuucguuaucaaaucaugcaagcaaaauaugcagaauuggauuucuucaagugaaaaagagauggcuucacuauuaaacucuauaaacuccuugauccuauuaaaaggacgguuugcuuaauuuuuuaggucagaauacaccuuaagaaucuagaagaaauuuaacagugcauuucgcuauuuugaaauagcauuaguaaauuucaagaauucgggggaaguugggaaaugagcgugcuaacuuuaaaacuugcauuaacuacgugacccaugugacuauaugaacuuauuuuacauuuuuugguaagaggaaaucuuuaaccggagccauaaauaaauuaucccagucagauaauuguauauauuaauauauacucagcauagucuuugguuacaguaauagaaagaaugcaucugcaaagauaaggcucugaaaacugacuuuucacugccugugaaaucauuucgccccugugaaccccaaucccuuuauauguaauaaggcaaaauaggcaaauaauuucuaccuugaauagucgugagcauuuaucagauaacaucugaaaacugccuuguauaaaguaaacacuagaugguauuuauuauuauuauuaaugguaaccuuacgcauauuaauucaccaauguuuuuaacuggucuacugcacacuauauuuccagcuaacuuccaagucggcuuccuuaccagaccauggggaauccucagcucauauugcccagccccaucucugccugucaaaguccugcuucauuucccagaauaccucacugaaagcacaucucuauuaaaaggaauacaucuggcuauuuuauaguuccuuuuaauaaaagaaugcugauuuuaucauugaaguauuuuuaaaucuuaagugggcaaggugaaaauuuuaguauauuuuagaauaaaauauuugaaucuagguuaauuaacaaguaauaucuguguggugcuuaauaguuuaaaaugcuuuuuucauguaauuuauccauuucacuugcaauaagaauuauuaaaacuaauuuuuaauuuggaagaacugagccuuagaaaaauauauuacuuacucaaguucucucuaugguaauuacuagagcuaugucuucugauacuagaaacuauuuuucuuaguauacauuaagccucuacaaugagaaauaagauuuaauaaaaagaaggggaggggauacagauaauaaccuaaaagggaaauaguaaggaaauguaaagcuguaacuauagcuuuguacauuuugaauaaagaucaacuucccuauucucuuucuuccuuucuauauauauaugugcauauacauacauagauuuuucuguauuuuuauuauaagcuuuguugaagcacaguggugucucuuuguuuaaauuucuggucuauaaacauaucuuuguuuuauaauauaaugccaaaugugccuccagguuuaaaauguauuaauauucagaagaguccucuaaucugcuuaagacaagauaaagggaaaaaggcaauguagaaucagagggcuguguucuucauugaggcccugggcauguuuuuucuguuuacaauugcuggaaaauauuaguuuuauuuucugcccuauaugguaucguaucauguauguacauauguuaaagugugauuauuuugguauaaauacauauuuuacacuuugauucuuauuuuuauucuugauguuuauaacuggagaauuauagaaaugcuaaccaauuguauuuuggacaugauuuaacaucuggucacuuuuuuauuuuuuuauuuuuuugagauagagucucucugugucgcccagacuggagugcagcggcgccaucuuggcucacugcaaccucugucuccuggauucaagugauucuucugccucagccuccugagcagcugggacuacaggugcgcgccaccaugcccagcuaauuuuuguauuuuuaguagagacggggugccaccauauuggccaggcuagucucgaauuccugaccucgugaucugccugccuuggcuucccaaaguguugggguuacaggcgugagccacugcacccagccaacaucuggucacuuuuaaaauauacuuucuaauuuuagaaguuuuaaauuuacaaaauaauuguaccgauaguacaaaggguucucaaauaaucuagacccaauuuucccucuucuuaacaucuuacauucacaacgaauaagccaauauugauauuuuacuauuaacuagagucauacuuuaguuagauuuucuuaguuuuugucuaaugaccucuuucuguuccaggaucccucacaggaucccauauuacauuuaguugcaugucuccuuaggcuccuuuuggcuaugacaguuuccagacauuccuuguuuuuuaggauuuugacgauuuuucaggaguacuggccugauauuuuguaccaugucccucaauuaggauguguaugauuuuuguuuucaugauuagacuggaguucuggguguugggaggagguaaagugccauucucaacuaucaacaugaauuauuauuacugauauuaaacuuuaauaauuaauuaauuuauuuauuuuugagagggaguuucacucuuguugcccaggcuggagugcaauggcgugaucucagcucccugcaaacucugccuccuggguucaagugauucuccugccucggccucccaaagugcugggauuacagacgugagccaccgcgccaagccugguguuaaauuugaucaccugucuggggugguauuuguccugugucuucacuguaaauuugcuguuuccucccuuuuccauucuguacccuuuggaaggaagccacuauguacauacaguucuuacuuaaggaguggagacuuacucuucaacuuuuaaagggugggguagcuacauaaaucauuugcaauucugcauaggagauuuguccuauucuauuuuauauuuuguauguauuuacaucgguauggacucauagauauuuauuuuacauuuuuggugauauuugaaugcuacuuugcuuauuuuauuugucaaacuguuucaguuuuggccacuggaaagucuuucaguuguauucugugucccuuugauauauccccaucaugugggcuuuuuuguguguauguacuuuuuuacuuucgguuacuauaagauguucuagguucguuuuguauauuuauuggcccaguccuagaaucagcuguuuauucaaagagcucuuguuccuuauauuggagaaugcuaucagaaaccacaaucugggaccuagguguguucauugcuacuugggaguuguugcuucuguguucugucagcugacagagcaaggaaauauauauguguguacuaauaguuguauauacaaauaucuauauauauuucaauuaagcauguaugaguuaauauuuggaagcagagacaguagaaucgccugagaagaaaucugagcauuucuucucagauuuuuccuauaugugauauauaaacagaagcaaaucaagacauauuaauaaguaagauaaggguagagcuagacagaggcuggaaauaauaccuuaaaaauauaccgggccgggugcauuggcucacaccuguaaucccagcacuuugggaggccgaggaggguggaucacaaggucaggaguucgagaucagccuggccaacauggugcaacccugucucuacuaaaaaauacaaaaauuagcugggcauuguggcaugcaccuguaaucccagcuacucaggaggcugaggcaggagaauugcuugaaccugggaggcagagguugcagugagccgacaucaugccacugcacuccagccugggugacugagcaagacuccauuuuauauauguauauccuaaaccuggaguccucaacuggauuaggcccacacagauauuuuccugggcucaaacagugcuuugaaaaacuauuagaauuacaucauuaacaucaaacaauugagagaugucaaacacaaauauugauuucuaucuucucuuuaaaauuugccaggucugagaaauccuaggcacacaucauuuaugcacccaucaccuugugcugaauggugguucaagccuucaugaguauugcacaagccccaguucaacagcccaucuacccaucccccgcccccaacucacugucuucugcacaguuagaagcuagcucagguucuaguccaugugcugcuguuuuuucuauuguagaggagaaaggaaaauauuuccuggauccauggcuaacaaauuaauaagauaagaaaaagcauuuuccucuaagugaaaaguaucauuuuuuguuuaauacacaaugugugacuacaucaaaagaauauuacuuaaaauuucaguacaaaaucaacccagcucaccaaauuuggauuucucuaauccuguguucuucaauagugaucagaacauaagucuuccuucuugcuacuuguacaaaaugacuucaucaaguaacaugagccaauacagaauuuggauuuaggcguggccuugauauauauguuauuauuagauuucaaaacuucagaagacaucucucauguaagaguaggacuucauuuucugugauaauuuuauaccucuugucauuuccuauaaaagaccaaugauaauucacucaagauccauaaaucacauucuauugcuauauuuaauguauuauguuuguguuuuugcuugaagagauugguccaguuaguuuuauucagaauaaacacgaacgaagaaaacauuuguuaacuguagauuaauaauuguaauuauagaaccuauaauauagauuucuacuacacuaaagagauggaauuuagauucagcauuuuauuugacauuuggcuucuauuuuucaaaaugaugaauauuaucagacaauaaaaaguuugggccaucagcaguuaaaaugaaaauaaaguucagauuguaaguagcugaaagugaagcaaguuuauagcuugccauguuuuacuaacugaaccaaacuaaauauauuuggcaagacaauguacuuguggcaagaaaauggaaaaaagcagugugauuacuugaauaagguugaauuuaggucuaauuccaaguauuaaaaauaaauguaagauaaaauauaauaacuauuauaaaauauaacauuaaaaaguauagaaagaucagguuuggaaauuugacuaucucuuuuccccacucuccauaucauuguauuauuguuagcaucauaaaauuucauaguguuuaugucugucuguguaaacauacaaacacaagauuucuccauuguuauacauguaugauauuuuuauauacauauauauuuauaaaaaagaaaaaauauacagaugccaaaugugaguguauauauaacuaccuccuaguuaaccuguguaaccacaccuguguaaaagaaaauaucuauauccucaauacacacauaugaagcuuuuacauauauauaaguauauacauauauaagcauauauauaaauauguauuuauauacauguaaauuuguacucagguauuuuuguguacauagcaguaagguuuucauuagaagaugcugauuagcucacuggaaacuuucugguuugcagaauaauauguugucuuuuuauacacaaauuaauuuccuaugaacauguguagcauagauuagcauuaaaaauuaaucugauaaauacaaggugacuuaacuauuaaguuucugcacuuucagugcugagaaaacagagcuuuagucaggccuagcucaguaagucccaucccacucgcaaucauuuuauucuaacaccucccugaacauagcccauccagggaauaaaugugacugguggaccucuuucucugcugauccuccuuacugaugaaagguuuacaccugcaauaacacucucuuguuucaaauccagggccuaucacuuaugagggaugggaguugcugugagcuacuguugguugccucaugggaaugauacuguuuauugaggauuaagugagaucaagaauauaaaacaguuaggacaauauauagcacauauuaaguauucaaugaauguaagcuucuauugcugccucuccuauuaccacuauuauagcuacuaccaauuuaaacaaaauccuuuuaaacugaaugaucuuuuaauaucucuuauaaaauauguguucuuuuucauuaaucuggagauuuccuaaauguguagauauaagcauaguguuugcaacuacuugaagccaaaacaauugaaagacauuagccuacggauuaugaaugauaaacugccauguggaguauuaucuuuuguucuucaguucacuguuuguaaccaauauuuaugacacagagaaguaggauuugucagaaaucauugcaguacuucauuuucaagcuuaggcaguauuucuuuuaccagauauguacucugcagauucauagagcguucaaagcccauguguuacucuuaauaacucacaacugacuguguggcaauauuuucucauaaaauaucuccauuauaaauuauguauuacuuaaauauccagguuaggaagaaaaaaguugcuaauaggguugagguaauaguccaguaauccaugagcaucugugguagguucuguuuuuauaauuugguuguuuugaauuagaauguauaugguuuuaaauuaagccagucauuuuuuauuauuugacuacagccaugauguaagcugaaauggaaaauaggaauagaaagauaacaagaagaaaaguugugacuugaauugaagauuuauuacauauguuauauguaguccagccaacccaacguuaugagcuggagauaugaauacuauccuuaaaggcaagauaacuuuucaaaacuuuaaaauuaaugccuuguauaacuucucagucuguacuaauuucaugugguuaauaaggcaugcagaagcuaauguuguuacuaaugaaaaauuaauugggauuagaagaaauuucauuuucuaaauaauaaaaacugauuguccacccuauuuuccugauuuuagccaagcuuaagagauguaugugcaacucuuuugaauggcauuuaugacauaacuuguuucauuuuccugaaauuugcccuugguuuguuguuugcugacccucaaauuccaggaaggcauuuucauguaggauuuuuuuauucuaugaguucaucaauuuugaauuugcuuuaugcaaaacuguugacaaugauguacuuucuaaaauuuauuucugagauggagucucacucuauuucccaggcuggagugcaguggcgcaaucuugacucacugcaaccuccgccauccgaguucaagcgauucuccuaccucagccucccgaguagcugggauuacaggcacgugccaccacaccuggcuaauuuuuguauuuuuaguggagacgggguuucgccauuuggcuaggcuggucuggaacuccugaccucaggugauccaccugccuuggccucccaaagugcugggauuacaggugugagccaccacauccagcugauaaugauguacuuuaaaaauagagucuagcaaauugccaaaagguuauauuuauauugccaacuaccuuagaggaauuuucaggcuuagauuauaacuaacucuguaaaggccagcuggcuggugagaaugcauaagguucugcaugacuggcuuuaauacagaauggagggcaaguauaccaauaacucucagagugggaugaagaggaugacagaucuaacaaccuguauugauuccaaagaaaucaaucagcauaucauuuuuaguauuuuuuucuuuuuuguuggugaaagaagagcuuucauaaagggucaagcaauucuguauggcuguguccucccuggacugcauggucauuuucaagcagaggguguggcagcgauuucauguaugucuucccaauccuucacucagaaauaaacaccugaaggaaaacuaaaauagucauucagagcaggauauggugcuuuaaaaaucuuuuucuugugugaaacauaacuucugaacuccucugauucugucauuaacacuugguuggugaaguggucucucuagcuucuuuuucuagcuuccccucugucguaaggauggacccuucucaauuuacauuaggcccagaguaaugaacaccuaacuggcuugcugcauggaaucuuucccugcugccugacgcucuuaguucauuccguugucucagaagauucagucuuccuuuuuccauuucgcagcucaacaaaggaaaagacuucaugccaucccuaucacuaucaaccaaguaaaugcaaugcuguuaguugauguucaagaugucugauuaaaggcagccaacacccucuggcauguauuccacaagaaguucuuucuuucauaaagaaguugaauaggcugggugugguggcucacgcuuguaaucccagcacuuguuggggggccgcgguggguggauuacgcagucaagagaucgagaucauccuggccaacauggugaaaccccgucucuacuaaaaauacaaaaaauuagccaggcgugguggcaggugguguagucccagcuacucgagaggcugaggcaggagaaucacuugaacccgggagguggagguugcagcgagccgagauugcgccacugcauuccagccugccgacagagcaagacucggucucaaaaaaaaaaaaaaaaaaaaaaaaagucguacuugggcaguaguguagagauugguuugccuguuaaugaauucaaacuaaucucuacacugcugcccaagagcauucuauauucaacuucuuuaucucugagaaauugcuuauaucuccccaacuguuauuuccagaacacucagccagggaacacucaauuaauauuguuuuauuaauuuuuuuuuugagauggagucuugcucuguuauccaggcuggagugcaguggugcgaucucagcucgcugcaaucucugccuccuggauucaagcgauucuccugccucagccucccgaguagcugggacaacaggugugcacuaccacacccagauaauuuuuguauuuuuaguagagacgggguuucaccauguuggccaggcuggucucaaacuccugaccuugagugauccacccaccucggcuuuccaaagugcugggauuacaggcguaagcuacugaacccagccuguuuuauuaauuuugacaauaaaugagaugaauuguuaaaaacuacauugaaugcaucuuuuuuucuuauacauugugauuugguuauuugaauuucacucauuguuuuucaauacuauucuucuuuuccaaagauauuaaagauacuugacuuaaauaaaaguacauucaaauuauuauaaaguuaagauaguuuuuacuuaauaucugcagccaggacuaauaagucuaugcagcucccuuaaauacacaaaguucauuuccucuguuuuaacagaaauuaaaagaaaaacguaaaaucagguuuguaaccuuuccaaaaacaaguucccuuuuuucuucucugauuuucugaaguugucuguaccaaaaugauacuguuauuuaggaauguugaugugguaggaaacuucuacuuaugucucuaaaaaccagaccaugauuacguaucauaaaaauagaugcaaaacguggcuauucuggccacuugaggucagagaacuuugccaugacuauguuuaauuacauguccauacaacucaaugacuuauuuuuucaaagaacagacauuuuaauacaagacaaucaaaauaugaaccucaguggaugaauuaauagauaccuuauaaucaaaaucugucagccucugaauuaacccaaaguucaguauucacauuuuaucaauuauauuacauagaauugccuuguuugaaauauuuagguauucuuaugagaaauacauaauuacuaauuuacacguauaauuucuuuuucuccucuaauuuguuuuaacaaguaugagagguaaauuuagcuaaaaauuauguauauggaugaagaaauucucuuagaggaacucuaaaacuaauugaaucauacuugauauauuuguucuuuucaacaauucaguuuuuuaaugcauauuucauuaggguaccaucaauguguuuuccugaagccuaauuacacaaaaaauuaucacauauuuucccuccuucggguccagacagagcuguuauugagcuccaggccuaguugcuguuuuugcucaaagagauuuucaauguccaauggcaucucaaaguaaaccuuggacccuaaauuuuuuguccaauaacauauccugauugucuguggucucuuaagacuaucuaauucauuaagacauuuuuuucacccaagaaauuaaacaaauguuaaauuuucucagcgaauuucauauuuucgugaaauuuuuacaauggcuugagcaguuuaagaagaaaaaaaccuuuuugaugcuuugcauuuuauuugcugggaaauuaccuaggcaaagaaacuuauuguuccauuuuaugaacuuuacaauucacuuagcugucaaaguuauuuccgguaacccaagaaagaacuugauaccacuuuuuaugaugacaggacuuaaagaugacauuuauuccaauaagaaucgucauuugaaaauacuauguuauuucccucaggucucugcucaaauucuacuuuauuugugagcuugucccugauuauucaaaauuaagcucaguccccgcucuccucucaauucacuuuucuccuggagcucuuugucuuuaccuugcugaauuuuugguaacacuucuugcuacuagacauauuguaugguuaguaaguauaauauuugcuuauuuccuguuucuuuccacuagaguauaagcucuuuaaggacuaaaucuuuucugucuguuaacacuuauauuucuaacauugauauggugccuaagauauagaagguagucaauaauguguugaauaaauaaaaauaaauauauuaagcauuugugaugugacuugggcuuuauaaacuaaauuuuucacaggcacuuguguaaaagguagguuuguagacugguuuauacucuaauauuucauuuguaaaauggaauggaaacuuaucuguguagaagagauacuagaugcuagcuagaucuguuugaaaucuuuucagagccaagguggcuauuuaaauaugguggcaauacucugauuuuauuuccucauuucccuuuuaguucauguggcuacagugaagacccacuauguccuagaucccuugcuagguguaagggguacagcuaugaacaacacauagauacccugcuucaguggagaguagccuagcuauuaaagcaaaaauuaggaauaaauaugaugagugucuuuacaaguaaaugcccuuuuaaauugagcacauauuaggugcucaaaaaucauuguuaaauaaaucaguaaauaaauuuguaaagaggcuguauaucaaaacucaaauccugacacuuacuucuagaagucuauuucauagacucaccucuuaaaauaucucagugacuaaaaggauuuggaguaaauagucuaaaagcauacucauagguucuaaccacaaaauacuuccaucuucccacaaauuacuaaaggaaggaaaauucucaugugaaauuagacaagacuguuucuuucagaaauaaaaguauucaggaauguguuuguccguugcccuaucaccacaauccagggcagugucuggcauggagaagacagaaaacgcauuuuuguugaaucaaacugaaggaauauaaggagggaaaaagauuuuaguucuauggccaaaaagauuucuagaauaucacaauacagacauuuuuagcuaacuauuaauuuauuucaucuuccuuugcuucaaggucacauaugcucauauaauuuauaacugcugcaggcagaaccauuaagagagcacaauuucaaacaaguguaagccacaugagggcauaaacuuuauauuacgguaaaccucccaccacacagucuuuaauguagcugcauaauauguguauuugguaaauggcugaauuauaauccaaccucuuccccuaaaucuuaacauggaugaaguuuaaauggauguaugauacagauaaguugcucuucaauuccuaauuugaaaaugauuuccuaaaucauacacuauaacuugucccuuuugaaaucaaauaggugauuuacaaaaguaaaugucaccuaguaccuaguagcuuuugcacguaaaagagagauuuuaaaagaugagaaaaaaggaaauuugacauaaaauuauuauuuuauuuacaccauuuucucuucauuucugaauaauucaaggaaugucccagaaucaucucucaaaauagaagcuugaaaaauccucauugaaaaaucaguuuucaaacauuuuacauauuucauauugaaaaacauggauuuucagauuucuuuagcaaaucauuuaugggcugggccccuuuuagugaaauguaaggaguuuuuccugccaauuuauaaaagcauagaaaaacaggcugaagacacagcugacagccuuucggcuuuaguaucgcuagccaucuguuuucuauaagguaguuguuuuuucuuguuaaguuccccgugugaaauguuuuucuuuuuuuuuuuauuuuugguuugugaauucuacccagugauaaaacucaccaggggaccauaaaggcacaaauggaaucugggagaacuuugagacuucuuauauucacaccagaaucucacuuuacuaaucuaaaucagagacuuuuuuccauggagauuuguuaccgaaauaccagaguccuaauugauuaaagcaauuuuaauucaagaggguuuuugccuuacaacagaugauuauugagagagauuucagguuuaugauaguuuucggugauaaacuuuccuaaggacgcaagugccccauuuagcuuuucucuguuauuauaaggaagaagcagaagauauagucuucucuaacagcuggacguaaggaaggaaaggugccuaauugggaaugaucauucuaaagaacaacaguuuucuuguugcacaucauuggaaugcuuauugugaggacgauaguaauuauuucugaaucuggcaucaaaauacuagagaugcuucuaaaaaauacaaguuuccaguuucaaaacaaaaucagagucacuagaaguagggccuaggaaucaguauuuuaaaaaauucucugagcgauucugaugcaaagccagguuugaggagcaccaacuuaaaagaaaaucaaggcugaaauuaaaaagaaaaaaacaaaaaacaacaaacucuucaauaugagggauacacagcauuuaaaaucacaaacuacauauaauuuuuaugaaacugauuuuggauaaaauauuugaauuacagaagagcugaaagaucauaaauauaugguuacaaaaauaaccugaagcuuuggauggcuuggaaagauaauuacugggauuugccucccaauucugcaagcaaaauaccaccuacuuuuuacaaacauaacuagcaagguauguauggguuauauuggcagaagucacaaaacauacuucaauggcuuaaaaugccucuugucaaggugccuuauaauuagcuucaaaagccuuccagcugugauuccauuaaauacagguguauugcugugggcagcuacaucagguacuguggcauuaauaggcucaacuaauugcugcaguggauuugugcaguauuauaugcuuacucagaaaaauuuaucuugcccucuuuccuacacuuaccauuucuguucuugaaaucugagugcacuucuguuuuaugaccuuauuuauauagacagacuugaccucagggcguuuuguggaagaagcagcacuccuucacugugaucauagccuuauauaaauggauuuuugucaauauaauguagauuuuucucuccugcugcauccuacuccagauucugauaggcccuauaaggaggagacaggugagcaugacucuacauuugauacacauguaaauggauuugaaucaggcaagagaaaucugggaaccucugugcuaaauaauaaugguuugugucuaaauaacacauacuuauuuuucaaagcacucucacaucuauuugauucucagaacaaccuugggaaggggguauauuaucccuauuuuuuaggugaaaauacaugacaaucaaagaaauuguaauuugucaaguguuacauagcaaguaguuuucaguguuggugugaaaaaguaaaauaaauaaaaaagccuagguuuucugaacuacucaauuuccauuccuccugcaucguuuugccucuuaaggguuuccagugaguagauuaagagccaaaauacaucugaaaggcuauuaguuagagcugcaaauuugcuuucucuuccuccauuucuucucauucuuuugauuuggguuggcaaaauccuacucacucugaagaugaagccaaagaaagaagacugaaggccaucagaaaucugugguccagacaccugaugcugccauuuuuuccaacccugucccuuuuuaaccacucaauuuugcuuuccuuuuuuuugucucuucucuuucccugccuuuuaacuguauugaauuacaaaucguuucuggauaaauucuacuucuuucucaauucucaguucauacaucacuuccacaagaaaagguaucccaaucccccuacaauggcuaagcaaugcuuguacacacucccuaagcacucugaauuuauuucuguaaguugcuuaucguuuugcacuuuaguuccuugguuaucugauugucuuccuaauuaggauauagcuacuuggaguuagagggauuucuuuuguuuuguucaguuuuggcaccuaaagaagaaauggcacauaauagguacucaguauuuguuggguggaaaacuauugucucugcucauggccuuagcauuccaugcagugcaguauuucuguggauauuucuuuggagacccaagucuguuuccucacccugccaagacuacuucaaauccccuacauggcacacuggacugcauauauuucauuuacuaaauguggccauuuuuguuaugcuguuauuagucccuugguuuggaaugcauuuuauuauuauaaugcuaccucuguaggggaaauuaaauuugacuuacaugcuuuacuaaaaagccuaauuuauucuuccugaguuuuagaagccaaagagcugauuuccucuuuccucuuaagaaauucugcagaauguuccacuugaugugcucuaagugccuugucacuuuucuugaaauucauucuuguuuagcacuaugaaaagaaauaaaaaaacuuauuuuuaauaacuuuaagaaaaagaaauaauuucuuuugguaauaaacacuagauauuaacauuuuaaaauaaaaauauuacuuuggguuuaaucacaacuuaaagaaauuuuccauaaacucuucucauuacacaaaauauuaccauuggaaagaauccacauauacugacuuuuagguaauaugcauuuugcuacuuuaucauauugguuuuuuucuuuacuaacauuucuaauauuuaaaucuuaagaugaacaagcugaaugauuguuaagugaaauuaaucucuaauaaauuuaaguauaacauaguuccuguguaaaaaucaauuuuuaaauuucugaaaacuuuagaacacauauaguggaguuuguaauuuaucauauguaggcugguauaaaguaguauaaagucauggcugggagaggguuauuguugcagauuucauauuccuguaaguuuugacuaaacucuucaccuauccgucuauaguuaaaggaauccaaagccuggaucccauaagaaauaagcaacuuucucuuaauuuuaugagaugaggaagaaucauguugaauacaguugucucucaaacaauauggggguuaugggcgccaauaaccugugcaguugaaaauccacauacaacuuucaacuucccccaaaauuaacuacuaauagccuacuguugacuggaaaccuuaccuguaacauaaacagaugauuaacauguauuuuauauguuguuuguguuauauacuguauucuuacaauaaaugaagcuagaaaaaggaagauguucuuaagaaaaucauauggaagggaaaauauauuuaugauuuauuaaguggauguggaucaucauaaauguagucauucuuauuaucuucauuuugaguaggcugaaaaggaggagaaagagaagggguuugucuagggguggcagaggugggaggaaauccccuuauaaguggacccaugcaguucaaaccuguguugcucaagauucaacuguaugugaauacugcuguaugugcaauuugguguggauaugcagaauaauuuugucuaugccuuagaauuccuaauucccagggaagucauugguaaaugcagcuggacauaaaauaaugccucuaaaucuacuuaacuguuuuauuuaccaauucagauacugugaauggccuuauucccuuaugguugaaccucuacaacaucagagaaguuucuauugguggauacauaccuugaguuucuuuuuguaucuagcacaucuugucaucucauuugauaauaugguccagucaugaaaaguuugguugaguucauaauaaaucccauaguucuuuauacuugauauuuagcccguaaaauuccauuaaauaauuuuuagucauugcuauuccauuaacacuauaagaauauccagauucacucaguuaucugccauuaaaucaguaugcaaauggaucauacuuagaauuuuuuauuagaucauaugcuuuuauugcuauaaaacaaagugagcaauuacauuuauuucauuauuugcuuuuauuucuaauccuuauugccaguugaaucuauugugacuaaccugaccguuacuaaacaggaaaaaaauugaaguuauaaguugguccugguaggaagauuccauuuucaaaucuauagcaaagauuaaauuaaaaaaaaaaaaaagaaaacacaguuaagaacuuuuuaaaauacuaguucagacuucagaaaaaugaaagaaaaugaaaacaugaauguaauguaauuuaaaaagcagaaguugauaguuuucuuuaaauugcauuuuauaauguugaauuuuauugaauuuuuccucagugacuuuuuuaucauccccuguuuaguuuaagugaaauagcaagcauggugcauucuguuugcugaacggagucauguuuauauaaugcaagcugaauauucuggggaaaaauuucauuuccugcgcccuauaaacuaaucuaaacagaacuaaauaauaguugguaugcaaucauuuacuaucccuacucauuaaaauaccugaaagacuuauucaugucauggagauagucuuucccccaucaauauccugugaggccucagaaaagcuagggggaauuucaccggauauuagcaugguaacauuugguggcuacacaggcggaacaccaggaaaugaaauuuccuccauuuagaguugggaaaugaauagaaagaaugggguucgcaaucuuaguauauuuuaauugcuucuuguucucacacauuuucuuuuaaaacacccuucuuaaucgcuuccuuuucucaucucuaagguaaaccaugcuuuaccuguuuuuucuuuaacccaggcuucuauugcucuucauucuucacaggagcucuauuugucacuuuuccacucucuuagucaaaauccacauuuagagugugacuuaagacuuuuguacauguaaaugugccauccccuuaucuuuucucuaacauagcaaucugguugucuaacacaauguauaauaguuaugggcguauauuuuuuuuaaauauuggcucugccacucacuagcuuugugaucaugauugaccccaagccucuaccaggaugguuguuaggacuauguggaaaauuuuuaucacucacuuaacauaacuuuuagaacacaauuaauagcugccauuaauauuucuacuggguuauucuuccuuaagauucacuccaacaugccuuaaauagaguuuaggauuuuuaaaauaaaauuuguuuaucucuccaaaacuuuuauuucauucgaugucuagaccauacaccuguguuacuuuccuaggggugcuugauaacaaaguaccacaaacuggguggcuuaugacaacagaaaugagugucugagucucuguaucuauuccccucuucccuccuuauaaggacaccagucauauuggauuaagggcccaucauauuccaguaugaccucaucuuaacuaauuaggucaucuucaaugaccuuauuuacaaauaaugucacauucugaaguacagaggauuaggaauucaguauaucuuuuagcagggcacaauuuaacccaaaguacccaguagauauuucuuccuccauucauuucugagacucugaaauuaucuuuaaaaauuuuuaggccuggcgcaguggcucaugccuguaaucccagcacuuugggaggccgagguggguggaucacuugaggucagcaguuugagaccagccugaccaacguggugaaaccuugucucuacuaaaaauacaaaauuagcuuggcgugauggcacaugccuguaaucccagcuacucgggagguugaggugggagaaucacuugaacccaggaggcgaagguugcggugagccaagauugugccauugcacuccagccugggcaacaagagcaaaacuccaucucaaaaaaaaaaaauuaaauacuuuaucccacccaaacuucaucaaacccuucguauuuucuaccuagugucucguggcuuuaccucuguucucauaacuacuguuucuccuaacuccaguauaacauuuuccacuaguggccuuuggucucauuuauuucugauuuaucuuuaauuagguaguuacguuaauauuccugaaagcuucuuauacauucuuuuauuuauuaccuuuuuucauuuauucagcaagcauuucauguaucaggcacuuuaauacacucaugauauagagagaaauuaaauauuuuucauucucaagaaauguacagcccaguagaguuuacaugcaaacaaaccaauaaguguaauagaauguugcagguauuugccagguguacggauaaggugagaugagagcaagagaagagaaugaccaaauuccaugugggcaugucguuaaaacuuuccuaguggaagagguaucacauguaccaaguauucucaucaccuccuuuuuuugauaaauuaaaccauccccuccugaagcuauguauaugacauguuuuccucccucucuauuccuguuuuaggugguucccugccucuuucccaggcagaguuuuccuuacccccaccaccucaaauaccuucuauuuuuucaaggccugcuuaagaacccacuucuacucacccuuucucagauaauuucagcuuauagugauaccaucuuuucagauuucuuauuuguaauucucaaaccucguaucuuauauaaacuauuugcuaccucaacuaauuguggucauugaagaaacaacuggauagaagauacuuuacauuuugaauguucuuaguaaauauuuguuaaaagagugacuuuauaaacuuuccucuaagcuccucuggaguagcuuguguaucuuuaacuuuuguaucuuucuuccaugguauauagucaggcauacaguaaguagacucaauaaauacuuaaguaaucuaugaaaaugaguauaaguggaugugcuaaguauaaguaaaauaaacuuuuaguauggguauuuaauaucuuacuucacaguguuuucuaaauuacaaaagucagcuucuuucaaacuagacauuauacuauuuuuuugacuuccuaaaaugucaaaacacaauaauccagaauucuguaucuacaauugaagaaagacuguggaauuggaccuagaaaaaugcuuuuuuuuuuuuuuuuuuuuuuugagacggagucucacucugucacccaggcuggagugcaguggugcaauuucggcucacugcaagcucugccucccagguucaugccauucuccugaaaaaugcuuuuauaguuugucccaguguggcuagagugaguuagucaucggcaacaaaugguuccugccauguugcugugcaccacugucuuggcuucuggacugcuggcccgcaccaccgcaagagccccaccccuccuccaaggcaccuucccauggacauaccaguugguuuagaaacaagagugcuguuguuuuacccucagucaaaggaagagaugguaaagaaauuaaaaucagagucaugguugagagggaguaccuggucuccuucagauccauccuggccaguugguagagagaaggaaucuguugccaauuaccaggaaggagccaggaguaacaauauuauacaccuuggaaaugaauuuuuggaaaaaacugcuuuggauuuuaauuuucucacuugaaaaaaaagcaacccccaaaacaauaaauuaaagaaaggaaauaaggaaguuaaagaacucaaaucccagauuucuuuugacuucucugaccuccagccuagaugauaugcccuuccuacauguucccacaacaaccaagauuugccuauaauuuuguauuuaaagaauuauguucuaauaaucuguuacugcacugguucucucaguagucuguaaacuccguaaagguagagaggaauucauuacuuuaacuguauucccagugcuuggcaaaauaacagauaaauauuuguugaauaaauaaacaauauuaucaaaaugcauacauuauguuauuuugauguuugcuucaagaauaaguguauuuauuuuaugauuuaaacacauucuuaaugccaaagguguuggaagacuaaaacauacagggaggacugaaacucacacagaggaucucuaaacuguggccuuagccauuauuauggcugguauauucugagggaucauugaaugauuugcauuuauggguuuccacuuucucucugcuauguauccagacugucuuggugucuaaggguuuaaaauauguuucauuaucaaauaggacaccaaaggagaaucaauagaugauauacucauaagugaauguaauguuauucuguauucuguucacccuuacuaauuugaaguuugcuuuuauaaacagaauuuuauauuuccauaaugauugaagauuguuuuuguuuuggauucuaggaaauccucagguugauguuccccagacuuaguuguaguuaaugaaaauaaacagcauuagacaaaaccucucaaaacacagaggaagauuuccaagauaaggaccaauaauucaaaaggccccaggauacauauagguuagagaaaugaaaaaauagaaugaguuuaugaaguuucaguguguauguaauuuuuccagaaugcacuagugaaauacacauaugagcaaaaucauucuacaaaaaauucauuaucuuuugcagcuucuguauauuuugguuguuuuuggcaaggaaguugaacuccaaaugucucauucucugauccaaaguuuucuuuuguacuaaacaaguauuuaauaaaauuguuauuauauuugcuagauaaauaacuaucgauuaaauggauuaacuaaugccucuauuccuuuuuccagauugacaaauuuaggaugagcuuucaaacacacuuuaaagcaaacuucuuuaugacaucuuuaaauauuucuuaucugcaaaaguaaaggcucauguuuuaucuuuuucuauauguuaacaaguagaaaaacugaggcacacuuuucauuuauuaauuuaguaauaaccaguugacuaguaaacaacuuaguuaaucuuuuguccaaacuaaauuuuauacuccuuaguuuaggaaauguuauauauuuuucuccucugaucucagcaugugcuaaugacuguauuagcaagaaauaaguauucuguaguuacuuggaauuaagcaaauuuuugaaagauuuuagaaacuuuaaaucuuuccacagguauuuaaagaaaaugacaagaguauuguuuuccuuuauagauauuuuauucguagucaccauguuuaaauaaauuaaaaugugaauuauacaauaaugauaaaauucagaauuuaaaaaacugaaugaauaacauuaaguaauaaucuaaaacuuuugaaauucuaauaaaguuugcccauguuuacuuguuaaggaaaauagcaacuucuccuuagaagcacauggauuuguaggugaaaaaucuccgauucauucuuuguauuuucccuaauaggauaaagaaguaucuucagguuaauucuguuguuuucuaaagaaacuuguaaaaccuccuucuugauguaguaaaguuacauggaaagaagaugauugucucauccuccuuccucuaccccucucccuccuuccucucuucauccuccuugucuguuugcuuuucuugucuuuuguucucccuacaaguagagaaauuacccaaugaagagcuuugcugugcaucuaaaaaguuauugauauaacuuuccaauaaaggcaacaacucuuuuucucauaccaaguaugacuauggcauuuggcugguuuugagauucagagcauauugaguuuugaucuuaaacaugcaauaaauaaauuggcuuccaugcaauuaugcacauuauaagggauaaacuaaauaugaagauuaagagaugaauuuagguucugaaauaacaauuacaguuuuuuuuuuaaagauucuauuaccuguucuggaagugacuuggaaaggaaugccagaaagaagaguaaaaucuaguuuuaguuuuguucuucagcaaaaucacuuacuuuuuuaauagcuagaaaauagauguaaauuaaaucuguguaaagcagaacaaaacugaauacuaauucaagucacuagauauuuccaagaggauaaaauuagaaauuggccuuugggaugacagcacuagucuccuuucacccaugccuccagaacugagcuccagagggaauaaugcagaaagaggcaucccuuuaaauuccuauuagaaauuuucuucaaaauauuuuagaauccuugguacugaaaugaaugggaucaaagagccauugagaacuguggaauguuugguggauuguaaaagaaauuucaacuugcucaaggcaagggcagagaauaaagaaugaauuggaagaaauaagcugacuacaaugucuggauuuucucuagaggcccuaaauauucuucuguaucagggaaaauugaaaaaggaggcaaaaugcagcugcaaagacauaauaaaauacagaguuaaauugauucuaaaauguuuuauguaaaauauuuaauuuuauacucauugaguauacaauaaugaauauucucuuaaaauacaauaauaauuauuuucaauuacaaaaaugaguaaaaauauauguucuuuuuaggauauaaugucaggaauaaaugauaauacaucauauuccuauaauucaugguauuuuaaagcuuuguagguuuggcccacauuuaaauaagcagcuaaaauggcgcuucucuaaaaaucagguaauagcccaggguugaagcauaucauuuuguauucaauauggccuagaucucuuacuugguauucuuaacaauugacuuuagauauaaaaaucccuuuuuauauacaaaagaauauuaugaaaugacuuuaccauauaaagcuucuuaagcaaacaacuaauauucaauaaauuaauucaacaaauacuucuugagcauuuacuaugauccugacacuauucuaggauaucagaauauaucaacaaaggaagcaaaauaaauuauauguguucucacagagcuauaauucuaucauggggugacaaacaauaaacauaauaaauucaauauauaguaggcuugaaagugguaacuacuacauuaaaagaaaaaaaaaaaagaguaagaauuagugaauugagaguguuaugguuguauguguguguagucaugugcaauuuuuuugguaaggugaccagaguagguaacauuugagcuaagaccagaaggagaugaaggaaaucuggaauguggauacuauauauuacugaauauuuacuucuccuuugaaagagaaacaguuaagcagauuuuugucucuccuguugaucucaagcaauauuaggcuaggagagauuaaguagacaucauucagaacacuuacaaauguuucauguauuuagguaggcagacacauuuggcauagcucuguaccaaacuuauucacugaggauuaauauuuaagauuagaacuaagguuggcuauaaaaauuacugcugaaauuucuaguguauagauuauagaguuggcucaauucucuuugugcuguuuugcagcuauuuaguaguuugagguaugugggaaaaaaaaucuaugucaaaugcauuagcagacugaaaucugcucuuccagacagaacuguagaugagcauugcaugugcaguauguguaguuuuaguuucacguuuuggccacagucauuuagauuucccaaugauacauggaaaaaaacuuaaguauaccuaauaugagaguuuuuccuuucuauuuuuuccauuuuaaguaaaguaaaaacagcaguuuuacuaguuaacugaaaaacuuugcuuaugagauuggaaaacauuuaaugguugcacugaagaaaccaaccaccuucacagacaguuuaucaaauuuuuuaaauucauaugcucacugaaaugcauugaaaugaagcuuucuaugagucaucuccuuuucaauuuuucagauuucaaggaaaauuuucaaaauugucauuauauugcuuuagaauauaaaacaugauuguccuuaguggaacaaaaauuuaacucagcucaaauaauuauugaaugccuacucuuguucaguugguacaaggaaaaaaggagcagggcacagaaaaaguaauaauuuggauaacuauccuaaaaccagauuuaagcuugcggggcucacuagaaaguaaaagucuuugcaguggauugaagaacagaagauguaaaaccccauaggccuaccccauacauacuuauccucccaccaucccauagaucuugaggcugagauagaaaaaaauugucaaaguauguaauagaucccccucagguaucccugguggcuucauauguaucuaacuuuucaaauuugggaguuguuuaaggaaagcaaaaugaggaauguggaauuuuuggcaucuccucugcauggucuaaagaaggaauugaaugcugucccucuucgucuuucccuucuaaugauaaacagugcccuagagcagaaggaagggaaggauuuccuugguagguucucuggaaccccauccaggagcccacgcucugcugugcauuacuaaaggcagcaucuguggcauccagacugacacgugggcggcuuuauuaccuccuccuuugucccacaaggcauucucucuccacuucaugaggccaccagcugacagugucaugauuauagucccucaaggaccuuuacagucagagaaacuuuaaguaaugguagcccagaucuucacaaucccaaaagggaccuaaaucugcugggucaggaaggcugaaggguugcuguagcuuucugaagguuguucuaaaauaugaacuguugugacugacacagucuucuuccuuucuggucacacagaggccugaaugucagggacacaccugguaagaaccaccaagugaccauucccuuucauucaaaaaaggguuccuaagagcacauccucucuggaaagauuagggaaggaggaaagagagcuaaaagugcuuaucuuuuuaauaggcauaucaaugaacuaguuccuuacuuuccucauucacaucugcauucaucaaugcuacacauacguuuaucaaagacggauuauauaacauuaaaugugaagguugcugagguaaacacaguucuggcugucgaggagcucacagucucacagcucacaggggaaaaugaucagcacaaaccugugucugaauaagagauuuaaaauuuuuauaacacgugugugcuguguauuauuucugcuugaaagaacuuuaguuaauggcuagagaauaucuaacauaauuuuagggacuuuuauuucauauauuuuucaaagccuguaaguagacuccaauaauuuaauaugcaaauacagucgucucucuuggccaguccaagguuucaauauggccguuucuaugcaggcuuuuuuuuuuucccccacagguguaauugugugaaaaaauguggaugcagggcauaccauauaguuggcaagcugcaauugugauaauuuaguuucuaauuguuauaauaagaugguggauuuggucugccaucuagugauuaagaacugaauucuuacaacuaaauuuaaaagcacuuaagauuuaugagaagagaaaucuaugaggauauaugagaaacagaaaaauugaguugauuucaaauaaaaugugaucagauaaaauauaucucuuuucuguaauauaucagugccacaauuguugugggaaugacuucacaauggauucaauuuauuggaacauuuggugaggguaaaagaaucuuguagguugggagauaaacaugaaaauuacaaaauagugaugguauuaucagauuucuaccaguccuaaucaauuuuaggaaaguuaaacauaaacagcaaaaaauacaaguaaugcaaaauuauaguuuuggcguucuuuuuuagauuauauaaaaauauuuaucuaauuuuuaaauuuaaauuuuauuuuuauuuuaaguuccaggguuuauguggaggaugugcagguuuguuacauagguaaacgugugccauugugguuugcugcacccaucagcccaucaccuagguauuaagcccagcaugcauuaacuauuuuuuucuaauuuuuacuaaugcucucccucccgcaaccccacccuacucccugaccggccccaauauccagguauuuuaagaaacauuuuuuuuuuuuuuuuuuaaguccugggccuugaaucuaagcuuuggacgucagcuuggguuaauuuuaugauuuggauagagaaaucaggaggacagaauugaauuucucagaaugucauuugaaaauuuuuguuauuuuauacuguguugucauuuauaaaauaauucuauuaugacaacuuuacugcaauauuuuucaacaaauuggcugcaauuuugcuuucuauuuuacuuuucuuuucguuuaaguaaaugucuguguagaaaacagaagggacaacuuaaucauaugguguacaacuaccauguagauccgugaaaacugcaagacacccuguauuuucuacccacuguuucuuuguacaugucuuucauucagacauggacaaugagaguucacugaguuuuugagcccucugugauguguauggauucuugucugagugaagagaagacaagguuuaacagugaaugugguuuuucgucuccuugcuauuuaaaagcauuccaacuaacuuuccacaucaucuuaaauuuaauuauaaauucucaggagaagggaagccaugaugacucagaguauaaaacuaaccuuuaacauuaucauuuaaagaaaguaauccaguggcccacuucuuugccccuugaguugaaguuauguugucuuaaacuuucagaaagaaacugcucuucuagguguuaacacaagacugagacaaugugucuuuuuauuccaacccuaaaggagccacaaggaagaagauaagcuacuccuugaagaguuccucacauauuuuaauauuuaauugacaucauuacgugucaucuuguuuuuguuuuucauauucucugcuuccaaauaucuaauuaucccaucagcauauauauccuuauauauaauauauauccaauaauaacauauuuuguuauaauaauucauuuuauaaaucuucaggggauaacuuauccuguucucuauggcuccuucaagauuuauacaauaaacaaacauauauuauauaauuaaaauuauauaauaaguuaauuauauucaucuauuauauaacaaauauagcacuccacaauguuauauauauaaaacauacauauauuguuauauguguaacauauauaauauauauaauacuccacaauaauauauauuuugaggacagaaaggaacacauaugcuuccuucuugucuuuucuuuuugugaguccaggucucacucuguugcucaagauggagugcaguagcauagcguucccauagcucacugcagccuagaacuccugagcuaaaaucauccuccuaccucaccuucggaguagcuggagcuacaggcacaagccacugugccuggcuaacuuuaaaauuuuugcagagauaguaucucacuauauugcccaggcuggucuugaacucuuggccucaagcaauccucccaccuuggccucccaacaugcugggauuguaggugugagccacuacacccagccacauaugcuuucaauauuuugcacaauuaguacuaggcacauaugcacuuaacucccagcacccccacccaagaguguguaaugagagaaacaagcuaauugaaguaguaucucauuuucagguaauagcauuuaacauuuguaaguggauauuuccuucucaaucauaaaacuuaaugagcaaaauuacccuuaaguuaucuacuuaauggaauuguucagugaacuauagacauaagcccauuuuuauacagguugugucuuuggaaauguuauucauggaauuacacuguguuaaagugauauuucaucuaaaagucacacuguuuauuugaugaauacauuucucauuuuuucaaaauaaucuuccagaaaagcauauuaaaacauaauuucuauuuuccccuugguuuuaaaugacuauaauagcacuauggacauagagcuaauacuguuuuguugauuagauauguauuaugugauacaagucuuuuaaugaagauaaaacagauuagaaacuuguguccucaucuuauaaaacagcacacaaaccauuaggauauaguaguguuacucucugaaagcaauuuuccguuugccaaauaucugugaugaaagacuaaauacauaaagcaaaauauuccacaggacagugagaaaaauguuuuuauuccagcuuuauuaagguauaauugacaaauaauaauuauauaaagcagauuuuuguauuaauaucuguauuguaaacuaaaauaauuuucauauguagcuuugcauuaucauuugaauauauuuauaugccaaaugauaauaucuuucauaaacugauuacaacuacauuaaaacaucuuuuuaugaaguacaaaguucaugcugugcaauuaaacuaguuuaccguaguuuagauucauucauuauauccauccaguagacaaauauuuauuaaauggcuguucuaugaaagguauagcaucaagcuauacaaugaggaggccgggcacagugguucacggcuguaaucccagcacuuugggaggcugagguggguggaucacuugaggucaggagaccagccuggcaaacacggcgaaaccccgucuccacuaaaacaaaaauucgcugggcaugguggcaggugccaguaaucccagcuacuugggaggcugaggcaggagaauugcuugaacccaggaagcggagguugcaaugagcugagaucgcaccauuggacuccugccugggcgacaagaacaaaacuccauuuuaaaaaagaaaaaaaaaaaagaaaagaaauacagugaugaacaagacgccuaguccuuacuuucaucuaguuuuucucuagugagggagauaaacuaaacaaaaauaaaaaauuaauacucauucuaauaaacuuccugagggcagugauuuuugccuauuuguucacauuuuaguaucucuucaauuaccuagcauauaauacacaaugaaugaaugaauaaaugaaugaauggcugagugaaugaguucuuugaaaaggucucugaaaaauaucaguuggguaaaggaagucuaauuuuugcaggguagucagaaaagaauuucgcggggagaugacauugaaguaaguaaugauagauagccaugugggccugggaugaaggaaggagagguagugcugggcaaaaguggucaaguugugcaagaaaugggaaagaaggucuuuagccuuuauaaggaaguuuugaauuuaaguaguugggaaguucuugauguauuuaagcaaggaugauuugauccacauuauguuuuaaaauucuguaguauuucuuauaaaaucacaaaguuaaugauguaauauauguguuuacuuguuaguaaauguauaauagaacugcucuugagcaauauguguacacacacacacacauauauauguguguguauuuucccaaacuuucuuaaauuguaauguaaauguagaaaagcacuagacaaauauauauuaacucacuguauuauuuuggcuaugguuuuccuuaauuaauuuugaugcaaacauaauucacucauuaucugcauaaguuuugcauuucugccacaguugaguaaacaccaucaauuuaguauaucaaauagaauucuacuccaugaaaugggacaugguuauacuuuuuuacuguacauuuaaaaauaauuuuaauaaaaacauacaccuuuuucuuuuuugaaguuuuuuucuaugguacaugaaaacauacugucuccuguuguggaauuuacuaaaguuuccagugaguugcaagucauaauaggguucaccaaacauucaaauuuuauauucuccuuugagcuauucauuuucuccccauuuucagaugguucucuuuuaucccucuuuauugauauucucauguuucaucauucauaccuucaagaauaaaaucuugaaggaagcauuaucugguuaaaaaauauaccuccauuguaucacuuuuauuucuuccccuaucaugcaaggauacauuaucauuauuucauggugaauuacauauuauuuuguuaugaaaugaaaucaguucaucuguguuuggcuccuuggaagguuacuucuuaguccagaauuuuuuagaauccacaagauggcucaccuuuuauuuucucaauucuauaauuucagauuacuaaccucuucuuucuuuucuuauuuuagaaggauauggugaagaaauagccugcacucagaauggccagauguacuuaaacagggacauuuggaaaccugccccuugucagaucugugucugugacaauggagccauucucugugacaagauagaaugccaggaugugcuggacugugccgacccuguaacgcccccuggggaaugcuguccugucuguucacaaacaccuggagguggcaauaccaauuuugguaagaauguuuagggccaacucauaauugauccaguuacucaccuuuauaguugcaguguuuuucacuuucagcauucagcaacucaagagaauaauuaagcagcuuuuuugguggcuuuugggguuaaugauuaaugauuuugcucacucacuucaucuaaaguuagauagaagcagacaguaauuuccugucuucuuaaauaucugaagcauuuggggcugaauuuuggugguuaugucuaaucugagaauuucuugaaucacuuaagaugaucauuuguuaccauaugcaugaugagugccuccaaguuauuuuucaguuucccuuuaaguccauuaaugccugagagaagaucuagaaaacacauuuaucuacaaugaugccaacuuuguccuagugaauggaauacuuauuccuaauguaauucagugccacagcacccuguauuacauuggcucuuaaaugcagaaugcuuuucauguuggcuagguaaagaaugaaauagauuuccaggagaaaaaauaauauaaaguaaaacuuuuaaaacuucuuugaagaaaaaguuucuguguuuaacagauauuauguauuucaguaugaguacauauuuuaaagauacauguuagggaaacaaguuuauauuuauagguuucaauaaacaagguaagagcaauauuaaaccuucagguuauuuguguuagcagucaugagacuucuaauucaucauugucaagacaauaucaaggcuuuauuuuuuuuucaaaauuucauugcaaauaacagcaaauacaauaaagguuucaacaguauguauauggaaauagauagcaacuuaccuuuucucugcuucuugaacagaaacaaugugccuuggguaaauaccuacacucacuuuucaguaauguaauaagaaauauauaaaagaaagaauuaaaaccaagacauauaagagcuacccaaagcaaauacaaucaucaaaacagcccaggaauaaaguaaaauuaaauccguggggauaagugaauagcaaaugggaacaaugguggcaaauaucagaaaacacaccaaaauauacagucuccuucaaauaguuggucuaggagcuggcaauugcauuaugcacagaugccauaagauaaaaagugguugaguucagcuaaauuuacgagauaacacaccagaaaauauauugcuauagaccaugugaaaauucugaccuaucauuuuaccgugaaccaaaaaaaaaaaaaaacuuaauaaaguaauucucuuuaagaaagaaggcuauaaagcagaaauaaguaauggucagaaaagaaauagaaggaaaaucaaaucaucacaaagaaaugaagaugaaauaugagggaucauaaggagaguugauaucacacaaaauaaagcaagggccaugagaauaggaaaauaaugaauuacaauuuuuaaagaguuaaaaaauaauagauguagaaggcaagcaagggauaacccugaagaugggcacccaaagaaaaaauuaauacaauugaguagaacaaauaacaauauaauacaagaaaaauuuuaugaaguaaaacuuuaaugucaauauugaaauggcaaccacaugucugaaaaauugaccuaaaagaguuaacagagacauauguaacuuaaugaagucauuaaacuuuaaagauaaauaaauacuucuuuagaaugucaaagaauaagaacagauuauuucucaagggaaaaguuguuaagacuggucacaaauuucuccacaguauccagugucagaagacaguggagcaauauauacauauuucuuaaggagauaauaugguuaauuaaaguuaaauauaaauccauucucuccuucaaauauaaaagcuacaguaaaagcauuucugugggguuauuguuucuauaaauuucucagggaaacuaccaucggcuaaaugcaaggcaaccaagaguuaauugaagaaacugucaaagaacuuaugugagcauuuauuauauuuaaaucuagaaaaagacuaaaacaaaaguguaacuuagggugacagaugggauuguaaauauuauagcuucugacaaugcagaaauaauuauaaaacauauauaaugaaagggggaggcaaaagaaaguaugaacuagagugaguuugguaauuccucaucuuuaaaggugaaagucagauaauaucauucaaaccugacaaaucacaugaacaaaguaguggcacauuuaacacuacaaaaauaaaugcuaaaaagaacauuuccuuguuaaaauggaaugcuagaagaaaaccugagcggcauguaagaaaaaagaaacacugucaauuuuaucauugcucauuuuaguggaacuaauagaaacugucuaaacaaauacagaucuaugaguaauguaaaagaauguuaacauaauuuagcagaauauggaauauaauugauagaacuaauauauaaaucuuuuuaaacauaagaaguucuaacacaccaaacaaagauacuugaaaacacagugaaacauuuuauuuuuaaaauuuuaacaaaaaaucauaguucuaugcuuauauaaauaaaaagaaagaauaaaaguaugugcauuuagcaucuuucucaaaaaguuaaaaagaaucaacaaaauaaacugaaaguaaguggaagaaaaaaauuguaaagauaaaaacagaaguugaaaagugagaaaacugaaauauaguagaaauaauauguaaauccaaaacauggucccauaaaaacccaaccaaaagaucuaaccuaaagcaaaaaaugauaaagaaaaaauuaccuaaugaaaguaaaacaacaugaaagaaucauuaagaggucccuuuauucaacuguaucuucauaaauuugaaaacuaauaugaauaauuuucuaagacaauguaauuuacuaagacuagcucugguagaaacagaaaaucuuagaacauggauuuucuuagaagaaacagagaaauuugcaaagcagcuagauucccaaagcagcaaguccagguguuuucacaguugugucaaacaacuaaaaggucuuaaaaagaaaucagaugguuuuaaugcuuuuaaauccucuucuugaacauugaaagagacagcaaacuuucaaaguuuuacuaugaaggaaguauauuauuuacagcaaaaguaauaacaaugacacacacaaaaaacuaugaacugaucucauaaauuuuuuuuacaauucuaaauaaaauauuaagucuauuagcauauuaagagaguaauuauucaugaaaaaguggcgauuauuccacaagugcaaaauaauugacuauuaaggaagcuauuaauaaaaauaauuaucuuaacagaucuaugaagagaaaguauaugaauucuuucauaauuaaaguaaaaguauuugacaaugaucaguaaauacuuuugauaaagacaguuacuaacuugguaauaaaugauacuaacauaauacaauauuuacaucucaacuuaaaaguuucauuaugcuuaauacuaaaagcaucccuacuaaacacaaagauagacugaguauccauuaucaccauuaccauuuaacaguacugaaugugccugaauaaauaauuugacauuaaaaaaagaaaucagagguuucaaaacucuaaaaagaggagcaaaaacuauccauuugcagaaaauacaauuguaugcuuacaaaccuauuaaauugaguaaaaauaaaacuacaaaaaauaaaagaauuuaguaagacaugagagugcaaaauuaacaagcagaaauuaauagguuuacuauguauaaacaauuacaucauagaagaaauaauaggaauaaaaauuccucauuuguaauagcaacagacacuuaaggauaacuuaacacaaaauguaugagaucugaugaaaauuuuuuaauacugcuaauucaaacuaaguauuuaaaagacugaauguccuauuauguucuugguuagaaagacuaaacauuacacucacauaaauucuccauaaguuaauuagugauuuuaacaugaucucaauauaaacauagcacacuuucuuugagaauucaacauauugcaaguuaaaauuuucauagacuacacaagaaagaauaaucaggcaaauccuuaagaauaagagcaauuaaggaugacuagcccuacaagauuuuaaaaaggauucauuaguuuaaaaaaugugauguagauacaugaauaaaauaaaaucuugaaguagauccaaauauacauggucagauugaauacaauaaagauggcaucguagcaguggagaaaagaagaauuauuucauaaaccuuguuggaauggcuaggcaaucaucuggaaaaaaaugaaguugaauaauaaaaauauauucuacacuagcacaaauuauaaauaaagcagugauuuaaaugagaaaaauuaaaucauaaugauuucaaagauaacauaggauaauuucuuuauagucuucuaaaauauaugacuuuaugaauucugacucaaagcccagaaggcauaaaaauguacaaaaauaauaaacauuugugugacacaaaaaaugagcaaaguagaaauguuugcaacucaauucacaaagaauuaauauucuuuacauauaaagaaauacuagauauaaauaauuaaaauaucaauaaccuaauaaaaauauaggcaagggaaauuagcuaaucauucgaacaaggaaauacaaaugauuuuucaauauaugacaaaacugucaaauuuucucauaauaaaauaugugaaugaaaacuauacugagcuaucauguuuuaccuaucagauuggccaaaauuaaaauguuugauagcauacuggguaucacugcauauugccuguggggaaauguguccauuauuuguggaguguaaagugguauaauuucuaugaaaggauauugguaguaucuaucaaguuaccaaugccuauaccuuuaacucaaaaaggauauuggggaauuuaucuuacaaauauacuugcauguagcguauacguaacaauuacucauuacaauauuauuuuuaauagccagcaugaccuucauucuagcuugccuaggaaaaccccaaauuacaucaauuuucuuggcauaauaaacaauaacuuucacuuucauucuuaaaaguguccugguuagaugauaaaguacauccuagugauaacaaaagauuagaaacaauccaaaugucccuaauggguaaaggucaaaauuaguuaaauagauuguguuagauuaauacaguggaaucuuauaaaaaaauuaagaaaaacaauaaagaaacuauauacugaugagcaaagaucuguaagauuuaaugaacuaugugauauacagacaagugaagaacaguauggaaaaaguagaaaaaugagucuguaauaauuuucuuaaauauuccaaacuaaacuugagaacaacauacgagaaaccaauaauaguggccuccuguggggguggggguaaaguggaaauagggaacacaggaccagauggaaugacauuuuuuaguguauaauuguauacuuuuaauacauuuuugcuuuugaaccauaugaauaaacagccuugcucauaaaauuauaaaaagcaaaaauggagaauauugaugaaagauaauucauuauagcuuuaauagcuaauuuaauaauuuaaugaacuuuaaaugucauauaaauguugugaagaauauuaauaucauguuagaauuuuccaaaaagaugcauuuuuugccuuuuauggaaguauugauccaaaaccuuuugaauucugcuuacugcugauaguguaaucacuaucacuguaauucugacuccagaagaaaucuauuauugaaaguaaauauuuagcagauucucaauaauuguuuccucauaaaauaacacauuuacucuuuucuuuuuacagguagaggaagaaagguaaguguuacuuugcauauuuucuuuuucauaagcagacuuauauccaauacuauccacacagaacugugcucugaaacguuugaaagcuuuugaaaaguacaaaguaccauacaaauacauugugacaaguauauaagcacaguucagcuacuguguuuccaaaggacagaugccucuuaaccauucacuuuaugguuaauuucuguuuguauaucuguuucugccagaaaguugugacaucuuuagggauugaaaaugucugauuaaccuuuuauucuuugcauuugucauugcauaguacauacuuugcacauauuagaaguacaauacacauuugauggaagaaagaaaagauaggaggaagggaaggaggaaggaagaaagugagggaggaaggaaggaaggaacgaagaaugucaauuugacuucaaugggccuguagccccucucucauugguugggaaguaaagauccagaauuaauugaacauuuuaccaaacagacauuucuuccccuccucuccccuccuucaccuucagagagcuuaaaaucuaauucuggacacaagcuuuacacuugaaaacaggguaggcugcauccaugacccgaguauagcuggucagcuuggucacuugccaucaauaagguaauccuacgaagcgaagauaguucuuuuugcccaagagugcucucuguuuuuugguuaucuugaaaauuauggcauuuacuucaguuguauccaaaugagaugggcacagggaucaaggcaguagaaacuguugcuggucccaauuuccauaaauuuucuuuacuuuugcacacaguggaacuuuaauaaaaugauuuaucagauaacagauaaagcaaugcuacacauucaugauaaguaagagugaugcuaucaaggggagauccuggccaguuuuacacauuuugauucagagggcaauaucauaaauuugucucauuuggaauaaauuagauaugaauauaugucaaaggagaagggcugcaaaugcuauuucacauuuaauuuauugugaaaacgaaaauaaauugaaacuuagcagauugguauaggccuugaacaaacuugacagauaggugaaagauagauggauggaugcauggaugcauggauagacagauagagagacagaccaaucuaugaaacaacaaaaaauccuaacaaugaguacugccaugaaauaaucauuuuaauucaguuagcaguuacccgacuuagagagauaacugguaggcugugucauuugcugccuuucuccaaaaguagugugggagagcugggugaagaauauacucaaagcagcugccaauguagcagacugugguuaugugccacuaucuucaugacuuguuuucauuugucaucagguaucaucagaaacacaagagcaaagcaauguuauaaaaaugcaauuuguucuucguuuauauccacuuugauauuuacuuacaacucauugaccgauugauucauucauuaauucauguuaacuccaacauaauuacugaaccuuuuuuauauggcuaugaggcaaaugguauagaugaugcaaaugugagaaaaacacuauaacugcuuccaugguaaugacauucuacaaagcauguccacaugguauuaaaugauaaguaauuguaaugcacaucuggaucugaguacaugaacuuuauguuucucaguggauaugaaaauuaaauuuaguaaaacuuuagacagaccauuauuccauacaaauuaacuuauucaaagccuauauuaauacaaacaauagaaacaaauauuuacauuuguggcuuauauccaaaauaagaaaucuauagaaucauuagggaauuuauuauuagaaacuuauaauugaacacuuaaccccuuuuaaauauugugcagcaacagaacagucauauaucaaaaagccuacaauuuagguaagacagguaucagagaguucuauuccccuacauauaaagcaaguauaaagugcauuuugcuuguaggucucuuaggauggaaauuucacaacuauucuuagcaggcuguuccauuuuucucauucugacugaaacaauuuguccucucuuuuuauuuguucuucuagucuuccucuagaaggagcauuguuucagcaucauaaaguccuuuguuuauugcacaaaaauuuauguacccuuucuaaacaauucaaauucuuucagcauuuugaaaaauaucuuuuauuauagcucuuacaugguuaaauuuuauuauuuuuguauuuuuuaaaauagaaagacucuagaaguuaguggaugugaacaugcagaaauaagccuauuuuacuuugaagcccauauauguugauucuuucuuguccuaggcuuuguguagguuggcuauuagucccuaguguuucaaucuugaacuuacccuauagaacugccuccugcuucuggagagcccuuuccuucuuuuggauucucaauuuauuccuuacuuccagaguauucgcugcuucaacauuagaaucagcaacugugacugaguuauuauuaguuccgcccuuaaguccaucauuucacuucaugaaguuuugucaggauaguauuggaaggauauaaguagauuguaucuuuaguaguacaauuuggugauauggguuaaaaacuuaaaaugucuuuaguccacaaauuuaacuucuaaaaacauaucauaagguauuaaucagagauaccauggacacauuuauaaacaaagauauucauuuuaaugucauucuuaaacuuaaaaaugaaaacaaaauuuaagaguaagauaaugaggcauugauuagauacucaaagugcauguagaugguggaaaacuaagaaugccagcauauuaacagugguuaucuccgggguguugaguaggauauuuaggguuuuuuaaaaaauauuucuucuauuuucaaaauuuccugcuaugaacacauaguauuuuuauaaucagauuaaaggauaauauauaugaaaggagaaauaaaauaaacuagaacucauucuucuuguguuuuucuacauuuuagagauguuaaauucauauucauccuacacaauugcccaguaaaaagcauuauuucuuaauauauuaauggaaaguaauacauuuuaaaaauucauugaaugcuuccauuugcuaugcugagcaugugaaguagacuaagacacaaccaugacuuugaggagaccaaaaucuguucgaagacaaauuuugaaaugaagaauacaaauuaguaaaugauuaaguagaaauagauaaagcuacaauucauccaauauuauuuaaucuauguaccugauaucaugcaaugaggauuccauuucugagaaaaguucuaagaaacaaaauaaauucuaucuacaucuauuacauuugcuauaucuauuauaaaagcaauuauauugaccugacccuauuuacuuacaugauaguuucuuauguuguuuuugauuuucuuagucaauugauuuuuuuuccuagauuuucuucagguauugagaaucaucugaguggaauuauuauuuuuuucuuucuuuuuauuaaagaugagcacauguacucauuuuuaaugcccuuccaugaguacuaaaaaagggugcuaguaguucaggaauggcaucugauuagauccugaaaacuaugugucauaugauaaaagugugaaaauuuguauauauuaauuuauauuaauuuuuauguauuacaauuucuggcucuuuuuguguuuucagucuuucaguaguuuuuccucuggugcuuugucuuuacaucuuuuuguugcaacuauuuugugcucuagucaacucuuuggauuugaucuauguggaaacugaagcaaaauagcuuuacauauuucacacgcuggauuuuuuuaugucuuucaggugagcaguaauauuuuaaugaguaauaucugacuaaauauccuaaaaauuguuaacuuucuuuuuguaguuuuuugcauuucuuacauagaaauucccuguguuuacauggcauauucuagggugacauguuuuugcccagcaagccauuauauugugcuaauugaauuuuugaauuguuuuuaaugucacagggacaaaagggagaaccaggauuagugccuguuguaaguauauguauaaucauuguuuccuuguaccuuaaauaaacuuagcuuauaguauaauuguauauuauugcuuauguacauacuuucaaaaauaaauuaguuauuuuaaaaacaaguuuuuaguauaacacaagcaaaccagaacagauuaguuauuuaauacaauauuugauauucuguguuccugacuuuuauagucccaugacuaaagguagaaagucauuguuuuaaaaaguuaaauauauuacauguggauauacacugauaguuaauauuaguacuaguuaguauaguaguuuauuauuccacacuucuggaaauacaucaugcccugauccugagcaaaauucccuguugcauaagaauuccuaagacuucuuuaaacuuguaaauggaucaagaaguauguuacuaaacaggauuaaagcucuucaacugucguucugucagguuucauuauuuuuuauuuuuauuuuuuugaaacagagucucgcucuguuacccaggcuggagugcaguggcacaaucucaguucacugcaaccuccaccucccagauucaagugauucuugugccucagccucccgagcagcugggacuacaggcaagagccaccaugccuggcuaaauuuuguauuuuuaguaaagacgggguuucaccaguuuggccgggcuggucuucaacuccugaccucaagugauccacccaccuuggccucauucuccuaaguuuuaaagguguuaucaucagucugucaagacaaaaagaauaugcauguugauuuauuuagcaguguuuacauucucuauuugccuuuaauuggcuuguuuuuuuaacgaagauuaccuaaaacuuaaauaauucauauuguuuuauuuaauuuuaaaaagcauuuaugugugcuuacuaugucuuagguguuaagugcuuuacaaauacaaauauuuauuuauuugucuucauaacucuaugagggagguaauuaccuaaucaucacuaccauuuuacauuuaaguuuccacuuaagauccuuaagaacagagaggauaaguaauuaguccaaagucacacaucugguaaaggguagugucgggauuugaacccaggccccuuggcuccaguguuggugcucuuuaucauuacgccagcacugccucccuauauuaguuaaaacuagauaauaucuuaaaucuuaaggagaggaggaaauggucaucaauugacaacauccauuuguuaaaaaaauuacugugguuuuuguuguuauucuuauuuguuacuauugaccucucugaauaucugcagaaacuuuaccuuuacaaauuuucuuguuuauuguuuagguaacaggcauacguggucguccaggaccggcaguaaguaguuucucccaauauucuugguacucuuguauuccuugagauacugaaaaucuuuacagauauuauauccaugagaagauaaaagaauuaaacaaugauacuuggucucuuaaaacauuuugucuuaaaccaucuucaaguuagacauugcuuugcagcaaugaaugguagauaagggaucauuuuauucugaaacugaagaaacauuauguuagucuugcuauugguuauguaaaagacaaaacacuuuauuguuacauuuguuaauuuuagugugacuuuguucacugaaauuagggcauacuuguguguuguuugacuaugauuaaugguaggcuaguuuuaucugcuuaauaaaauuauauauugcaguagaauuugagaaaucauacagcaggagagcauauuuauggcuuaguauaaaagauuaauuuuuucaaguuuggauuaucagcaguauucauaacauauacacacacuucauguaaauguuaaacacaucaaaucagcuuaaaauacuaaguuagcuuuaauggacucacucugguucuucugaagcccucacuuuuaaacgaugcuauauguuggguugaguaaauacacaauauaaucuucauaacucaguuuaaauccucuuuuaaagagaaacaaagucccccuggcaacagccauuucccagggggggaaaaacauuuuaagauaucagcacaauaacaccacuuuugaaauauaauagucauuuguuauuuaagggaaaaguaacuguaauuaagauuuggaaauuucuaaguggguuuuaaacauacaagggaaguaaugcaauauucuaaguaaaguaaaaagaaaagaugcuugaguguacauaaagcaguacuguaguaggcuaagaggcuuuccuuuccauugcuuuuaucagcaacuugaacagugaugaacauuuugggguaucauguaccaauuugauuucauacagucccuggaauaauugauaauuuguauuuugcacauuuauguaauuuucaaaaucagaauuguaaguuuuugugcucagaguuuaguggcaaaggcuuuaccugggagaagacagcaaauaugauccuuaaaaauuugcaauuacuagucaagcuaaucuauuuagcucacuaugcuccaugaugccauaaugugcaccuaguucuucauaggucuuuaaaugucacugauaacauaaacaacgcuucuaagcguacagaacuuuuauaugcacauggcuuuauucucuauagucuucaacugaacugaauuaagugugguauuucuguuuuccaauuuucuuuuaucaaguagacuuuuaaaaauucaauaagaaaguauacauuuuugcaugcauaaucaucauuuucuguuuuagggaccuccaggaucacagggaccaagaggagagcgagggccaaaaggaagaccuguaaguugacaggagggcuccuuguggggaacguacagccagucaguuuacacuguguucucugaaugcagcaagaagcugggagcacuauuccucuuucaccuccauuaaauuuuacaaaaauacaauaauaauuguauauuaucuuauuagauaacacaaaugauauuuccuugucccuuaugaggucaaaucaaaauaaaguagaacuuaaggaagcauaguuaacaugucaugaguuucacucaugaguaagcaaugccaagaaugcacuguugagauaaaacauccaaguuauaugaucugugguugccacaggaauaaccaagcuggauacgggaaaaaauuguuagaggauaaaauuuucuuucaagugguugcacaacaaguuuauuucccagguagcacuccgccuuuuucacucagcagccacugcagagauagcaaaggaguaguuuuaaaaaucagcaaucccauuacuagacaagugaaauaccuuuacaauaaaauagugaccucaauaucuuugagauaaaacaugaggauauuauauaauauauaccaaagguuuucuuuuauuaccuaucugcacagaauacauauuguucucaaguguuagaguuacaacuuuuuuuuucuuuuuuuuuuuuuuuuugagacggagucucgcucugucacccaggcuggagugcaguggugugaucucggcucacugcaagcuccgccucccugguucacgccauucuccugccucagccucccgaguagcugggacuacaguugcccgccaccaugcccagcuaauuuuuuguauuuuuuaguagagacgaguuuucaccguguuagccaggaugugauccgcccgccucggccucccuacaacguuuuuucuuauguaucacuucuaaaaucuaaugucuuucauauacuaaauaacuguauucauuuguauauugcucccauuaucccauguuucaauuagaaaauuuuguuuguacuguuuaauuuuuucucuaauguaucuauuaaaacucucaguagauuuuuauccuuuuaaauauauauuuauccauauuuaaaugggaggauuagaagauaagcaaacagcagacaaguuugaauauauaaaugaggauaaaauauauuuuagaucauaugccuaggaacucuugccacuaguuucauucuuguuacuacauuauccuucuacucauuucaccucauauauagugugaugucaguacuuuuucuuaaacggggcugcacuauggauguuacuugcaggcauguaggugcaaagcagugccccaagagauuggccauaucuugggguguguccagauuauuauaugccccauucuucacugugguuguauugaguuuucucacuaguguugguagcuuaaacacugcuguaggucuccagaugucucuccuagaucuagaaagacagaaauagguagaaaauaacaucaguuggguggaggauggguggucgugacagaaaaaaaaaaaaagauuuugcauugguguauuuguacacuguaaguaauugauaacauuggguccuaagucuagguagaaguuguuguaggaccagacuuccagaguuccugguuaagauccaaagaaucuacuccccaacccuucucacuuauuuucccuauuugacuuugugauguggucaauuuccugucuugguuaggccugagacaaucaaugugaauuggguauaagugugugcguguuguguguguguguuuguguguguguguaugaaagagcgagagagagagagggagaaagggggguagauuuuuaggaggaaucaagugagacaacccuggcagauauccaaguaggaaaucuguuccucucuuaauccuagcaaagaacuggugugaugguaaguguuuaacaaaucuuuuaaugccugccuacaccgauuucaagauaugaaaugauguauagcuuugcaugaaaugauguauaugaaaugaugggcaugauguaacagaaugcccauagguagaauguuuugccucaugucucaagccuucugggagcugcuuagcuggacuaaaauuauggcugucacaauaucauaaauagcauucccccacccccaccauuauauuaccaucaaacaguacggaaggcucacaauguacagcaugguuucucacuguuaacacuauugauauguuaggccaaauaauuccauaugcauuguaggaaguuuugcggcauuccugguaucuacccacuagaugccaguugaaacugccaucccccauacaauugugacaguuaaaaauguuucuugacauugccaaauccaggcaaaauagcucuggacugagaacuaguaugucaguaguucaguaugagauacuccuacaagaccuucaggauuagccaaugauuuucaugacugucucucaucacacguccucaguuuuaaguguauuguucagauaacuucauagugacaagcuagcaaacugucaggagauggaccgucaaugaugugcuaaguucuaguugcacaugacacuuaaccacuauugguauguuucuugaucuguaaaaugggaaauauacuagaucuuaacaucuauaacauuuaugugugugugugugugugugugugugugugugugugugugugugugugugugugugugucagagagaaagagagagagagagaaacgagagaaaugaaguucuuuaacaguucccggucauucgucuuuucuacuuguggauguuuaaacaucgccaccuaguggcaaccucaaaguacuuuuuuauuguagauuacugcggagguauuugaguaucuuggaaauggaagggaaugauaauaaauguaacauuuaccuuaauauaagaauuauguaauucagcucacuuggagauauaaaaauagauacuuuuaaugagcucccaaauucuaauuugcuuuugauauuuaccgguaaacauucuuguguucacuuaauuuuagauaauuuuuauagacguuuuuauuaauuuuaaucuuaaucugugcaacaguaaauuucauaagcuauuuagagggcauuccguggagacauauaaugaaucugaagucaaugaaaacaaucuuaggaucagacuuugaaauacgaaguguuaauuacagaagaauggagaaagucacaaucucuuuggaggacuaaugaauauuucucaaacuuaucuccacuccuguugacaauaaauauaguuuuguguaugucucuuuggaacucucauugggagcagagauuaugcauuaguucacuuuuuguauguaauaauaucugguuauuaauuagcaacugagcauugcaagaacagaaucagaguuuucuacacaaggcuguaugaauaaaccagacuauuauuuugucugugcugucauauacauauccaguucauguuacucucauucauaugauccaggaguccuagagaacaauugaaaucagccucuguuguguauaaugaagugugaaguaaauuguuaguaguuuaggagucagaaaaguuuugauuuuuaaaaacugagaauaauuuucuaagauaucauuuuuaaauauaaguuuuucaggcuaaguauucuacuucuauuuaauagauaaauuugcuuguuugucccacuacugcaagaaguaaauaugucuauauaaauguuuaaauauauuaaaauaauuaaauuucugaauagcuaugaugccacccuccccaaaaccaucauauacaaacugccaccuccaccaccugagcuuguccuguguuugcucccucugcacuaucagcuccuauuugaauugcuuacuguggucccauagguauucucauguuuaagcaugggaguucuuuuuuuaacuauuaaacuucauuuaccauauuucccuugaucccugcuuauaauuauaaaaagcauauugccugaugacuuuuugguccuuucuuuuugaagccuuucaagauucuuuaggguuaaggagccagaaaauacuuaacuagccuugugggaaugaugagguuagaggacggagcauuuccagaacugaggacguggcuguuccccaagcugccuucagaauguggguuaggagaaggguggaauuuggcagcuagaaaucauugcucacuucucugagaacuuagacuuggcugggucacagugccuuugccucuaauuucucaauggucuagucuuccucugggggugggaaguaaaauaaagugugccaggcuuuaaaguauuaaagaggacugaaagguaacaauauaauaugcauguauugagugucuaguauguaccaggaacuaugcaaagcauuaaacaauuagacagaaaaucucuacaaacuccaaucaagggauucuugaauuuuggggggaagggagaaguuaagcagacguauacauaguuaacuguaauccaaugacaauccacuguaauuucagugacagacaagugaauuuauaauuguugaucaaauacccuugcacggcaaaaacucaaucaaauaaggaaguucacuuuagaauacuguugaacugaaaauuuuaaaaauaauuauucuaagaaugcugauuucuggguauuuaacacaccacauaaaauucuuacccagaccacauccgaaugguagaaguucagaccuaugcugaaaucaguagugacauggcugaugaaauuacucuaaguggcuagauugccauguauuuuuaaaauaauaaacacucccuugccauuaagaagucugugccuuuagcuuucuacuaaguguauauuuggcaguggguucuaauuuuaacuggcuuguuuuccagggcccucguggaccucagggaauugauggagaaccagguguuccuggucaaccuggugcuccaggaccuccuggacauccgucccacccaggacccgauggcuugagcagggugaguugugugcauuguuugaugucacguacaggucauguuuuaaauuauugauauauuguuaggauuuuaaauugugucuguucagauauugacacuugacuguaagagcaguuaaauaaggucaacacugcuauggacaguagaacuaauaaacccacagggaauuguuggaaaaauuggaagaaguauuuucuaaaguacugcuucaaauuguuuguauuucucaaugucagcucuagacucuaugugcuuuguuuuuucuauugauucuaaagaaccacugcuuucccccucuuuaaaugaaaugagagauuuaucuguccuauucucuaggcucagaaugccaaaaaaaucugcuccguauccuccacaagagaggaugacacauccaugaugagggauaugagaaggccauugaguugacacuaaaaaugacaccuaauuauuucuucaauuuuaguuuuuuuacuugaaguaaagucaaacaaaaagccuuucaauaccgacuucuuugaauuguuaaugucagacauaggggauuuauaaguacaggcaaaccauggagauauuguggguucaguuccaaaccaccucaauaaagugaaauacugcaguaaagugaguuaugugaauuuuuuuuuguuucccagugcauauaaacuuauguuuuuccacaauauagucuguuauaaaguguguaauagcauuaugucuaaaaaacaagguauauuucuuuauuaaaaauaccuuauuguuaaaaauugcuaauaaucaucugaccuuucagcaagccauaaucuuuuugcugauaggguguuuugcuuugaugcugauaguugcugacuaauaagggugguauugcugaagccuggaauugcuaugguaauuuaaaaaauaagacaacaaugaaguuugccauaucaaaauccuuuguugucauuucaacaaucuucacaguaucuucaccaggaauagacugcaucuugagaaacgacuuucuuugcucauucauaagaagcaaguccucaucuguuaaaguuuuauuaugagauuacaguaauuaagcaacaucuucaggcucuacuuauaauucuaguucuguugcuauugccaucauaucugcaauuacuucccccaaugcagucuucagccacuaaaauucauucaugaagguuggaaucaacuucuuccaaacuucucuugaggcuuauauuuucaccaaucaauuaagaauguucuuaauggcaccuagaaugauaaauccuuuccagaagauucucaauuuacuuugaacauuauauucuuaaguaauaagauuuaaaaguugaaauuuauuuauauccaugggcugcaaaaugguuuuuguauuagcaggcaugaaaacaacauuaauauccuuguauaucuccaucagaacucuuaugugaccuagugcauugucacugagcaguaauauuuugaaaggaauccuuuguuucugagcaauaggucucaauagugggcuugaaauauucaguaaacaaugcuguaaaggcuguaaacagaugugcuguuauccaggccuuguuguuccauuuauaggguacaggcagaguuguuuuaucauaauuccuaaggaugcuaggauuuccauaauaagaaauaaacacuggucuuagcuuaaagucuccagcugcauuaaccccuaacaagagaauaagccuguucuuggaagcuuugaagccaggcauggacuuuuucucucuaaacaugaaaguccuagauggcaucuucuuccaacagaaggcuguuuuguguacauugaaagucuauuguugaguguagccacguucaucaaugaugcuaacuugaucuucuggauaacuugcugcagugucuacaucagcauuugcugcuucacuuugcauuuuuauauuauggagauggcuucuuuccuuuaaccucauaaaccaacauuuucuagcuuccaacuuuucuucugccacuuccuugcuucuuucagccuucacagaauugaagaggguuagggccuugcucuagauucgauuuuggguaagauaauguugugguugguuugaucuucuauccagacuacuaaaccuuucuccauauuagcauuaaggcuguuuuacuuucuuauuauuuguguguuuacugaaguagugcuucuaauuuuuuaagaacuuuuccuuugcauucauaaguuggaugacuguuugcugcaagaggucuagcuuuggccuaucuuggguuucaauaugccuuccuuacuagaccauuucuagcuuacaauguaaagugagagaugugagacucuuucuuucacuugaacauuuagaggccauuguuggguuauuaauugaccuaauuuuaauguuguugugucucagggaauaaggaggcccauggagaggaagagagauggggaacacccgguugguagaacaacacacacaauauuuauugaucaaguuuauugucuuguaugggcaucauucaaggcaccuaaaacaacuacuuuaguaacaucaagaucacugaacacagaucaucauaacagauauaauaagaacaauaauaauauuaaaguauuaugagaacuaccaaagugugacacagagacacagagugaacacaugcuauugcaaacauggcaccgguugucuugcuuggugcaggguugccauaagacuugaauuuguaauaaacauaauauugguaaagcacaguaaaaugaggcaugccuguagauugagaccuuaacaaggaaacauaugaagccugaauaugauuuuugcuuuacaaaaguucauacacauuuuucucaacagauuguagaauaaauugccaauuuauuuauaaacaguacacacauucuuuccuaacaaaauuuggaaacuaaugugacuacuaaaauguauaugaacaauuuuggucaguuugauuacuaggguuuuuuaauugugaaagagaguaggucaaacuguuuccaaacuuggaacauucagggauucauuaaaaggacuauaaaaguguuaucaacuuacauaaauguaauuuaaaguuuacugggcauugaacaaagaaagaauaucauccaaaaacaguccaaaauggaaucuggaaucuuuaggacaaauguuuuaaaggcaucuuuuaggcuuuguuuagauguuuggcaucucuaacugugggaagaaaucaguuaaagagacuuaaaccugcaaucaauuagacuggcuagugcuuaucagaacaauccaugcuuuuaucaaguaucagacauuugcccuguuucagaaacugcucuggagcaacauacuuauacaauacucugggaaagaauggucaauaaaaagcacaaacaaucaaagcaacuuaagucuuuuuccaggcuuuaaagucaagcacuuagaaugauucucagaagagucauucuauaagaauucuagagaguguacauuuauccauaugaaaaggacguugauguaugucuuuuacuguagaaauaaugucaacauaucgcuuuuacagccguuuucagcucaaauggcuggguuggaugaaaaaucuggacuugggagucaaguaggacuaaugccuggcucugugguaagcauaaauuuuacugaucauugaaguacuucagugaaaaaaauuauuuuaaaaagagaaucuugaguuaacuagucaaagaauaacaugcaucuucuuaaacacagucguacauucauucauucauucauuuaauuaacuuauuuacucuacuguaugccaguuaaaagcccaguguguuucauucauaauuaugcaaagugcugacauuaauaaaggucuaucuguacauuuuauuuaauauuggaagaaaauaaaggaguuuaagacauauaaccacagccacaauaguaaaaccuaaaccuuuauaaauaaaaagcagaacuauuuuauggugcucuuagaaacagugguuugguaaaauuuugaaaugagauguuuugcuauuuucauuuuuauuauuuucuacuuaauauccucuggcugccuuauuccaacagcucuaugguuuccuggcugagucuucucaauauucuuacccucuuuugaauuucuucaacaucagaaagacucccauuuuuuuccuggauauuuggagcaauccaauuuuauugaauaaauuaacacuuuuaaaaccaacucucccauguuuuauugcucauagcauaguucaaaauaauuccagguuaauagcauuucaggcaauaagaagugcaaaaucagaccucauagauaaccaccccuucuauccauccuuaaggccagcguugugagcauuuuaaauauuauuuguauauuuuuaaaguuacuaguaauauggcaucauuuagugauucuuuugggaacuuuuuuuugaguugcauguuuuuauccauuuggaguuuaaauuacauaugugugguuuuuuuuaaauggagcuuuucuuacuauauguuccauucaaaauaaaaaauuaaaaucuugccauaagaauaaauuugauuuuggccaggcacgguggcucacgccuguucucccagcacuuugggaggccauggcagacggaucacaaggucaggagauugagaccauucuggcuaacacgaugaaacccugucccuacuaaaaaaaaaaaaaaaaaaauacaaaacaauuagccgggcaugguggcaggugccuguagucccagcuacuugggaggcugaggcgugaacccgggagguggagcuugcagugagcccaggucgcgccacugcacuccagccugggugacagagggagacuccgucuaaaaaaaaauccaaaaagaauaaauuugauuuuaauuuauuuuacuuuuuaaaguaugauauuuaaaaaauaguaauauacauauaauaauaaauguucuaaaaucgcauuuuuguuuucuuccuuuuguuaugccucaguggaacgauuucauguuuaaaugaggaaagccuguguggauaguuucaaucuauguugugaaagaaagaaaucacccaggaaacucagugccccaaaucguuuucaacucacauuuaauauaaucuagucauuauuguugauguuucauaaaccuuuaauucaacuuauuuaaguuauaagaauuaucugcugugaaucugaagaauuaaauaggaaguuugagaacuaacuuaugucagccaagauuuuucuuuauucggauguucuuacuuaacagaaccauccauuaaacaugcaaguguucuuguucuaaagacauuggguguguacagacauauggcucauuucucuuuauaacacugaaguuauguauaaaaucaucccaaauguuguccaagcuuuaaucuccuugaauuuagcugccuuccaaaugaguacagauggagaaugucaucaucccccuuugucaaaacuucacuuuuccagauucuagagaugauucaacauuuuugaaauauuugaccuaauugucaugaguacuuugcaacguuucuccucauuuguuuuuaaggguccuguuggcccaaggggaccacaggguuuacaaggacagcaaguaagucucuuuauaauuaauuacaugcuguaagaaaaacauacacacacacauauauuacauaaggucucugugacaugacugcuuuuggcugguuuuaaaauuuuauauuguaaugcucacuucaaacaggauauauuaaauaguuuuuauuuagaaauauaugccacaugucuuugcaaaguuuauugggauaaauuuuuaucaucugauuucuuuaugugacugaccuucgauaacaaaauuacaugacuuugcaucugaaguaagaaauucauuauguuaugucaugaaaauguucacaauugguuauaugccaacucugaagcuaugaaaucagaucauaggaggcaauccccguguaguauuauuagaaauaagaaucaagauguuuguuccaugggaucuuuaggaagaauauaauacaauaugcuuuuaaaaugccuaucagaugccaguaaaauagugauguagaacuauuuuuauuuauuauagcaauuuaacaggcaucaggaaauaauauuuuaaaagaaagaaugaaaauaaccuuuaguucagucaagguuaccacauugucauugucauguguguggaguuuuacuucaagcuaucagugacuagaaaaugugguugaugauggugaugaugaugauguugaugaggagaacuaccauugauggagcacucacacacugugccagcacuauucuagguucuuaacauacauuaauuacuucagcagccauaacagccuaauaaaguaaguaccaauauuauucugauuuuacacauuaggaaacaguuacagacagauuaaguaacuugcccaaagucacacagcuggaagauggcagagccaacugucuaaacaauuacacuguauauugacagaguacaggguuuaauauucuauuuuuccuugguuuguauauauacuuuguuuucaacuguaggguggugcaggaccuacaggaccuccuggugaaccuggugauccuggaccaaugguaaaugucaaguaagcauguagacccaguuacauuuggguccaccauuauaaugaugucaaauauugaguuauuuaucuucccagguccucccuaauguaggaagaaauaacaauccaguuugggaguccuguucuaugaacuguucuuaagcuauauguuucucauagcagaauauuuaaauucaaagacuauuuaaauuuauuuauuuaaauuuaaauuuaaaaauucaaagaauauuuacauucaaagauuaugaucauuagacagugcugagcgauuugcuuuugugcaauuauacuucuuguugagcacaugaucuggggaugcaacauaaaauucaaaacuuuaauaaaacuauuuucucugucucaacaauauuuaucauuuucauuuguuucaauaauaguuugacauuucauuugucucaauaauguuuugaauuguauuacuggcaaguaaagguaaauauucuuuuuuuccuuuuguuuuguucuguuauuaggguccgauugguucacguggaccagagggcccuccugguaaaccuggggaagauguaagcuaccuuuccucauuuuccauucagguuuugaagaggcgaagggguuaaaauguuaacaagaauguucuguauuaauuuccauuacauuuccccacccuuuuagcuugcauuaaauucaauguaaacaggagcacucagaauggaauuuuacaaauaucuaaaagggcucuuaauuugcguaguauuauguuauuagguacuacugucucuuccugaauucccuggguuuuuguuaagauuucuccauuagaugcuaggcuuguugucacaguagcaacaacuuuuccuaguggaaccacugaaauuaccugaaagaaaaaauauguugcucugauggcaauacaucauuaugaggucuuauuuaaaaggaauuuuuaaaacguguuaguaguauagugccaauauggcuccccaaugaugaaaaaaugauuucuucaauuggauuuuuaauuaaaguuaagacccaacuccagauuuuaacauuaagaacauguaaucagagaacagugugcaauagcagacuuacauuucuagauucuuaguuguaccaaaguugaggaucaaauuauggguaggccauuaauuucuauaugauacuaaaccaaguauuaauaaauauuuucucuuuaugagucauaagauuuauuuaaacagguuacauugaauuuggacauagagcacauauuucugauagucuuuucuuuuuaaccacaggaaagaaauggaaaguaguauuuuaagaagcaauacuuuaauucagugucaugugaucauauagaauucuauaguauauauccuauagcauacauguauguuuauguguauaaauuuugauguucauaaaauagugagcuacaucagaccaagaaaauuuucaacaauuuauucuucuggguaaauuaaugaaagccacagacuaacuugauagaauggaguacuaucaggaauauaaggaauagagccuauuuuuacuuuauuuuuugcacuguuuagagaauuguacauuagcuuucuaaagaagacuguuuuauuaguaauuuauuuaucauuuaguuucagagaagaaccuuuuaaucacuuuugccuucccaaucuccuacauuuuuuuccauaaagggugaaccuggcagaaauggaaauccuggugaagugggauuugcaggaucuccgguaaguuuauacucaacauaaaggcaaacuuugaaaaauaaagaacauugaauuaaaucacaauucucuguaugcacauguaucaggcacuaaguaaauggagacaaacagcauuguuuguuuccguaaaaauguaaaaugucacaggacguuuugccagagugauuguuaacuccaguugucugcuuugcauuggcaccauaaauaagccuucuggagcuagagaaguauauugaacauaacaugaaugcucuccaaacugaguuucaaauccucagaaaauucagaaaaaaauaguuuuuuuuuuuucauaaaaugaguuaccagcuugaccuguuuacaauucacacuucaauccuauuuuagcucuuuaaaaucuuuuuaauauuuuuacuuuauauugucacauaugucuaaauaauagcuugaagaaaagcuuguugccuuguuuuuuaucaacuagagacaguaaauuauggaugggaugcuucuuuggcugcuccccaaacccuaauuuuggcugaaauucuugauuaauguucuggguccuaaaaucaugacaauuuacacugauuuccagcucuccuaacauagcuguuuucuuccccuuuggcucccuaaaagaauagacuccuggcaacuacuccaccagaauccaagaccuggccccuuugccguucucugaacccaccugucucuugucacucaaauugcuuugcuaggcccucuucuagaauguguuacgcuggccauggggaaaauuagaguaugauaagcaagcaaaaguccucuucaaacauuccuacuucuuggguuucuccugcucaacagccccuaaacauucacucucccauuuauuauauuuccuauaauuuccuuauguuucugccacucaguacaaucaacaguaccacauuacuuucuguuuacuuucugaaaauugaugagguucaaugcuaggaaauguuuuaaacaaaugaaugcucccuuaucuuuuaagggaaauuugcaaggcucaaaggauuauuugguugcaaauauaaaccaauuucccaacucccugcuuucuuuccuccucgaucagccugggaaauaaaugcagacagagacaugagguuuagucauuagcacagauguccuuuucaacccauccagguuugaacuucccauguccugcugcacucuugcucaugcucacagugugggcccuccauggggaggaagggugcccugccagcacaccacagaugcacugugcaagcucagugcaaugugugauugcacuguaaugacaguccugggucagcagaaugagaauuuuuaugagcauuaggacaucugguucauuuucuuguuacauuagggauauguaaucacaugagaauuucucuugcagaccauaaaaacugaaguuaacuaauuauuugaaauaacauagcucagcaauuccccuauaggcuuagacgggucugcacuaaguugccugcuaaggauggagaggagacaaaucucuguaaaaugaggcauuaaguugaacacuuaaagggaguucuugaugugaaagaauucuugagcgggguuguguaaacagaagaauuaaugggacuucauuuguucagagagcaugauuuguuuuaccccuacugugauaacccucuaaaacacuaaagaaauaauuuucuuucaagaggucacagacgaauuauugcuuugauuuuguuauaugaauuucauccauugaguugcuuauucaaccauuuagaaauagugaaugaaaccuaugauuugcagagcagaaggauuuuuuaucuguauaagaucaugcuaggccaagagaaauuccuuaggaaagguuaaagugcuaugagaguaagaaauaucaaaccauuucuuuauuuaguuguuuauccagugauuauucauugaauguccauuaaccaaacauaaggcuaagugccagcuauacauaaauuaagaauaauaaucaauaagugaucacaucaaucaaugcuaucaaggugcucaauauacuggcggcagugguaauggcaauucaaugcaaaaucaaauuaauauaggccauaauaauaaguaaauaauuaagucauuagcuuaguaucuuuuaagacaguauaaggaaaaaguuucaagcaucauuucaaaauaguugugccacuggauuugauuuucuaugguauuucuauuguuuuuuauuuaauguguuuaggugaaagcuacauagaauuugcagaaauuaaguaauuauuuagucaagaaaccaagcauucucauauuucuugacuuucuuuucuguuggauauuuuguuuauucauuuaguuuuuuaaauaaucauaaauccacaaaguuuuuuucuaaacaauuuauuuuaaaaauuccugaccacauuauaauacuguucuucccaucauauucugcugccaauauucagaaauucauagaaaauaaagacauugguuugcuacaaagacauuuaaucguguaccauaaauaaagcacaauaaagaaggaaaaggauauuuuaucuugaauuucucuccugaauauuuuuuuucuaccuugguauagucaauucucauguuggacauauugauucaugcuuauguucuuguuuuguuuucacuacuaauuauaacacagugauaucaugugaaaaauucaaaaugucaugaacucaauaccuggcauuacuuuguauccuuguauaagucauguuuccauuucuaauagcauauuuacuuugcuaauuuugaucacccagauauauuuugacagauaaaaguauacugcuuuuuuuuguucuucuuaauauguugcuggaaaacuguguacuagcuauuuuuugggaaaaaaugauauauuaaggaauuuugcauccuuauuaaugacuguaaaaugcccuaucuauguuuuccucccagggagcucguggauuuccuggggcuccuggucuuccaggucugaagggucaccgaguaaguucaaucuauuguaauccucucagauacugugguuuagugaacaggcucuggggagauuuaccuucaaaaucuuuacaagucaauuugucaauuguccuuaacugucuaugguugcaguauucaucugugguuacugaaaucacaauuuuuuaauacauuuccuuugaguuuaauuugauuugauaaagaaauauauuuugaauucuuacuauguacuggacacuaugcuacaaaagaggguacagugaugaaugagaaaaaucucuagccugaagcuucaggcuaaugggggauacggaugaaaagguaggcaauuccuguauaguguaauaggugacaugguagagauagagaguacuaggucacagaagggacccagucuaccuagacuuggaaagcaauagaaugccuuccuuauuacugaagauaauuacgauguaacuauuauauauuguuuacauauguagaaucuaucaucuaucuaacuaucauaauaucaaauagugauauucaaucaauauacacuggccucuguuuugaguaguugagauuuugauuaagaugucugcugcuauacucauuauuaaguauuuugaacauucaccuugaauacaaaugauauuuuauaacaauaugaacucuguaguuauguguuuccucuaaagccacuguaagguuuuuauuuguagcuacagauuaaauuucuaugaagucacaaguguuugaagggugagaacacugcaagcugaaaauguuauuuaaaggugaaaacucuaauuuuccuugaauaagcuuucagaaaaguuugagaauuugaaaguauuuugagcaacaacuuuaaauuugauauucauuuuuauaaggcaauuucugcaagcuuauuuuugguucuuaugccuuugaggauugaaaaaaacaggauacaaauacaaauuuacauuuuuauucucagggacacaaaggucuugaaggcccuaaaggugaaguuggagcaccugguuccaagguaaucuuauaauuaucucacuguaaccucacuuuggcaucuuaguuuugcuucaaauguuuacacauuuuucagaaccaccuuaauucagcaggagagagggcuacaaacaaaugguuagguaaauaaacauaauuuuucaaagaugaguggcaauggcuuuaccaugacaugacuugauaugccuccaagaauagccuccauagcacugggugucugccaguguaggaugaguguugucuucauaugaagauggcacuaugaaucuaucuuuuaaaauacaaucauucauuuuucuuuuuaaaaaauaucugaaagguuuagauaguucauuagucccauuauugaguaccccuuuaauaccaagaccuucuccucauuguuucuucucaaaauuuauuuguauuucuacagggagaaaaaacaucaaggaaguauaaaggaauuucuaguggaaagcaucaugaccuaauguggaaaaucauuuggcuuuaaaauuuuuuuuauuucuaagucuccuagaauagaucuuaagauaguguuacaaucaauuuuagcuuuguaaaguuuuacuugagacguaucagacauagccagauaaguccuuuccugagacuaguuacuguggcuagguaugauaguuuccgucaaucuuaaguccccaauauuauuuuagauguauuucuuuaaaacuacacuacuauugcauuuugagaagagguaauaaaacaacauucugagauccuauaucaaaaguacaucuuucauauguccucuuugaaaauaugcuuuuaaaauuacacacacagaacaaagugauguaucgguuguaggcuucucauacuguaauguauucucauuuuuuuuuagggugaagcuggccccacugguccaaugggugccauggguccucugguaugugcucguuuucuuguuucuuaaauuucuaagguuauauuuccuugccuuuuagauuacaacaagagaauuuuuaaaugaaaaauaaaaauaaauggacaacauauguuggcuaguaaaauaaucuugauuaccagcugauagacaagcacaggagaguugagcccuucuaacagaaaagguuucccacauuucacuguuucucuuaacgguugaaugcccuuauucuuuuucuauacucagugaucaaaucaagauuaucgcagauuuagcccauuaaagccagguuaagugaaaucuauuuauguaagaggugauagguuauuuaucuccacauggggauaguuuuucaaacccaacauugccccuggaaauacuacugcuugguggccaauuaucuugaaucucaauuggauugagugggguagucagacuacucuacauuucaaauuaggugcuucaagagacauuucuucucuaucgucuauaggguccgaggggaaugccaggagagagagggagacuugggccacagggugcuccuguaaguauaucugcuuuuacuuauacugcugagauguguauuucaauucauuuucagauuugguuuacugaacuugccuuuuaaaugaaaguaauaguacuggucaccuuuuuuuuuuuucuuuuucuuuuggaauaaagucagguuuacagaaaaguugaaaagaaaguacagagaauucuugaacaaccuucccuuugcuuuaauguuaacauauagccacaguacauuugucaucuacuuuaauacaaaaauuaagaaaauaaugaauacauauaacagcauggaauauaguccauagaaaaacacaaacuuggauauacuaaugaaauuacaauaauaggaaacauuuaucaagagcuuauuauaugccaagaauucuuccaagcauuuuauguuccucauacuccuaaaaggugguuacucugagugcacucuuugaaagaugugagccuccugaucaccuguccuugauucauuuuaauuauacagauugagaaauacucuugcagacuauuuauguaacuugaaccuguauaggaggcauauucuaauuauucuuuucgcaauucucugaagaucaggcuaugcugacuaauauuucagacuuauaguucauuacuuuggaccuaccuugcuuuagauaguuaaggacugccaccuuuccucuauuauuucaagauccgaucauccccauuacuauuagcaauagcggguuuacacugucucugcuauuaccuccagcccauagaggacaaccaccucagagcuacucaacaauaccaaauucagggcccugauuuggaaaguguaagacccucucaccaggccauucuuuaucacuuuaguaagcagaguguccuaaggggauauagagaauauuauagaauauagucagcuauuggcuuaucuaggcuaacaucgucuaucaauauaguaugcuuacuucucugugcuuucuucuacugucugccaagggaggucugacauuucugccccagcauuggcuauugcucuucccacauuucuaagaacugucucccaugucagcacuauuucucaggguucuuaccaggguauuaaauugcaauaucacgagacaguguauccacaucauuaaaauuuuccaacuuuguauucuguuuuuuugauacaguaucuucaggaccaagacccauacauucuuucucagaucccgccucuacccgauguuuaggucuuauaggugcuuugguguaugauaucuuuuuaaaaaaucaggaguaguguuaguuauuggugugguguccagaagugaggcuuaaguugucuuccaaauuagaggcuuagguaucaucuucaacaagagagaacuaccaacuauuaauggggggaaugggccacuucucuaggccaagugacuuuagauggaccugagauuuuaaauuucuuuuuuuuccuuuaaauuuugaggacagggucuuacucuguugcccaggcuacagggcaguggcacaaucauagcucacuguagccuugaacuccugggcucaagcgauacucucacccaaauagcugggacuacaggugcaugccaccguuccuggcuaauuuuuuuuguagagacagggucucacauuguugcccaagcuugucuaaaacuccuggcuucaagcaauccuccugucucagccucccaaagugcuggaauuacaggcaugagucaccgggcccagcugaaguucuucaguguguugacccacauauccuauugccaaaucucagaauccgacuccucccaauccaggacccugacugugacauaacagacuuucuagguuugagaauucagccaucccaagagcucucauagucuugcauuaagcccugugcuuggccugauauucagcuuuuucuucucucugguugcagaugagaauuaaaauaaaaugcugccaaggagucuuacuuuggugauuuaucaccaucagccuuuuagugucuuucuccaauagaugcacuauacaagacccaugcaauuccaucagcuuuauaauuguuauuuucuuaauucuucucaaaugcccgagauauugcauuacuagcccauucccuuaaaauaucucuguucaccauuggugacaauauuuuccauugugccaucgcggcaugccaagggugauucauacuccaacugucaccagcugaccagugggaaauccagcuuacaaaucccacuuuagaguuugcuuucuuguaaccacucugacauuaauggucuuagggucuuaggucagguuuccuaggaaacagccucaaaaaagugacuuguauacaguacaggaaauuuauuggugagugcucuuagaaacuguauuuuugaaggaaggaaugaauaaaagcaggguuuuucagagggagaaauugaauuguguugcaauugcaacagagaucucagucaauuucaggggaacuauggagcugagauggcucuugcagacuugugucaaauaagggccaaugcuuuguaucccugcauugaccaaggaaagagcacagucuugagagagcuaauucccuuuagcugagggcaauuccuagggaauguaucaauagugagccaucagcagguuauauuuccagcuggcaggaugaauacuucaguacuuaagggagcucugggugaaaccuacagaauucacuauaacuuaauuuaucucucuuguguauuuuauuuucuggacauugcuucucugaguuaaucuggcuauuaagaauacugagguguucaaauuuucauugucucugaguucauauguuagaagaugauacauuaaaguaaaagaaucauuuuaaucaguuucauuuucucaaucuugauuuuauugcuuauugcuauaaggauagaugcauuuaugacuaccauaucagcuuguguaaauguauuuauauugcuauuaacugagugaggguuauugucaguuaacuuuaauauuuauucuucaauuugcaauauggaaauuuuuuauaaggcaaauaagagaaaauauagucuaaaauguaaucuuauccugucuugucucuuuuucucuuaauuagggacaacgaggugcacaugguaugccuggaaaaccuggaccaauggugaguuauauuauuuucauauuaauucauuaauuuauucaugcauucuuccauuuguacauucaaaaacauuuacagagcacucaccacaugccagacacuuggaauaaaaaguugauggacacauaguacuucuucaaaacuguucuauuaaggaagagagagauauuaauauuguuguauaacauaauuguuaacuccauaauacaguauacaacuucaguuaugggaacaacuuucaagccaaguccugaaagauaaguauuuaauauauaaaaugggcaagaauauagcauuguccauaggauagauagaugacaaaacacagugggcucagaaaauucuaggaagguaaaauuggauugagaggcgagagcuauaucaugaaggguuauacuuaccauguuaaaugguuuuugagcucuuuucuauaguaguuaaugugcgaucauucagggauuuuaaacauaagaacauuaugaccagaggauaaucugcugguaauguugaacaugaaaugaagauggcuaagaauaaagaaugaguuugaauaccacuggcauaauuccagaaagaaauuacaaagaugugaacuaaaguuauuaugguaguaacagaggccgacugcaugucaaugagcuaagaacucucaugggcauggcccaguagauuucugguuuaaaguguuugauggaugauguaauuuaucugaaauuggaaauaaagaaagaggaacagcauaccguuuguggguuugaguuuagaaugggaauaaaugaauucaauuucgugauuagauaugcaagaguggagcucaggauagaaauuugaauuucaaauguaguuuuggaaauuuuuaacauacaggcaauaaauacagcugugggaguaaaaauguaacauggaaugagaaaugaugaggucucaguguguaccaauauuuuguacauugugcuuuuuugugcuugguauggacaaggcuauuguauuuugcuucagaccaucuugcacuauuucauagguaauccucuguaacuaugaaccuuuaauucacgcuugaagaugaaaaucugaauacuuauaacuagaucuagaucauaaagggcuauacuuacuuacccauuuaaaggguuuuugagcucuuuucuguaauaauuagugugagaucauucagagauuuuaaacauaggaacuuuaugaccagaaagaucaucuccagguaauguggaugaugaaaugaagauggcuaagacuaaagaaucaucuguaaauuauaaacauagaaucaaauguaaauuauaaacaaaggcaaauauuuuaaauuugacacauuucaagcauauuaccuuuuuaaaauuccauuacuugcaauaguucucccuugugaauagccucaauugcugcccauuaacugcuguguuacccagagguacaaaggauccuaagagauguguggaacugaaguagauuuuaauuguaacagugcuauggaucaaggucucuacuauuauucagucaaggacacuuaaauuauaucucuacaagcaaaacaaaacuaauuuaauuuuuaaaaagagcuucaagacauaaaguuauuuucugaacuuuagagcaacuuauuauacaugugcuuuucccaucaaauuaugugacuuuaauaguggugcccugacuuuuaaaaggaagauguaaugauaucuagaauaaauuauuucauauauuauuaacacugguugcuaguaaaauguacauacuuauauuguaggcaucauguaguaaacuuuaucuguucaucaugaaauuagugguucucaacuuuggcuauacacuagaauuaccuggaaacuuaaaaauauugauguccaauccaauuuaaauguaaucucuagagguagacucagaaaucaguauuuuuuaaagcucuacagaugauuucacagggucaucaauguggauagcuguugcaggaaaccaagaagugguguuuuguaauagcacaaauauauuuauaaaauguuuucuauagccauuuuuuaauguaguaauugagcacaaaguuguuacugaaaaugcuccuaaauaaauaguccauggaacaauuuuauuuugcugcaacaggaaaaacugagucaagcucuacaagguaaauuaugcuaacaaaacaccaagaaaagaaaauauuaugagggaaagagagaaaguauuguaggaaauauucaugaucaacgugggccaagacugaacgaucauaaaauaaaauaaauuuaaagcuauuagccaaaaguaaaguauaauuauagaaauugaaaucauuugccccaaggaucuuuucucccuuguuucucauaaguaggaaacaaaacauaggaugaaaaaauauguacauuuugaaagggcuucuauuaauugaaaacugaugagacuaaaguacaauccuuagaguuagaguaaucuguacuagaauuccuuuuauacucacuucuuuuaaauuuagucuuuuaaucaaugguuuaaauucuaugcaugccuucccaaauguaggguaauauaaauauccauaaauauccacuuauugccugaaaaaccucucuaaaauauccagaugguuuuuuuuuuuuuuuuuuuuuggagauggagucugacugcagguuggagugcaauggcgugaucucagcucacuacaaccuccaccucccagguuccagcaauucuccugccucagccucccaaguagcugggauuauaggcgccagccacuacacccagcuaauuuuuguauuuuuaguagagacuggguuucaccacguuggccaggcuggucucgaacuccugaccucaggugaucugccugccuuggccucccaaagugcugggauuacaggcaugagccaccgugccuggccuccagaugguucuuaagcaucauuuuuauagaaugaaguacuagauuuugauauaaaauauaacuuucuaaaaacuauauuauuugauuaacacaaagaaaguacaucucucaagaggcaauuguuugaaacacuuuauguuugugauugacuuaauccuauaugcuauuugaguaauccaauuauguuuaauaccuuggauaugucuuuuaguauuacuuuagauugauguugaagguacuuauaaugaaauuagccuauuaucuuuguaauuuuaaagugaaaggcagguuauucuuaugugucuaauacaaaaugacgccaaacucuaaaaaaugaccuaauuagauacuaauugaauacaugucugauuacuuuucugguuucuuuuaauaggguccucuugggauaccaggcucuucugguuuuccaggaaauccuggaaugaagguaagauguuaauguuaauauacaguauuuaacgcuacaugauuacaugagucccaaagugaagaaugacauuuaauuaauugaaaagugugaaaguuacuuuuaacuaaggaaagagccuagaguaugcucauuuuucauuauuacauggaaaaagauacauuaaaaaauaaaauuaacuguauaaauauaauuaaaggagaauuacuuauaauuguacccuuauaauaucaaagaaccugauguguuaggacucuaaugccagccagucaaaacaacuauaaggaauaggagcuuuaaacugaauaggaacucuauucucuauucuugaauagaguaccuggaaguaauaaacagcagaauguuccaaacaauaggagguuaggagguuaaaauaaauuagaugcugucaaaaggcaucuaacauuuucaccuaacauuuguuaucacucugcacucccccagcuccacaauccaauucuaugaagccauuaaaggagugggcacggagaauauuuggcucuucaugugggaauggauuaaaguauucugugggaugacuuaauauuuguagugaaucacaauugguucuuucucucaguacuuugggauaaauucaaggaugacaguagaaggacauuaggauuacauuagauaaacuggugaauuaauucagaacaccucuuucaaauuguaagcaauauaacacaucugauuuccccugaugccauguuucccuuugcaaagacauucuuaauccugaagagauuaugcacaagauuaugcuguacaaaaaugacugcggucacggacagucaccuggccccucuaaacuuuguuuucucauggaauuuuguugaggauuaugugacaccaucuauguaaacucaucacauagggccuuaugcagaggacacccucaauguaaguucgugcuucuuauuaguugugcuacucaaauuggauuuaaacuuagaaacaaaccagaagaaaaaugucuguagcugacauuucagauauuccuugaaaaugugagaaucaccaagucaaauuauucuguaggcucucucuaaugacauauucaaacacugugcuauggggaugccgcugcuuuaaaauagugccuuaauuccuuucccugcauucacugagaacucaaugugaacucaagugggugggaucuuguuggguucuccucugaaucugaucugcucccugaaguccuaauaaugucacuaccacagacucuggcccagacucucuauauaccccuaucaaaacaugcaaaaucccuucccucuuuuugugagacccuccguccccaaauugaguucugguuaaggaaauacucacaaaucuaugaauuagcagaaagagguuuauacuacaacuuucaugggguuuacuuuaacuucacuagcaaucauaguuuacacaaccauucacucugguuacuucucucuccuccuggguguuugugguacugguuguuggcuacugaaaacugcucaauaaaacucaaauaucuagcaaaacuguuucuguuagaaauuuucuguguuuuccuucuugcuucucuccaccauaaaauuccuggaucuuuguuuuuggacaggauccugcuuuuccuacaaaguucugccauggucucugcucucugacuaaagaauaaauuuccaaauccaguucuuugcauuucaaugaagugaaacagagauucaauaugcuuuacugauacugaugagauuccuaaggcuuagaauuuuaguuuuccaggccucuuuaggauuagauccacauagguacauaauaagccagauaaaauacagaaaccaaguuaaguuugaauuucagaugagcaaagaauacauguuuaguauaaguaugccucaaauauugcaugggaaaaacuuaugcuaaaaguuauuguuguuuauaugaaugaaaacucaacuaggcauuuuuauuugccagcuggacucacuaucuuggcuugaaauaaagggagcuauuaaguuaccuuaaccacuucacucugcucuuaauguugcacuuuaaaaaguaucuuuuaauucuuaucaaagaaguauuguuucuuugguuuaaaaauagaugguauuuugcuuauaaugcugccaaaaauuaaguugauuagacuuaaauaaaguuguagcccagauguuuuucacuuuacugauaaaugcuuucuugaaggucgguggaacugaguuuuuacaacucaaaucuuauauucugaaauaugauuuguuauauugcuuauauagcaaggaaacaauuuauuguucuguaaugaugguaugaaauuuuauauagacuuuuuacagugaguuucacagauuuggaaaacuauugucuaaucuugcagcacauuuuagcugauauuagguuguuuuauaaauauuggaaaauaauaugauuuauccucugaugauugcaugaagcuuuaauuuuguaguaaauuuuuagacuugaaauaucuagcuuuacauugaacagaaacaaccucuuuaagcacaguggguuggucaguuuuucuccuucauuugauuuguguuaaagaguccgaauguauacacuguuuauacagaaaugggcuugaauaaccugaguauuuauguaagaacauacuaaaaguaaaccauguggauuuaagaauaucuauucuuugauaaauaucuuaaauaaaagauauuuaagacuaucuuauucuuugaguagacucagugugccugagguguagggcuguuucuaguuuuucuuuaugaacuuagauuaucuaaacuguuuaauauguaauaaguguaaauucugauaggugugggaagaaaaaucucagauuuuguggagguucagaggagagggaacuuaagcuaacccugguguagggcuucuucaacuggagauuggauauggagaauauuccuagugaagaggccaccagcgucaucccuuaagaaggaagugggaaagugagugcgcuccuuaagcuugguugggcacgcaucucuuguaauccucuuuggccucuuucaguauuuggguuucaaauguaaaauuccaaauaagcggucaacuuuguacaaugccacucucguauuuuucuuaaauuaacauuucccuuugcacccuuuuagggagaagcagguccuacaggggcgcgaggcccugaagguccucaggggcagagaggugaaacugggcccccagguccaguuggcucuccaggucuuccuguaaguuucuagcauauuuaagaaccagcccagaaagcuggacauuucuuguaacaucagaacaaauucaaccuauuuuuuuaauugauacauaauauuuguacauauuuaggggguaccuguaauguucuguuauaugccuaagauguguaauaaucaagucaggguauuuaagauauccaucccauugagcauauaucacuucuauguguugggaacauuuuaaguccucuuuuucuagcuauuuugaaauauaaaauuuaauauauucucugaauucugaaugagugcuuacaacugugaaaaaauauauuucccuugucaacucuguaaguuuuaccuauuuuauguaaaggagaaguagucaaaaaaguaauuuuuaugauauaauggugguugauuuuuaaaaaaugcuucuacuuccuuuuugaagauggcuggacaucuguauacuagcacauuuguaucuauauauugcuuaauauuucauuacauacuuuuaauguaccuuuuagggugcaauaggaacugaugguacuccuggugccaaaggcccaacggugaguacugcauuuauggcaugugaagcucaaaugggcaugauucuuuagacauuggccccagacugcuaccugugucucuacuuaccacaucacucuugcuguuuaauagggcucuccagguaccucugguccuccuggcucagcagggccuccuggaucuccaggaccucaggguagcacugguccucagggaauucgaggccaaccgguaaugaccuuugaaagaacuaucauccuuuaguguaaucuaacuacgagggccaagaguaauaacaugucaugugaugcaaugaaacauagauaacgugacuuauccaaaugugggaagaugggagucuuugugaagugaaagcuaaauguugagguacaacuuagauguuuaaauucuaaguggaacauuauugcaguauguuaaauuuuaguguucuuuuauuuaaaauaauaagguuauaacuuuaugguucaccucauagaauuuuaugaauaauugaauaauaaauauuaugaaaauauuaugcaagccagugugaggaauauggagcuucaauaggaauuuauaaugacaauuaggcuaggguucaacaacuauuucuucagaguuauuguuaaagagugauucaaauauauuaaucagauugaaugucagauugaauguuuucauauuuuacagaaauuauuuauuagaaaaaauauuuugaugaacccauaacaaauaaacacauugagaaguugugcuuaauagcuuuuagcuugauguauaaaaauaaauauuuaaauaaauauuuacaauucuguuccaaguaauguggucaugcugauaaauucucuuaaagugcuggugacagauuuauuaaaucauuaguguugcuagugucacauuugauuuuaccaaguucugaauuuugcaauccaguucuuacaacuuaaauuucaguugguauuuaaagacacaccuacagaaaacccucuaacauuccaagagugaaaugcccuauuugaaguugcuaaauucucaauaaauacggcauaaauauaaaauuauuuugauucuggguaaacaaguucacauccuaaaauacagccuaaauguauuuaucuauagaaauugucauugauaguuccaauuuuaauuuucaaauuugaauaauaacucaauaauucuauuuauucuacuacacaugauaaaaaacaugauuuuaaaaauaaaucucuuaaagaccacuauaaauuaaauggcuuccaaauuauacugaauuuuauaaaaauuuacacauauuaacauauucacaugcauucauuuaaaaaugauuauauuauacuacugaugcaaaaccgacucagcuggagagaauuuuuaaagccuauuuauuguaacuaauuugagcagauuggacuagcuaaauguccugguucuuacaaauaucaauauauuuuuuucagggugauccaggaguuccagguuucaaaggagaagcuggcccaaaaggggaaccaguaagguuucauuguuuuaaugauaaguagaacauaguauugucuggaaguguacagcucaaaaugcucaaggguuuaaaauaauaaugagaauuauaauagcuugagaugaaaauaucucauuguuccauauacuuuaaaauuugugacugacuucguuaaauuaggcuuccaacuauaauucacugguuggaugggucuuucugguaacuguccuucuguuuuuaacaggggccacaugguauucaggguccgauaggcccacccggugaagaaggcaaaagaggucccagaggugacccaggaacaguugguccuccagggccagugggagaaaggguaaauuuaaauaauacaacacauucuuacaguugugagggaauuauguguguaagucugagaacaguaaggaaaacuagaacaguuaagagaaaugcuugcagguucccugcacaguucaguacaguuaugugcaaauagaaagagccaacugacuaaucauuauucauacauucaacuaauauugguuaaaucacuagucuaugccaauuugagccaucugugcuuggaauuauaucagugaacaagaaggcuaugguccuaguccucauguggagacuaguaaauaguuguuuauuuuaguggagagguaaacaauaaacaagucaauggguaaauaaaaauauauguacacacuuuaaaaaaugccauacacacacuaaguaaagacaugacacauuggagaguaacuacacauauaugucaguguuguaauguuagauuaggugguuaggaaagaggauccucugagaagauagcauuuuagcugagaccugaagaugaugauaagccaguagaaaacuuggaaggaagaacauucuuagcagaggaaaaagcaaaugcaaagcugggagggcagaaaggaccuggugauuuuaaagaccagaagagguagcugugacuggagcacagugagacaggucugaaaagaagaacaguaaucucacauuuaucuagagcuuuggagaaugcaaagcguuucacaaaaaugucacuaaugcaugucauuguugacauuuuaauugcuauagaugguaccuaugccucucaucucuagauaucaguuuucucuguuuaauuuuacuaugaaucguuagaauauuuccuugcuuccuuccuuccuuucuuccuuuuuuuuuucugacauagucuugcuguguuguccaggcuggagugcaguggcaccaucuuggcucacugcaaccucugcguccaagguucaagaaauucuugugccucagccuuuugaguagcugggauacaggcacuugccacuauacccagcuaauuuuuguauuuuuaguagagacagguuuucaccacguuggccaggcuggucuugaacuccugaccucaggugaucugccugccuuggccucccaaagugcagaauauuucuugauuugaggaauuauuuggcucaguacuuauauauucuucaaaauuuuaaaguuuuuccaucgagucagauuuuucucaugcauaucuauagccauguuggcuugaugauggcuccuaaaacuuuauagugcuaaaaauaaaaaucaccuauucauuacauauugcaaaaauaucaacaacaauuaagaaucacauuuuggucauuuguagggugcuccuggcaaucgugguuuuccaggcucugaugguuuaccugggccaaaggugagguugcccugucaauguugauacuuacguggggggugcuccagaagaugccauuuuucagcacggugaucuagcuauggccugcaugggcucagauccagaaaggagauggauacaaauaccaggccuaaccccaauccucucuuguguaauuccuguauuaagaggcauaggggggaaggaugcuaguuggcggaauguggugacaaaauuuuauacguuauaucagugccuugauuuguauguuauauuagugccuugauuuguaaaacgauaauuuuacuucugcuugcuuuuguuuuucuauacucuuuuucuucaugcaucugcuuugccucgguacagggugcucaaggagaacgggguccuguagguucuucaggacccaaaggaagccagggggauccaggacguccaggggaaccugggcuuccaggugcucggguaagaauauagcaaguguuugcuacaucaaaggggagaagugcuccugagcaugcauuggucggguuuuuguuuguuuuuaaauuuaguuuguuuuuacaguuuagaacauuucuuuguuuuuaugguuuugauccaauucauuauuuuaaaaaauacugguuuguuauuuuuaucauauauagaaaacacgguaacuucuagucucucucaaagcaguauguauuaauagcuuuaucacuuggcaugagaaaaaaauccuguuugucaaauuuuauaacuuguuagcaaguaaagaauuuauaaauauuuguaaauauacuuuuauagcaauauagcaaauaaaguaauuuuggcagagaaauucugaaaaauuuuaacaauacaucacuuaaaaauuuauuugauuuacagaaaugucauucuauucaguugacaaaaaugcaacacuauuuuuacucuuaagaaucuuuacuucaacugcauaucagcaacaaacugacaguugguuuuuuauuuucaggguuugacaggaaauccugguguucaagguccugaaggaaaacuuggaccuuugguaaguaauuuaaacagaaguccacaaccacuaauauuuuucaacagacaugcaacuuaaaugauauuuauuuagguuaauguuuuugauuauauggaugcuggucauauugacauauuuguaccaacuucuggaagcauauucuuaggaucuauuuucaaguugacaaaaauguagaucaaauuuuuacuaagauaaauauuugagauugaauugcuucccugccugacaucagugaaaauguuaaaaugauauaguuuuuaauguuggugaaauuugucuauuagcaauguucucauuuuuauauccuucuaauuuuauauguuuaagagauaaguagguaugaauuuugacaacuuauauauucuaagaucuucccuuguucugcaaugugaaauagaaguccugaauuuucauuaccacaaaccagaguaaaugaaagaagaaagauuuccccuauuaauaugacugucaggagacaucaugaggaagcucauaucuagaauaagaauaaaaucucucuucuaguuacuuaaaauacuucaguguuuuuuaaaaaacccauucaacuguccugauucuuuaacaugaaaaugcaagauaauuuaaaauuuauguaacaugauaguaagcaaaggugacacuuugggugaugcuauguuuagaaacaacuuacaugaaacuuacauggcuccugucaauucuauagggugcgccaggggaagauggccguccagguccuccaggcuccauaggaaucagagggcagcccgggagcaugggccuuccaggccccaaagguagcagugugaguacaguguauaauauguuggccaccucaucaugauccucauuuggaggagguauguuuuugacaaauugaaggaauuauacaaaaguuucauuuauucuuuagggugacccugggaaaccuggagaagcaggaaaugcuggaguuccugggcagaggguaaauauacauuuucugcuaaagaaaaauaauguagguacuauuuaaauuaucauagacucaccucacaaauaucugugugugauacuagggagcuccuggaaaagauggugaaguugguccuucugguccugugggcccgccgguaugugauuuuugugugugugugugugagaauauauauauacacacauugcauuuuuucgaugauguuuguucaagacuuauggguaaguuucagggaaagugaauaagaauguaugggaaugaagaauuucuguuauaccuucucuuuugauuucugugagauaaugucuucugccuuuuuaaauauaaugauugaucuuuuuacuuuaaacuucuguaaaacucugacugcaaagguuuuuauaugucacaguuaaggacuauaucaacugaagaaaacaguguguaacaaauauuuuauaaaauauuuuauuuaaaauauuuagauacucaauuauuuaccuucucucaauaaugcaucuuauaaaaauuuauguaaggccgggcaugguggcucacgccuguaaucccagcacuuagggaggccaggguagguggauuaccugaggucaggaguucaagaccagccuggccaacauggugaaacccugucucuauuaaaaauacaaaaauuagccuggcaugguggcaugugccuguaauccuagcuauucaggaggcugagguaggagaaucacuugaacccgggaggcggagguuguagugaaccaaaauuacaccguugcacuccagccuggguggcagagcaagacuccaucuccaaaaaaaaaaaaaaaauuauuuaagguauuuuuuaggacauaaaaggaauaauacuuauucuuugaggucuauuuucauuuuaggacuuucaaaugaaguguuuauccgaaauauuuuggcauauuuuuuuggggggguggggcaguuuaaaucuuucuaaaauguuagcuuugcuuucuuuagucauucuguuuuugaagucuugauaaauaauucuuaagacauucagaaauaaacuauaauaaaaauauuauguuuuuagauuacauauacaaaaguaauggguuuuccuauauucaauccaauuuccccauaaguuuacaauuggcuccagacauuuaaguuuggaucaaaaaauaaauacauguuaucaguuacuggcuuuagaagauauuuucucaccuccagagacuucaaacaauaccauuugguuacuauuaauacuaguuuauuaccuggcuaaagagaaaaacaugugauuggaagaaauacaaauaaauaucaguacuucuagugguucacguagagaggaagcagacaaagaucugguuauauucacaauuauuuucuccuucacaacuuagggucuagcuggugaaagaggagaacaaggaccuccaggccccacagguuuucagguaugcacuaauucgguuuuccauuucaucuuccauuaacuaaaaugcuuuuuuuuuuuaaaaaaaaagauauggucagaagauuugaaauucuacaauuuucaaaaagucaucccucuuuuaguagauaguauagacauuuggauaaaaucgaacauuuuuguucaaaguaaaggaaugggcuucuaaaaaaacugaucaaaccugcaaauuaugaacaaaacaaauaaaaaauaacaaaaaaguaauaaaaagauaucaggaauaaaauguuucugauagcucaacaaaguuuaugaaaccauuuuaaggcugauuuuguuuuaucggcacagugacuagaauuuuuuauugaacaaaguuucauaauuuaucuacauauaucaguauguacauuauuuaauaggaggaagaucauaauuuguaaaaaaaacuuucuggacugacuuuaaauaauauucuagcagucuaaaauauuguucacagagccauaaaaacucuauaaauaugaagaagcuccuguuacauuaucucuuuuuuugcuaaguggugugcagaugaaaauacaauccuauaaauugacuagcuguuguguuuuauugguagucuuuuuuuaaugcuucugaacaauauuuuuuacuuaaaaugucugaacaauauauuuucauugaaaauauagucuuggagaccccaugaauuguaaaagguaaacuguuaacacugguagccuguuaaacuuacacagauucacaauuuuauuuucuuacuuuuguuuuaggggcuuccugguccuccagggccuccuggagaagguggaaaaccaggugaucaaguaaguguuuaaauaauaauaauggcaacacuauacauugcuggcucaauuaucacuuuuuaugugugaggcucuguugugcuuuccuuuacauacauuaucucuuugaguucucaaagcagcccuauguacuagguacuaucauuaucuccauuuuguagaugaggaaaauggggcauacagauguuagauaacuuucccaaagucacacaguuaauagauuugaacccaggucaucugcuucccaagauguguucuuaaccacuuuauauaaacaguuauggacaaauacuaacaauuuuauucugucguuuuccuggcucauagauuuauuuauuuuucuuugaaugauucauuuguucauuuaaucauuuaauaaauauuugcugaacacucugugugcuugccucuacaaagcacuggccugaaccagcugaacaaaauggauuuggaccuugcuguccuuacaguauaguaggauucagagaguauaggacaauuacaauaauagcaugcucuaaaugcuauaauaagggagguacuauguuuauggaaacaaaaaagaugcaccuaaauaagacuuggggguuuuaggaaagguuuuccagacaaaguaauaucuuuuaugagaucugagagaugaaugaugauaaugaugaaggagggaagauaggaaaaaccuccaggaaaugagacaagcuuacaaaucagaguggguaauguaauuuggggaaaauagaaagggggcugcagggugacucaggggccugauuauggagggcuuuaauuugauucuaauuuguucuucaucauuagaguaaugggaagcuaaggaagaguuuuuaggcugggcacaguggcucacaccuguaaucccagcacuuugggagacugaggcaggugaaucacuuggcaucaggaguucgagaccagccuggccaaccgucuguacuaaaaauacaaaaauuaccugggcaugguggcacaugccuguauucccagcuacuugggaggcugaggcaggagaaucacuuuaauccaggagguggagguugcagugagccaagaucaugccaccauuguacuccagccugggugauagagcgagacaacgucucaaaaaaaaaaaaaaaaaaaaaaaaaaccagaaaagaaaaaagaaggguuuuuaaggaaggaguaauaugauaagauuagggagaucaggccacagugaggacaguccauuucggagaauaagauuggaggccuauuugauaaaguuaucuuuaucaaagaaagaaauuucaaauugacaaacuuucuuuuauguaagaacaaacaaacuuuuaauuuagacaugacugcacugguuugaaugcacaauaccuaguagagugcuuuguccauauuauaggcucaagaaagauuuacuuaauugaguagaauuggauugguucuauuuaaaagaccaacucuuuagcccuuuuuauauaacuuuucuuuauuuaaacuuuuucaucuuccauuaguuuaaaaaaagacauuuagcauguauuuuguugccucuaaaaaacuaaugcucuaucuuugugaaauaguacuuugcauguucucauugccaaaaaucaaacauucagguauaauacaaaguuuuuuggaaaaauguuuucaucuaaaacauguaauauucccucauuuauaaaaauauacguacuuuucuuucuuuaaauuguuggcuuaugcagccuucuaauggcacauuaauagaaacuagguguaugaacuggaaaguuuucugauaaaugccuaaacucaaagcucuuguuccauuaaaaaaaaaaaauguguuuauaggguguuccuggagaucccggagcaguuggcccguuaggaccuagaguaaguauuuuaaucuucaugauuaauguuguuucccacuggcuucaguuuuaaaaggugucuuuuaaaaucuuaaacugggauuuauuuuaaccuauaaauucuuugacuggauaaaaauuaauuuuaugagaaauauuuugugcuaugaaacuagcauauccuuacuucaaauuuauuucuuaucacuaaauuagaaaauugagauuuaguaaugucucauuucugaauuuuuccgcaguagaagccauuucucagaaacauuuugaccuauuuuuagaucaaguauugagauuauuugacaucccaauuuugugcuagggagaacgaggaaauccuggggaaagaggagaaccugggauaacuggacucccuggugagaagggaauggcuggaggacaugguccugauggcccaaaaguaagugucauagugaucucaguguuuuaaaaugcuuuaaaauuacugcuuaauaaacgcaugauggugugagaaugcauuugucuuguuuuugaaagauaauuugauuauaucauuuucuucuuccacaaauauuuaaugagcgcuuacuaggcuuuuuccuugcaacuaaagugucagcuaaaaagaagacucucuucuuugauggggauuguaguuuagugcacauggugauagacuuccauauacaaacacauuucuaauguuuauguacauuuuauuaguggcuucuaugaauaaacagaggaaagaaauagaaaauuacauaauuuauuaggaggcuuuucuaauaauaugcuccauuuuccuugucucagguuucacaauucugcuuacuacauaugugaaaauauggaacuuuuaaaaucugaaaauauaaugcaucauaaggcagaaaugugugccauuuagugauugguagaaaauaauguggccaacuucaguauaaacaauugaaguagaauuuuucauggucaugugacaugagaccccuuauuauuuucaggguuuagagugauugaugcagucuacuacaauuuagacacuauauuagccugaaaaccagguuaauaucaaauaucaguuucauuaaagagagaaugaaauauuucucuaaauguaaugucuuucuuucuuaauauauuccauuauguugccaacagagggaaaaaaaggcaacucuauccuuuuuauuugaaauagcguucaauugccucuuaagagaaaaguuaaaaauauaaagcagcaaucaaaaacaaaaucugguuuuuuuaauuucaaaauaucaacucacucagagacaacuuucucagaugaaaaauauaagcacuaaguugaacuacaugaaauugcugacaacuacuuuugacccacuaaaaagcaauuucauuaguuuaaucuuaauauuauugguauggucacuuaauguugguucauuuuagggcaguccagguccaucugggaccccuggagauacaggcccaccaggucuucaagguaugccgggagaaagaggaauugcaggaacuccuggccccaagggugacagaguaaguccuuuuuuuuuuuuuuuuuuuuucaguucauuuauucagacuuucugcugaaaaugaaaugauuucuugagcaggcuuuuauuucuaccauccugagucacuagucauucauuuuucauucuucuaauaaacauuuacugagaaaaugcacagugugaggcaccaucccaggcucaccuggauacgacuaggaaaaugacaauuagccuucacucucaugaaacuuacacacaagugugggaaagagacaauuaaaugaaucaauuguauuuuguguguuuucccaggguggcauaggagaaaaaggugcugaaggcacagcuggaaaugauggugcaagaguaagugaaaguauuccuuuucuagcugggcuaggaaccaacauuacaguaucauaugaguuucccugaaccuuccaaaauaaagucagucauguuuccuugguagucaggaguuggagaauaauggcaugugagaucugcugugauucaaccacgguuuauucauuuugcuuacccugaauuaaaugaaacuuaaauaaaaacauauuuauugugccuaugagauaagugccuuaaggggaugggggcccucuuuaucuuucucuaucaucuuuuuauuucauacacaagguuuauuucuguuaaaaugcuaaucuagugagcuggccaauacuucauuccagcauagacaaguagagcuuuguggagucaccaaaguugugauaaauguuucucaguauauuggauguuggggugagaaauuuacugcacagugaaucgucauuaauguuaucauuaauaaacaguuugaacaagcagaauguccagaaggauggucaacugcaaagcauuguuuaaugucaugucagaaauugacauuuaacaagcguuaggucuuugaaauuagaaugcauuuacaauuccaaggacaaucagacucgaaggacaauauauuuucagacauaaaugauuuccucauguaagaguggcuagucacaauggcuuaaacauccaucauuuucuggaauaguaccugauauuugacuaaugauuucuguuucaguaugacaugguuugcuguuaguugucaugugugcccuggcaauuacaguuguaacauaauaaaagagaacugcuauuugguucugcacauugagucauuguuaauacauugguuauaauagcuuuagauuaaggaaauauagugaaauguaguagaaaauuuucaucuuaaggguaauuaguccuuuuuaugcaaauuuaauuaaggaugcaccacuucuuuuaacaaauuaugcacaaaagauacaccuugccuuuuaguuaaaucuaauauuuaauuuaauauuucaaaaauagucaaguaaaucuggcauauuuuuaauauuuuacaucauggauguccuggaaugcauaaguagugcaguacuauuuauaggaacgaugcauuggcaguuuguuuuaagggaaaaucuaaaauacauaucaauugugccuaugaacuaacuuugaaauugcaaugugauaggaccaggauguaagcaaugacugcuuuauuuuuaaugaggacacuacauuguugcaggaaagaagcagagcaaagcacuuacugcaaucucauaguagggaaaaaaugaauaacauguuuucucuguauaaaaaaucuauaaacauaaguaaugaagugauauuuauauuucaucaaauccuuuaaagaaguauauuacauaaauuauuggaaugauaucauuccauuguagauccagagacuauaagaacacagauuucuuauguucuugucaaaucuauaaaauuaaagucauuuuuguuccuuaaguuucuuuaguuguacauacagaaauuaaacgaugaaagaauauuugggcugcauaugaagaggcaagacacaguuauaagauagagaacuuguuuuaaagaggacuucaauauucccacaguuucaaguuugugauuaccugucaagaagacucagguuguguccccauguguuagcuguacuguccucuaaguguuagcucuccuaugcccauaaaucucaaaguagcugggguuuuaggcuguaaacuuuagcuacuuuuccuuuucaucucaaaagaaugaagaaaacuggcugggcgcgauggcucacgccuguaaucccagcacuuugggaggcugaggugggcggaucaugagggcaggagaucaagaccacccuggcuauggugaaaccccgucucuacuaaaaauacaaaaaauuagccgggugugguggugacagacgcuugcaaucccagcuacuugggaggcugagguaggagaauggcgcaaacccgggaggcggagcuugcagugagccgagauggugccacugcacuccagccuaggcgacagagcgagacuccgucucaaaaaaaaaaaaaaugaagaaaacuaagucaggcauaguggcuugugccuguagucucaguuacucuggagucugagaugggaggaucacgugauccagggcaagcguucaaagaugcaugugcugugaucacaucugugaauggcuacugcacuccauucugggcaauguagaguggagacccugugccaaaaaaaaaaaaaaaaaaaaaggaaaaaacaccuaaaaugccuuaacacaauuucaauuuuuaaaaguaaaaaagugauauuuugcuauuauaauuuaagaauauaauauuauaugcaaaagaaggaaagccucuuuucaauuuguggucaaauguccgaauaaauauuagcaaagcuaauuaugcuaagaaauagaaacauuuuuguagcuuagcauuaauguagugcuaaugccugaaaacaguuuuauguaugcaugaauuagguugcaugaaagagauuaaaacacuguguggagaaaauaugguggaaaugguauuaaacuagacagaaaacucuugaaaauauauagauuauaucauuuauuauagauaaugauuugcaaaggcagccaaauuauaacaaaauagucguuucuuuuuuguuuguugauuugcuaagcaugaagauuucugugcauuuuuuaccucaauaugccuauguucuguuaauugacagggucuuccagguccuuugggcccuccagguccggcagguccuacuggagaaaagguaagucacaaguuguuaauuuguacacucaaaauuaugaguccugaauagcaggcucuuucauaaaucuuuucauuuuauaacauaugguaucugagcaagaucauuucagaguucuuuuccacuaucuccuccuacacagugaccaauguccuaaaauuauguuuagcuacuguuuuggacaguaaccaucuaaaaucugcuuucuagggugaaccugguccucgagguuuaguuggcccuccuggcucccggggcaauccuguaagugacaguauuuugguguucuuuagugugagauugagcaauaaaacaauuaaucauuuuguuuuuauauuuauauaaaacaaugcuuauugguuuuagguuauguauaacuuccugguuuuuagcuuuugcuuuucuaauuaaacuuaaaaauuaucugcuauacaaucuauuaaguguaguuaggcagcuuguuuacuaacuaauuuggaggcuccuuugagacuucugaccuugggaauuuuguucuaugaccuauaucuuuauauaauccuuaaggaccuuccuuaagcaauauguguaauuuuucuauauuuacaugucuaacuaucagauuuauaugaucauauuuuaaaauacuguuccuguuuaggauaaugugugaaagcuacaguaaucuuugucuccuccuaggguucucgaggugaaaaugggccaacuggagcuguugguuuugccggaccccagguauaauuuucaaauaucccuaauuuacaaauaaacacuuaucuuguuauaauaaguuuaaugaucauugucauauguuuugaagucguauucuggaaaauuuacaguuuucuagacaauauucucauuuucaauacauuuuuuuauagacuggcacaaaacuuguuugugcuaguugagcuucuauaauuauuuguuaaaauaaaaaugcagugggauagcuuauuuuuuaggcuguuuugaaagaucucaucagaguacuuuuuuuccuuuaguaugcuuuaauacugauuauaaagcacuguuucacaauauaugauuaauugauacauuaguaauaauuacucuaaaguaauuugucuauaagucuuauaaucaauugcuuguuuguauaauuuuuuauaggguccugacggacagccuggaguaaaaggugaaccuggagagccaggacagaagggagaugcugguucuccuggaccacaagguuuagcaggauccccuggcccucauguaaguuaacaagaaaaaggcauaacuugagucaagugccccauguuuggaguguacauucagccucuuuugcuucacuauagugcucuuuuguuuguuucuauucaggguccuaaugguguuccuggacuaaaagguggucgaggaacccaagguccgccuguaaguuuauuugaugcucugcaaaguaugcacagcuaauucuaguuaccuagugcuuccuggucauguaaaagauaauuuucaucugagacugaaauaacaaauuauuaccuguaucaacuguacuauagugcaaagggcacuuaacucagauggagauuuggguuaaaaucaaguuuguaaucuuggagacccaggugccucaccuguaauguaaguaacauacuaccuauauaaaagaguaaauaaacaaugugaaagcacuuuauuuaauuugauuguauaaaauaucaaugugauucuaguacuaccugcauggaaaaaggaaaauagugcccuuccuaccaguuaaucuagauuaauuccccaaaauaugggauucguacgaagaaaaaaaaauauugcuuacaacaugaaaggaaaucuaaaggcuucagucuuccugugaaaaaaaaucccaggaaaauacauguaacuaauuuauauuaccuuaaaaauugcuuauaugauauucugguucuagggugcuacaggauuuccugguucugcgggcagaguuggaccuccaggcccugcuguaagucaacuuagugagacaagucacugauaaugaaauaauuacacacacacguauacauuugaguuaaauuuauuauuuuauuuaauuucuuaaugguauguuuucuuauuuaacaacucuuauuccaauaaugcaugcugguauuucagcaaagcaaaucauccuuaauaaucuaguauuucuuggaggagcuaauuugcaaguucuuuuuagccccaauguuuuauuauuauuccguuuaaauacugaauacuuacaguauuaugugcuaauaaucauucucuucaguuaagaugcaacuaugaaacuuucuuuaauaaaugucauucauuauaagaucaaaucauaagaauaaauaauuaucucagaauaaaguauuauauauucaucauuggaguggagcuuuaaauaaguuugaaaauucaaguuaguugcaccacucuuuaaaaauuauucaaagggaauugacugcaaaugauauuuaguuuucccccuggggaaugaaucuacagcuguguuuucuuuuguuuuguuuuguuuaaauccuauagaaugacugauuaucuaacagguaaaaugaaccugcgaggcuuggacaucugcaucugaggcagacagcguuaugucaaucacucuuacuugccuuccauuuugcccuccuugguguuucuuucuuuguuauacuagggagcuccaggaccugcgggaccccuaggggaacccgggaaggagggaccuccaggucuucguggggacccuggcucucaugggcgugugggagaucgaggaccagcuggccccccugguggcccaggagacaaaggggacccaggagaagaugggcaaccuguaaguuuggcguauccguuccagaccaccuucaacugagauauuuacaaauagaaacccauaaugaucagugucacaaaaaugcuuaaauauuaugcugggcacauuccuaaaauuuuuaaagugcauuaaaucuauaaggcuuuaggaaaaacguguauauauauagauuuuaaaaauagcaguaauagauaugguaucuaaaaacuaaacccaaaaaaauuauuuguuaaauguucauuguguaugaauaacuuuaaaaauauauguauauuauauuuuauaugcaaaugccuuuaaauauuguguuuagauaacucuuuuuuccuuauuguuaaacuuucuuuuugucuuuuuauaaagaagaaaaaauauuucucugaaguuaccucuuuuauugagucaguauucacauuaaucuucaguuucuuuccaacggaugagcuguuuucaccuuuaaauaauguuagagguucugugcggauuacaauuuaugacuacucauaugcaguaugauuuugagaaacagagaacuucuuuuucauacugaaaaaccuguaaagcuguacccaacuuauuguaaauuccuuggguacaguuuuacccuggauaguuucugauuuuaguuuguccucaacauuaggguccagauggccccccugguccagcuggaacgaccgggcagagaggaauuguuggcaugccugggcaacguggagagagaggcaugcccggccuaccaggcccagcggugaguagcugcaucggucaauauuuuaucucauaugugcaauacaaauuguuuagagaauugauuuuauuuuuuuugcuugaugaauagauuuaaacaguauuguagggacauuaauuuuugagucucuuaaaaaucuuuugaucuuaaaugucaaauucuuaacuaccuuacaaagucuuugaaaauauauauuuguuuaacccugagacuagaaaaguaggcaaauaaggauauggauuuuuggugaccuuuaaauccuucuucaaagauuaaaaagaucccggagcuagaggagggggauaaucuucuggugaauagguagugucuuuuuaaguaaacaugcuuaacaaaaauaccauauuuuacaguaaaccaucaaagggaagacauaguugagcuaaaguaauauuugaggugaauguagggggaaugcugaagaaggaucugaagguaaucuccuguucccuggagggugcuuuaggauuuuauauucccuggaguauggauaaaaguuugauucaaaguuagcuuugaagagacuaaauuuuauugcuaaaagauuacagugcuugaaaaaaauuaaugauguuuucauauggaauguagacagagagauguaugggaucuuagaacugggagacauguggguugaaauaugaaaccaacaaaguaggagcuaagggaugucuuauuguuaucagaagugagccaagaaugugaaaguaaaaucucucaagagugagaucaaaguaucagaauauagaaauaaaaugaacagacaaagcagagcggggaaaaaggaugaaagugaugcaaauuccagaagggcagcuagaaucaccuaugguacacaugauuagaacccaaaaugcacaccugugcugguggcaacagaugguugguuuuuggucccuuagauacgucaagaggagucugauaggaggugggcaggccucuaagaaagcauuaugauuacaugaguguuguaagauaaugcaaaauuauuauuauagaaggagcccagaggcaccauuuugaaaacuuagccuuuaugggaacuagcguucuucaauuucuucacaaguguuugacauuuauacuucuauuucagggaacaccaggaaaaguaggaccaacuggugcaacaggagauaaagguccaccuggaccuguggggcccccaggcuccaaugguccuguaggggaaccuggaccagaagugaguacuacagugaaaauaacucuucucuuguuaucuggugucauggaaacaauuuuuuucauuuagcaauugauuuagaauuuuauugcauauuugaccuuaagaaaguuucuuaguaauguuauuugauguacucuacuucccuagagaguuggcuaagugaugacauaaagaaaagguaauaggaucggugucuuugcacugaccuucaucuagucuggagcuaaguauuuuaguucauuuaagcuguugccaaacuguuuugagggugaaaggacacauccauucaucuuucccuuguuauuauuucauuuuguaaugacauauuuaucaaaauugccaaguuuuuuggugauaggauuaauauagcuauuccagcuugugaaaagggcaaaguuaguagagaucauuuuacuuaaauaucacuauaaaguaacauaauggauaucauguuccuuuaggcacuuuugggaggaaaucaguuuuugauaggcaauuugagaaguuaaaggcuggaauauccucuguucaggauuuuaaggagugaaucaucaaacaguuaauguaacauuuuauugaaagaaagaaucaauagccuuuggaacaauuuuugaucaaauagcaaagacauauuuaugaaaaaaaucacaauaaaauagaaaaggaagacuauuucuuaaaguaguuuaauauugaaacaguuauuuuauuucaaaacuuuaaggauauuugaauaaucuuaagaaguaaauguaagaaaagccuuucauuguuaauacaagcaaaacauaaaguggcaagaauguaauuguuaucuauuucaaaauauuuguggguuuuuuguuuuucaaaauaagaaauauaaaugaagaauauggauuaaguaagaauauguuaauuuuacaguaauucaaaauaaugaaaaagagguagaaaccguucuucugcugacauuugcauaaaugcuaacugacaguuuauaaaacacagguguaaaacaugcugucauuuuuugacaauuggaaugaggauuuuuuucauuacucaguuaaguaguuuuucaaaccauuauucuuuauaggguccagcuggcaaugaugguaccccaggacgggauggugcuguuggagaacguguaagagccauuucacuuauuauaaaaucuaaagucaugcaaaucugaaaucuuuuuaauuuacacuaaaaacugucauuuuuccugauaguuccaauacacuucugauuuuucugaauaacaacuguuucuguaaagccauaauuuuuauaucuuguaaaugaaaugauauuugaauaugcaacaaauuaagaugguauuuuuucagagcaggaagauaaaauugaagccaucuuugguuuaacauaaaggcuuuggaugaggauauauaugaaguguucuaaauuuuaaacucauuaacaaaagcaugaaagccaaaauagugcuguguaaugucuaaauuuuuccauucaccaucuaaagugaaugccguaugagaauauaagccauguggcuuuuuaaacacuguauauuccaugauguguuuuaaauuagaaugugcugaacugaacauguccccaacuuucucugaagccccagucccuucuggcaguugcacagucaucucaugcugcugagaugggccacugaaggcaaaaucacuccccacuccaaagucuguuaugauguaauuaaagcucaucauguagcagaaugggcuuuggagccagucagacuugauuuggaauauuguuucccuaaguaauuagcuguguaaucuuaagcagauuuucugaaccuccauuuucaaaugcuuuaaauauaauuaauacauaugccauugggcauuuguauauuaaaugacauguuuaaacacuccacuacaggauagacacucaaccucauauugaaaaaaaaggggaagaaaggauuuggaggaagcuugggcuaagucccgcucaucuacuauaauccacagacugcaaauucucuuggcaacuugggcuuuuuccuuugucaauauauacuauauagugcaaccaucuucaaagguuuugcugaaguaauuaugaaaaucgguaaaucucucuacuuauuuuaaguugccaucgcccuuuuaaaaucacaaguuuaaauaguugcaaaggaggugauuccugguaaauucuaaauguacaagugcuuuaaguauuuuuuuuuuuuuuuuugagacagagucuugcucuguugccaggcuggagugcagugacacgaucucgucucgcugcaaccucuaccuccuggguucaagugauucuccugccucagccuccccaguagcugggacugcaggcaugugccaccacacccagcuaauuuuuguauuuuuaauagagacuggguuucaccacguuggccaggauggucucgaucucuugaccucaugauccggccgccuuggccucccaaagugcugggauuacagcccacuuugugagccacugugcccgggcaaguauuuuuuuuuuuuuuucaaaaccuugaaguugccaauucagcuuauucaauguauuaugugucuguucuauaaccuaauugccaaaguuuaucuagguugauaaauuuaucagucaaauaagacaauuuuuugucagaaaauacagucugacucaauuuuucaagucaaauauuuauguuuagacauguucauauaacgcuuaucucaccucugacuucuuaaggagacaaguaauauuuggagccuugucauaauugugucaucuggauaaaauaaaaaggagccucuuuauuuuccaaauccuucguagcuuuauacucaaguaaacuaugcauucuggaaaagucccuuaguucagugccuagagguauuuauuccuugggacauugcaucauaauaagauugcagaugguaugauuucugcuuuucuuuuacaaaaugagagaagguggauuauuuaggggaaguaaggaaggauaaucaaaauauaguuuucugaaagaauacauaaggagaggaaaaucuagaaggugguuuccuuaaaauuuucuuuguuuucacagucuuuggaaagucuuuguguauuccaaguauaccaauauuccagcuuaaagauuggugcucuagaaaacauguuaaauucuggaggugaucacuccuauacuccaaugaucuugacgugcgagcaauagggaguaggugagggaaaggaugagacuugaaauuaggaagaaauaacuuuauucuuuucaauuugauuuauuaauuaauaaauauaaguaaaauaguuaaaauaauaaguaaaaauaaguuuuaaaggguauuuuuucccauuauuaauacuauaagaauaacaugaacauauggaauauuguuguuuuagaauaaauguuaaaaaauaauaucaugguuauucuuguuagggugaucguggagacccugggccugcaggucugccaggcucucagggugccccuggaacuccuggcccugugggugcuccaggagaugcaggacaaagaggagauccgguaaggagggagucaauuucacacugacaguuuugcacacccauaugcuauguuauaagcugcauauaggcacacacacauagucauacaugugcacuucguuaaggacucuaaauaaugaaugguaaacagcuaauuaugaacuacuauauguuucuuagucugaaaggcaaaauuucauuucuaagagggaauagaagauacugaugcuuugacuuccaucaucugaaaaugcuguaguuugaaaauguaauaaguaugcaucauguuaaaugucaaugaauaaugucuuacuguauucaacuaaggugauacuuauucaaugaagucaaugaauaaaauugaccguaaaagugucauugaaguuauagugaccacagucuuaucuacacauggacauuugccugauuucaauuaauuaaucauaagaguaugcacacacacacacacacacacacauauauauauaugcauccaacuauaaacguauuguugacauccuguaucuauguaauaugugaauaucuuuuuuacaugccaauuuuuuuuguuguaaauuucuuuuaggguucucgggguccuauaggaccaccuggucgagcugggaaacguggauuaccuguaaguucucuuuuuuuguuuuuuaaaaaauguuuucuuauauaaaauauacucccaaagaaguauaauuuaagauucauaacugaaaaauaugaaauuccucaagcuugaacaaaaauauuaauuaaaaauuauaaguuuacucuuauuuuuuaaaguaauacgaguuuauuuuuauaauuuuaacacaauucuucugaauuuaaccaugaauuauaucaauaaucauggagguuuuuaaagucacagguuucuccuaaaauaauaggaauuauagugcauuucucucugagcuauucuaaaaacuacauaggaaaauggauuugaaagcucucuguaaacuugaaaagcacuauucaaauauuauguuucauuuucaacuagauuuuucuuucuauguucugaucuuugugcuauuugcaaucagugacuuucagguuaacauuauuauauagaugucuuaccaugaaugaaucaucucauguguaaucuaauaggucauaugcuuuucaugcccaucagguaaaucaaugucuguucucaaaaagaacaauuauacuuugaaaaucauggccauauuauuaaauaauucuccucuuuaauuugagcuugacuggcaaauauuuuauaguugcauagcaugucaagugaacaguguuuugagcaguuauagaaacauuguaauuuuguuuucuaugaauaaauacauuguaguuaauaauucaaauaggugccuucugauuuaguuuaguuuuaauuaugaaacuuugggucaucccccaaauaaaagaaccuuucgaacauuaugaaaaacuucaggcugauuuugauaguauuuaaauuuauauuguuauauaaaauaugcaaaagcuacugaaaucaucuucuuuuuauuauaaauggguuccuauacuguaugauaauuaggaaauauaaauucaaaaucaaaacaauaagggaaaaauuaaccugagagccaauugauuugaugacugcagucaucuuccaaagucagauaaauagggauucaguuaucuuuugggaaaacacuaaaagcaacagaauccgguucuauaguagaugacucuaugccacuugucaguuuacugugaaccacucguucccuggagcuguuuuuaauuucccaggacuuaaaacaaaacaaaaccaacaccaccaccaacaauaacaaaacaucugagauugaucagauaauuuucaccucuucucuggguauagcuucuaucucaaaauaagaucccuaacuacggcuuucuuuguagccguagaucaagcuuagcaucaagaucacuggauuugguuacagauauugcagauaugggauaacuuagaguugcuuuguucuuuagaggaaaguggcuuaaagaugauauuucuguuuaauuuguucaagcaaguuuuugccaauuucuuaauauaguugcagcugucauagccagcuaguuuauuugcauauguaaauuuaaaaucauuucauuguuacacacggcaaguaugaaauguuuuaauuuaaaagaaucuauauaugguagcaauauuuuuauauaauaauaucaacuaaauaugugaagcauaaucuuuaaaaaacauuucagauaggcuagaucaaacaaaaauaucuaauuuuaguaugaauguaagauaaacauuuaaaaaauaaaucuucagaaaaguauucuuauuauaucuuuuuucagugaucaccuaccauucuuugggaaaaauaaacagaaauuucuaggucuaauacuauuuuuagauaaguaaauauauuaauccauauaaaauaccaaguucaaaauuguaguaaauacaauuauaaaaaguaaaauuuuaguaaauuuuagucucaacaauaauauguagcaaguaauuuucaugccauaucucuauuucuagggaccccaaggaccucguggugacaaaggugaucauggagaccgaggugacagaggucagaagggccacagaggcuuuacuggucuucagggucuuccuggcccuccuguaaguuauuccuuuaaguauuauucugcccuguaguugaaaauacacggguaucuugacacgaacauuuaucugucuguaaaauagguggauauguuuguaucuuauuuucaguucaaagaauaucuugaugaauaacaagugauaauugccaauaauaagcuauaauuuuguagggaagaaauaaagcaaaagcuauaugcacuguuacuccuacaggugucuuuaacauuggucaacucauguagacauugcagagauuggugacuuuaucaaaguaguucaugcugcuaaagucaaugauagcacauuuuugagaauggcacaaugcaggauccaaauauuuuggcaacauuuuuuauuguauuccuacuuaggguccaaauggugaacaaggaagugcuggaaucccuggaccauuuggcccaagaguaaguaacaaaaaguaguaaguugcagguguaaauaauaaugccuuuguugauguacugcuaaugcuugaguaucguuuuccugguauugaagcuggaguuggcucaucuucucugagguuggcaacacacauaugagacaagcuauuuagcaauuaauuuuaaguagaaauaucuugaaauaugauauauuaccucaugggcccgcaauaaaauuuauuaccuaggguuuggauauauuccucuguuaguucauuuuguuacauuguguuaauuuaaauuucuauucaacuuucacuuuuugagaugauguaauagcauuuacuaugaaguggagacagauuuugaagcuaaauauauuuugucuuuuaaguaauagugauaguuccucagaaguaguuuacauaaagcuaauuuggaaguaaauaauaaaaugaagccaauauuugaagcuuuuagaaauucuccauuaguauuaauguugcuuguaauaagucauugauggcauaagacaauugguggacauaauuauuuaggaaaauagaaaauauuuuguagaaaaaauuagaaaaaauaauuuaaagaaucuugguauaucugaauacaguguaaacaaagcauacauaaaauucagaauaauaguacaugauggcauucugaggcauaagcacagaaauuucacuuaaacacuccaacuucugucauuuucuuauuucaaguuaauugaauuucuaaguuuacaauaugugagguuuaaugaaaguuacuaccaauaaaaguaggugauuaguccauuaaagauguaaacucauauuugucuuuuaccaugcauggaugauggaaaauucuuaugugaugaaaucauaaauguuacaaaguaccagaaguucauuuauuaaucaguaagaaaaugaaucuuagaaaucacuguuacagcuccauauguaaaauaguucuuugauuagagaaaggcauuguaaaauuuuuccuucauagaaucuaaacuacagucuuuguuucuugcaggguccuccaggcccaguugguccuucagguaaagaaggaaacccugggccacuugggccaauuggaccuccagguguacgaggcaguguaggagaagcaggaccugagguaaagucacaaagguuuacaugcaagaaaugcuauuuauucaauagcucagauuccguccaagaaaugucugugcagcccgauugacaagagacuuaagggaccccgaaaacaaacguagaagucacacaagaguauaaguaacuauuucaaguauuuuaauacagauaaguuagagcacauaaaaucagaguccaaccuacccagacauuaacauaaugugauacuaacaagagcaaagaacaaguuauaauuguauuuauaauuaaaguuaugaaaauguugauuugcucucaagggcaauauuuuaaaugucugugagguauaguuauuacuucaugaaaacuccauagaaaugcuggacaaugaagaguaugaaauugaaguuuuucuccauugaaaacauucagggaggacuuugauuaaaacuuuuuguaaaaaguuucaguaguguugacuugaggaugauacaaagcuguauacuauguuaguuagauccuugcuucucaggucugggaaacaucuucauacaucuuccaugcacagguguacucaugugcguguuuguauaugagcuuaugcuucucucucugguguuucuuccucauuggucuuuaccuucucuuccuuacuuuuccuuugcccuucauagcaauacuguuaagccagauauuuacuucuuauguggaucaaauagucuuauauuuccuauggacaagagauauguuuucuacucauuuauuucucuaauugugaauaggaaacagcuagaaaauuggaauaccuucagcuuauguggcuguugauugacuuugugauucagugggccuugauauauuagaaaaaagucuuuucuuuucucuuaaaauuaguauaaaggaacgcaugaacucaguauaugaccuuagagacaggaagaaaaaaaaauuauguaacagcccuuugagagugaggaaacauuggcacugaagguaaaagcaacuugucuggagccauauaacaaguggcagagccaauaguagaacuccagccuucuggagaguucuugcucccagaucuugcucucuacaugagauguggacuaugugucucuucagguugucaccugguucuuucaaguugcugaguucuuccuuggggaagugcagaagggaauuaauagagaggauccauuucguagucucugccacuuuuugugcuuaucucccucucauuucagugugucuuauuuggcaaaaaaaaaaaaaaaaggcaggagggcucuuuauuuaugucaauucaaaggcuaaggcuaggaauacugggcaccuuggcacacaccuguaauucuagcuauucaggaggugaaggugggaggauugcuugagcccagcaguuugaauccaacuugggcaacauaguagcaagacccugucucuaaaaaccaauacuauuucuucaguuuuucuuaggacagagaauuuuuaucuguacaggaauuaaugcacauaaaaggacuuccuguguuucucucccucucuuuuagaaguaggaguauaauucucuuguggguguuuccuguggguauuuucuuguuauugacauguaaucuuauagaaccagcagccacuauuccccugcaugcuuuguucagcuucauccaaaaauaauuuuaaaacauuuugguuguaccuugacgaaaauaguuugcaaaugaacauacauaucugcaugcuauuaacauaaaauauguuguaucuucaagguaaacaccugagcaaauauuuugugcuuugaucuuuauuuaucuuggaugcugacuugaagauauguuuccugaaaaaugauugagcaucauuucucauccuugaauguuacagccuguuagaccacccccaucuaguuacaaaagggcgcgagucauagaucucccuuuacugucaaauuggagugucucauuggaacucccuaugaaccaaguucuaccaguuaaguaaaacaaaaacaauguguuaaaugucuuuccaaucucuuuuuaauuagggcccuccuggugagccuggcccaccuggcccuccgggucccccuggccaccuuacagcugcucuuggggauaucauggggcacuaugaugaaagcaugccagauccacuuccugaguuuacugaagaucaggcggcuccugaugacaaaaacaaaacggacccagggguucaugcuacccugaagucacucaguagucagauugaaaccaugcgcagccccgauggcucgaaaaagcacccagcccgcacgugugaugaccuaaagcuuugccauuccgcaaagcagaguggugaguagacagcagcccauuugagcaaaacccguuguuucugauuguuuauucucaacugcauuccaaaauauguuacugacuuucuacuuagugauagauuugagauaaaaauaguaaacauaucauggagcuuauaauuuaaugguggaaacagucaauuuugugaaaacaugaaaaaaaugcucagcaucacuaauuauuagagaaaugaaaaucaaagccauagugagauaccaucucacacgagucaguauggcugucauuaaaaagucacaaaacaggccaggugcggugucucacgccuguaaucccagcacuuugggaggccgaggugggcuaaucaugaggucaggagaucaagaccauccuggcuaacauggugaaaccccgucucuacuaaaaauacagaaaauuagucaggcgugguggcgggugccuguaguuccagcuacucgggaggcugaggcaggagaguggcaugaacccaggagccggagcuugcagugaguugagaucgcgccacugccugggcgacagagcgagacugugucucaaaaaaauaaaaaagucacaaaacagauacugacaaggcuuuggagaaaagggaaugcuuauacacuuauuggugggaauguaaauuaguucagccacuguggaaagcagcuggagauuucucaaagaacuuaaagcagagcuaccauuugacccagcaauccugugauuugguauaucccaaaggaaaauaaaucguucuaccaaaaagacccaugaauucauguauucaucacugugcuauucacaguagcaaagacaugaaauugacccagaugcccaucaaugguagauuggauaaagaaaaugugguacauauauaugauggaacauuauguggccauaaaaaagaaugaaaucauguccuuugcagcaacauggaugcagcgggaaaccauaauccuaagcaaauuaauacaggaacagaaaaccaaauaucauauguucucauuuauaaguaagagcuaaugagcacacauggacauaaauaugaaaccauaaacacugcaggcuacuacaggggggaggguguggaugggagcaaggguugagaaauuaccuauuggauacuaugcucacuaccugggugacaggaucuguaccccaaaccucagcaucauacaauauccccauguaacaaaucugcacagguaccccuuguauuuaaaauaaauguuaacuuuaaaaaaaauguacuauaauagaugauauauccuauuaauaauccaguuucaugaugguaguuccauuuucauccagaaaucuuaaaauauugauauuuuuguggaauaaaagcauuucguggaaauguggaaaaugcuugcuuaaguauuguucaaaauauuuauuuacuugcaugaccuauaagugucuuaauguuaacauauugcuggaucaucaagcauauauuucccacauuuaaauauguaauuccuuucauguaguuuaauguucuaugagucauacuuuuggaaucucugcuggcaggauuauauuauuaugagguuccaagacauuuuggaaucaaauaguuguucugcccuaguugcauguaccaggcuuaaaguuuaccuuauucugucauuuuaauuaauccaauaugaccuagagaagagggauccuaagucacaggagacaaaugagcuacaaagagccuaagaauuuaaguuaacuuugaaaugacauugacaggaauagcuaaaauuauuaucauugaagaaagggcaauuuuauuaacucuauacauuacauuccgacacuuucauuuaaaaugcaauucucacauacuauuuauauaauauacacacaaauauauguauacacacacccauguaugcaaaugcauauuaaauuguguauuugacuguaugccuaccaccaggcacugccuugguauuuccuauuuuaagagucucuuauauaugagaagaguaauuuuaaaaagaucuaaugaaaugauucauagcauucuaauuguaauucaacuuauuuauucacuuuacucauaguuuugauguuacauuauuuuauuacauuauuuacauuauuuuguuacacucauucuaauuugcuuuaaaauauuggaaacacaucuauuuugguaaagccgcuuacuauagauuuucucuuuucgguaugguuuucucaucuauaaaauggggguaaugauauuuccuucauauggauguuuugagccuuaaguacaugguuuggcaaagugccuuacaauagcgacuagaauguagaaaggcccccaaugcauaccgguuacuuuuuucguaaggggcacucucacuuaaaagaauccuuaaucagugaguguauauuuucaaacccucuguuaauucuuuuggagacuuauagucaugauugagauugucuuuauuuaguaaaauuucuauuuugaaaaauaggugaauacuggauugauccuaaccaaggaucuguugaagaugcaaucaaaguuuacugcaacauggaaacaggagaaacauguauuucagcaaacccauccaguguaccacguaaaaccuggugggccaguaaaucuccugacaauaaaccuguuugguauggucuugauaugaacagagggucucagguaauuuaauauguuuacuuaaaauuguauucuuuacuuuuuacuacuuauuacauauuuuugauuuauuuaggacuuugcuauuuuuuuaaaccaggcuuauuuuaccauguuuauuuugaagugauauagucucauuaguuacaauuguaauaccauugcauaaacaagguuuugcuaugagugaaguuaacauaaauuuugaauuaaaaauuuucucauggaugaaauauagaaaaguaauuauuuuuacuguaaguuccucuaauguaugugacauggacuauggaguguaccagaagugauaaacuauagugccauaguugauaaacaguuauuucuguauauucagcuucagcagaccugguuaccucacggggaucuuguacugacuuuggggccuuauaaagucucugaacuuuuuggagacucaguuuugccaguuuaaaguaagggugauaauauuuauuccauaguuuccauguggauauaaaauucuuaguuuagggucucuuguacuaugggauagaugguaaauuaauauuagauaacuacuauaauaaugucuaaauaauugaaucauuuuguaaaauuuuuaauauuauuuaaacuuaaggcauuuuuguaauguuaugaagucaauugauauuuuucugagucccagucuacccuguuucuaucauggucugguguucagacaacugucuggccuuuccacugccuguugcaaugugaauauuucauucugcaucucuuuauggcagccuaauugaaauuuucuucucacuucugcuucugaccuuuuccuagaaaucacguucagaauaaacauuaugagaacauuauggguguauacaagauaagcuaguaucugucauuauuuaaugagcacaaaauuuuaaauuuuaaauauaaauaguugaaauauaauuuagcuaauauaauauguaaaauaaaacccccaaaugggagugcugaaaccaaagcuaaaguagaaggugaguaggaaagagucucuagaaaaauuuuuuugauuauuuuuguuagcacauggaaaacuuuuaauauguauuuccuacaauuguguaauaguuggggucaaaagauuuuauacuacuaguuaauucuaauuuuuauuauaauuagcaauaaaaaugaguuauuuuugauacaugagugaagcagauuuaaaaauacuuaugcuuguucucgugaauuauuguuauuauugguuucauuacccuuuggguuaauaaggacagagguucuuuugaguauucauagacauuuuaagauauguuuagauguacagcuagaauagcuuacuuuaugacaagaauuaaaguaauacucuucaaaauugauuuaucugaaaucaauuuauauauuuaucuauacauguguaaggcauuaugaaacccuucagucuuguguaugacaaagacucuuuguuuuucuaguucgcuuauggagaccaccaaucaccuaauacagccauuacucagaugacuuuuuugcgccuuuuaucaaaagaagccucccagaacaucacuuacaucuguaaaaacaguguaggauacauggacgaucaagcuaagaaccucaaaaaagcugugguucucaaaggggcaaaugacuuagauaucaaagcagagggaaauauuagauuccgguauaucguucuucaagacacuugcucuguaaguacuuuuugaucuacauugaucugguugaggaaaaaaaauuauuuuuguuaaaaauacuauuacagcacuagaacugggggcaauuuuaccuuguauaugagcauaauagcaguuuguuuauagucauuccuuaggguaaauguguguguguuagcacaugaagcaugauagagguuugaauccauauaguaaagaaagaacuggaucccuaagaucugauccaguucuucugcagacuuucuuugguucuuuuccaaguuauuuaacuuacugaaucucagucccaugcuuaaaauuccuuauuucuaaaaugcguaauuaauccaagauacuuuauuuuuuccaccaauuuguaaguaagucuccccgcuugcauauugagauauaaaacgaaaauaauacuaaauggugaauuauaguuucauuugugaaaaacaaaaaagcuuucauaauuuauguugcuagugaccauuugggaagcugcagaagaacaaaggaaauuuacuuaaagcaugaaagaaauucuguuacauaaguacacuaauauuucacuuuauguuuucauuccuuuuuuuuaaguaguacucuaaaaaucauugccuuuacauuauaaaagugucugggaagguugcugucuaacauacuuggaaaaaauuguauguacauuuaacccauugcaucauuuaauuucagaagcggaauggaaaugugggcaagacugucuuugaauauagaacacagaauguggcacgcuugcccaucauagaucuugcuccuguggauguuggcggcacagaccaggaauucggcguugaaauugggccaguuuguuuuguguaaaguaagccaagacacaucgacaaugagcaccaccaucaaugaccaccgccauucacaagaacuuugacuguuugaaguugauccugagacucuugaaguaauggcugauccugcaucagcauuguauauauggucuuaagugccuggccuccuuauccuucagaauauuuauuuuacuuacaauccucaaguuuuaauugauuuuaaauauuuuucaauacaacaguuuagguuuaagaugaccaaugacaaugaccaccuuugcagaaaguaaacugauugaauaaauaaaucuccguuuucuucaauuuauuucaguguaaugaaaaaguugcuuaguauuuaugaggaaauucuucuuccuggcagguagcuuaaagagugggguauauagagccacaacacauguuuauuuugcuuggcugcaguugaaaaauagaaauuagugcccuuuugugaccucucauuccaagauugucaauuaaaaaugaguuuaaaauguuuaacuugugaucgagaccuacaugcaugucuugauauuguguaacuauaauagagacucuuuaaggagaaucuuaaaaaaaaaaaaacguuucucacugucuuaaauagaauuuuuaaauaguauauauucaguggcauuuuggagaacaaagugaauuuacuucgacuucuuaaauuuuuguaaaagacuauaaguuuagacaucuuucucauucaaauuuaaagauaucuuucuccucuugaucaaucuaucaauauugauagaagucacacuaguauauaccauuuaauacauuuacacuuucuuauuuaagaagauauugaaugcaaaauaauugacauauagaacuuuacaaacauauguccaaggacucuaaauugagacucuuccacauguacaaucucaucauccugaagccuauaaugaagaaaaagaucuagaaacugaguuguggagcugacucuaaucaaaugugaugauuggaauuagaccauuuggccuuugaacuuucauaggaaaaaugacccaacauuucuuagcaugagcuaccucaucucuagaagcugggauggacuuacuauucuuguuuauauuuuagauacugaaaggugcuaugcuucuguuauuauuccaagacuggagauaggcagggcuaaaaagguauuauuauuuuuccuuuaaugauggugcuaaaauucuuccuauaaaauuccuuaaaaauaaagaugguuuaaucacuaccauugugaaaacauaacuguuagacuucccguuucugaaagaaagagcaucguuccaaugcuuguucacuguuccucugucauacuguaucuggaaugcuuuguaauacuugcaugcuucuuagaccagaacauguagguccccuugugucucaauacuuuuuuuuucuuaauugcauuuguuggcucuauuuuaauuuuuuucuuuuaaaauaaacagcugggaccaucccaaaagacaagccaugcauacaacuuuggucauguaucucugcaaagcaucaaauuaaaugcacgcuuuugucaugucagugguuuuuguuuugugaaauuccuuugaccauauuagaucuauuucauuuccaauagugaaaaggagauguggugguauacuuuguuugccauuuguuuaaaagauacaacggauaccuucuaucauguauguacuggcuuauaaaugaaaaucuaucuacaacauuacccacaaaggcaacaugacaccaauuaucacugccucugcccuuaaaaaugucagaguaguauuauugauaaaaagggcaagcaauagauuuuucaugacugaauaaacuguaauaauaaaacauaugucucaaaguguaucacauaug

SEQ ID NO: 12701 - RNA, 3173 nt, Homo sapiens
agauggcggcggcgggggaggcagcgugagcagccggaggagcgccgagucccauugaaaccggcagccauggcccuccacagcccgcaguauauuuuuggagauuuuagcccugaugaauucaaucaguucuuugugacuccucgaucuucaguugagcuuccuccaugcaguggaacaguucuguguggcacacaagcuggggauaaacuaccugauggacaagaauaucggagaauugaguuuggugucaaugaagucauugaacccagugacacuuugcugagaacccccagcuacaguauuucaagcacacugaacccucaggcccccgaauuuauucucgguuguacagcuuccaaaagaaccccugaugguaucacuaaagaagcaagcuacggcuccaucgaccaguacccaggcugugcccucgcuuuggauggaaguucuaauguggaggcggaaguuuuggaaaaugauggugucucagguggucuuggacaaagggagcguaaaaagaagaaaaagcagccaccuggauauuacagcuguuugaaagaugguggcgaugauaguauuuccgcagaagcccuggucaauggcaugccaacucagcagaacagugucagugcagaggaugcagaauuuaugggugacaugcccccgucaguuacgcccaggacuuuugacagcccccagaacuccacggacucugucagugacacugugccugacaguccuuuccccggagcacuuggcagagacaccgggacugcagggcagcaggaggggggucccgggguugauuuuggucaguccugcuucccugcaggggcuggcagacacacccugucaaggacagcuggggcucagcccugcguucguaccgauacuacugaaaaccuuggaguugcuaauggacaaauacucgaauccucgggugagggcacagcuaccaacgggguggaguugcacaccacggaaagcauagacuuggacccagccaaacccgagaguccaucaccuccugcugacggcacgggcucugcaucaggcacccuuccugucagccagcccagguccugggccagucucuuucacgauucuaagcccucuuccuccuggccgguggccuauguggaaacuaaguauuccccucccgccauaucuccccugguuucugaaaagcagguugaagucaaagaagggcuuguuccaguuucaggggauccuguagccaggcauugguugcuuucccgccgauguaccaccugaugaaguucauuccucuguauuccaaagugcaaaggcccuguacgucaacacccaagauagacagcuuuguuuggcuaaugaaugaguuuacuaauaugccaguaccuccaaaacccggacaagcucuuggagaugaaaucgugagggauauucacccuggaguugccuuugagcccacguauauuuagacuccugacaguuaacaagucaagccugucugaaaaggaucgacaagaagaugcugaggaauacuuaggcuucauucuaaauggacuucaugaggaaauguugaaccuaaagaagcuucucucaccaaauaaugaaaaacgugcgauuuccaauggccccaaaaaccagucaaugaagaagagcaagaaaaacaaggugaaggaagcgaggaugaaugggaacaagugggcccccggaacaagacuuccgucaccugccaggcggauuuuguucagacuccaaucaccgcauuuuugguggccacaucaggucugugguuuaccagcagagugcaaaagaaucugccacuuugcagccauuuuucacguugcaguuggauauccagucugacaaaauacgcacaguccaggaugcacuggagagcuugguggcaagagaaucuguccaagguuauaccacaaaaaccgaacaagaaguugagauaagucgaagagugacucuggaaaaacucccuccucuccucgugcugcaccugaaacgauucguuuaugagaagacugguggugucagaagcuuaucaaaaauacugaauauccuguggacuuggaaauuaguaaagaacugcuuucuccagggguuaaaaauaagaauuuuaaaugccacagaaccuaucggcucuuugcaguggucuaccaucacggcaacagugcgacggguggacauuacacuagagacgucuuccagaucggucugaauggcuggcugcgcaucgaugaccagacagucaaggugaucaaccaguaccagguggugaaaccaacugcugaacgcacagcccaucugcuguauuacugccgaguggaccugcuguaaacccugugugcgcugugugugagcccaguguccgcuuuguaggacaccaccucacacucacuucccgccucucuuuauuggcucuuuagagagaaacucuuucucccuuugcaaaaaugggcuagaaugaaaaggggaugccuugggguucgugcacaacauagcuucuguugacucuaacuuugaaaucaaaaucauuugguugaaacagacugucgcuugauuuuaaaaaauacacaaaaacccauauuucugaaauaaugcugauuccugagauaagaaaguggauuugauccccagucucauugcuuaguagaauaaauccugcaccagcaacacuuguaaauuugugaaaaugaauuuuaucuuuccuuaaaaaagaaauguuuuaauccaucacauuuuucuucccuacccuuuaguuuuugauaaaugauaaaaaugagccaguuaucaaagaagaacuaguuuuuacuucaaaagaaaaauaaacauaaaaaauaaguugccgguuccuaacaggaaaaaaauuaguaauugugcugagggaaacugcuuacauagacauugcagaucaaauauuuggaguuaaaauguuagucuacauagauggaugauuguaacuuuacugccauuaaaaagauuucagauugcauucaugcuucuguguacacauaaugaaaaauggacaaauaaugaagaucucuccuucagucugcucuguuuaauucugcugucugcucuucucuaaugcugcaucccuaauuguacacaguuuagugauaucuaggaguauaaaguugucacccaucaauaaaaaucacaaagcugguuua

SEQ ID NO: 12702 - RNA, 34434 nt, Homo sapiens
agcgccgacaccacagacacuagaaagcgacgccuccggugggacgacuggaggucacgugguacacuauacgccaccuuucccuucuggcggaaaaagccauagagucagguugacaaggccugagagaaauaugucuguauuaaauaauuguguauagguauauaauaaaaacugauugucucuaaaucucuguuuugcuuucaccuuuucuuacaagugucuuaguuugacauugcccacacaaaaggugccugcacggaagcggaguccuaccaccgagucucaggccuagaagggcccggggguggguucugugggcugggaacagccuuauuacccggcucaacgaaggaaguucagggcgggaccagagauuggccauuccgcuacugcgcaaagaugguggaggaggagaacauccgcgugguucguuguggcggcagcgaguugaacuuuaggagagcuguguucucugcagauucuaaguaugaggggcaccgcgcuuugucggcugaggggcggggcgugaguuucucgagggucggggagaaggaauugucagucgcguucggacucgcccgccuggcggauaucggcuuuggguagagcacgcgccugugggggauccccaggguaccugggaggucccguuaccacugcagauuggguugcgucccccgauuccuggacaguuuaccugcagguagauaaaggcccuggagccggucuccgugucgaggaucuggaagguguucgggcggcuggaaaaugguccagggguggauguguaugccacuaccuuugcaguaccuacucuuucguacagaaucauguuuuggagugacuaaaaccuaaaacuauuccgcuuuuucuacccacuccucacuccugaagcauagugcaugaagcauagugcagucuuuucggaacuuuacaugaaaacagauguuagauucuuuaugagauaaaaauacgcuaagacuuggucucuuuucucaguguagcuggaaaccaaaccacucccuggcuucaaaauccacuucuuacauuaugaaaccuuuguaaguuucuuaaucuuugccucaguugccaucaucuguaaagggggacaauauuuaguucaucucacgugguuauugggaggauuaaaugccucaauauguuaaaacuacagacaacaaugcccggcacauaauggcucaauguauguagcuguaaucauuauuacuguauugucagguuuucaaauaacuuuagguaggguggcacuuaauaaaaucaaaaaacccuuucugccuuagaagaguagagauaguauuuuaugaaaguuuguagccuccacaauauucuuuuuuuuuuuuuuuuuuuuuuuuuugaugcagaaucucacucugucacccaggcuggagugcaguggcucaaucuaggcucauugcaaccuccgccucccugguucaagcaauucuggugccucggccuccugaguagcaaguauuauaagcgcgggccaccacgcccgcuaauuuuuguauuuuuaguagagagaggguuucgccauguuggccaggcugcccuggaacuccuggccucaagugaucugcccaccugaaccucccaaagugcagcgauuacagugagcaacugugcccggcccacccccacaauauucugcauaugaguguacgacagguaguuguugaagguaaugcaagcaugacugaaagagcuuuuauaaauugccuuagaagccaaaaaaaaaugaguccuguggcuuuguugacauugaucuuaugaaucaaaggaagaaacaggcuuuaagaggcugucacacugugacgcuucggacucauauccauguaaccaguacuguucuuauaccuuauucauuauaaugagguccauuguguguuugauuugcuaagcccaacaauucauuuuuuaaguacuugucaacuauauauuauguauaacaugcugcagugacaaaaacuaagauaauuuuaauauugauccugccuucgaggagcuuacagucuagugaggaaaaggaauacucaguaacagauuuuucuuacugugguccuguaggaaggagcucauaagaagagauuacuucccaaacuaagaaggacggagaagauugcugagcaaaugacauuugugcuaggccuagaugauauuuuaaguggggaauauggacagaagacauuucagguggggaggacaguguaagcaagaaagacagaagugauuucuguugaacaggcugguacaguuagcuaguaagaaugguauauauuaagggagguagugggaaaugagguuggaaaggacacgugcagccaguuguugguuguuguuuggaccaaagagaaugguuuuuuaauucuuuaaggggacggcgguaaucaguuguaauuugauuguguuucuucaauaauguuaaccugaaaacuguaaaacucuaugauacauguuggugaguggagaaaugagagcuggguaggcugauguacauaaaguacagugauggcauagaagagggaguuacauagucaguuuuaccuucaguagugguucuugcagcaauggcaagaguuugccucaccaguaauacugggggauggaaugccaggcaaacaagcuugaaaucugggggccuugaaaacuggggggauugagccuucuauguaaagucaguguaauugcagcauaggguauaagagauggcaggaaaagacucuggaagaauagagaccagggguuagaagaccagugcaggcauccaagcaagaaaucacuuuugcccaaacuaagguaauauugaacauggagaaaagagacaggguuuuagagugauuucacagucagugucaauggggagauagaguucaguucgggguuauuaacucuaagguaccuguaaaacaaccagguggauauagcuaguaguagguagaaauucaggacugaaguuuggagaacuuggucaagauuuagagauuuuuuuuuugucaucuauauauaagcuaauaauuaaaaccauuuaucuaacaaaugacaggauuuuaaugaacucagcaaagauuugaauauuaucuacaagguaccacaagggauuggcugccuuauacaaagaggaauaauuuuguauuuuaccucaaggugcuuaucaagaaagccaaaaucauaaaaagacagacuuguggaauuuuggcggcuuccucuugaaacuagaacaaaaacucuguucuagguacuugaguagguuguucugaggggcauguggguauacauguaaguuccugguguucccauauuagauauuacugacucucaguccaguucuguuugcaucccauucugcggcaucccacaguuauauggugcugugaauuauugcacugggguuguuaggguagagaaaacugaaacaaugagucauccuugccuuucacuuuccuaaauugcccacaagcuaaugucccaaacucaguauuuuucccuuacagaucauucugaguauugcugcuguaacaauuuuccuaaguuguuacuguuauaacauuauuacucuaacucuuauuucuagucuugcucugaacuuuuuaacaguuuuuuguugccuccuuaacuauagcuccucuauauggcuuucaaucccuucucugauauagcucaacucuuccuacccaacuguuuccugauacuacccauuauagacacuuugcuugucagauaaguacauuaucugugucuuguauauaaucauaccauuuccuugcucuugcuuauguugcuauuuuuucuucccaccccuuaaaucauacauccuucagagucuaguuuaaaucuugguuccgacuugaaacaucccuaauuucuuacuucuucacuuucucaacaaagaugaauccuaugugacagguguuguggugggugcauuacacaccuuccagucuacaagguuaagguauuaucccuauugagugagugcuugcuguguaugcuaagcuuguauuugcaugcaauguuucacuuaaacucuaugagaacguguuauuuacauuuuacaguggcuaacuguaaguggagaugugaaguuuaaagagguuaaguaaauucuccaacaucauucagcuaauacauaauaaagcugacauucgaauccauuuguguuugacuuauuauuguuucuaauaagugaaaacacagugucucaccucaaagacucacagucugguagaggagaaacauaguacacagacagucuuaaugccuugugguaaguucugugauggagcuaagcccaccgucguguagaagcacauuaggacgggugcugaucuagaaugagaagaugaggaagggcuuccgggagaaaauucugagcugaaucuuaaagcaguagucaagaguucugagaaaugggaaagacugaaaaacugucacugauuggaagguucugagaagauaugacaacuaaggugguaugcuggacuggggucuaggaacauaaaaaagacauuaauggaaaaagugaagagcuccaaauaaauuauguagucaauagucauguaccaguguuaauaucuuaguuuugacuaacaugcugugcuuauguaaagugcuaacauuuguggaagcuaggugaagcguaugcaggaacucuguaauucuucuguaaaucuaaaauuauuucaaaauuaaaaguuaaaaaauaagcuuacucuuaggaaauaaaaaagaaguaauuagaaaacguguucuauguagauagcagagagugcaaaaccauggagagaaaguugacuuugaaggguugcguuuaaguaauugaagccauuguucuaugcugagaaacaagaagagaggauauuccuuuuuucugaggaagcuuaucagaaucaauuagggaaaguuuucuuggccaacaguagcccccuacccaccacugucucaaggaagccauaucuaaaggaccucuucauauugauagggugugucugggggaugggggaaauuguuggaguuaugaacuauuuuaauagagcacaguguuaagugaaaaaguaguucaaguuagacugggaucagacuaccaaagccuuaagaauuuagaucauuuccuaaagucagagggaaaacagugaaggauuuuagcuuuaucugagcaaguaauauggucaaauuugcaaaauuagucuggugugacugugaaagcugcauugaaggacuguaccuggagacuguaggaagcccugaagaguggcccaggcuggagauguuaagcuucugaacugaaguacucaugggaauggagaagaggcuccagccaaagggcagguuauauaucgcaaaugcuuuguugcucauacauucuugaucuuauaccauuucauacaaccaugccuccuggcugacagcacuuacaagagaccauugauuauaagaugcauucuaauuucaaagagaugaacaagugaaaaucaagugucuugaacuaauaaaauaggauaguaguggucccaguuugcaacaaauuuaguguguuguaauacaguagcucucccuuguccacagaggauauguuccaggacccucaguggaugccuagaaccacagguaauaccagacacucuauauaguaaauguuuuccuauacauacauaccuaugauaaaguuuaaguuauaaaucaggcacagagauuaacaucaauaacuaauaaaauagaacaauuauaacaauaugucagcaucacuacccuuauacuuuggggccauuauuaaguaaaauaaggguuacuugaacauaaguacuucaguacagcaauaguggauaggauaaacuagacaguuucuacgugacuaacgggcaggugugucuacagcagagaaugcuggaaaaaggaaugauucaugucucaggugagacaagggaauucacuacugagaauggcauacaauuuuaaacuuaugaauuguuucuggaauuuuccauuuaauauuuucagauugaucuugacuguagguaauuaaaaccagggaaagugaaaccauaaauaagagaguacugcuaugaauauaauagacacagagcaaauacuuuuuacuuggaagauacaagaagauuuauauuucugcgccuuguucugugauaauaucgugaaaguagucaaacagugccccaaguagcuuaaccacuuuuaguaauuuaguagcugcugcuacauggaagaaauccacaaauccagaaagacaaagcaaagcuagcauuucagcaacaagaaacaaaaauggaauaaagucuuuguauuuuucuguacaaaaggcccagaccucaccaacuggagcagaaccuuugacuuaccauuuguaagcugguguugccagugaaccauggagauguuggggacauggaaaaacacugcuguuggcaguacuauugaagaguaauaguugauagugacuaguacagugucugcauccauuuaaugagcaggcaacuugguuaagcuggcuguuuuugcaggauaauuccauuuauagccucugucuacaaacagucaagagauaugauauuggcaucauuaaucuuuucugaguuaauaaucucuucugaguuaaugaacugauuggucauagauguccccauagacaaaaggcacacaaauuugaguauacaauucuuaaacuauaccaaaagaaaugucuguugcauuuuuaucauggacaauaaaaagauccuacuaccuauugaguaugugauaugguuuggcuguguccccacccaaaucucauuuugaauuguagcucccauaauuuccacaugugggagggacccaauuggagauaacugaaucaugggggcaguuuccccuauacuguucuugugguagugaauaagucucacgagagcugauggauuuauaaaggggagcucuccugcacaaguuguuuuugccugccaccauguaagacaugccuuuugccuuccaccaugauugugaagccuccccagccacguggaacugugaguccauuaaauuucuuuccuuuauaaauuugaagagggagaugguaagguuuugaaugagauauguaaagcaccuaggugcuaggcucccaccuguaaucucagcauuuugggaggcccaggcaggcguaucacuugaggccaggaguucaagaccacugaaacaaugaugaaaaaugucuuuuucagcagugugaaaacaggcuaauacaguauguaaaacuuacuuuucuuucuuuuuuuuccagguauaucuucugugucucuggagacuuuguuaaaguuuacagcacaguuacagaagaguguguacacauacugcauggacacagaaaucuggugacuggaauccagcuuaaccccaacaaccaucuacaggugucaaacaguuuauagcugaauacuuuaagacuggcuuuguucuugacagaaaaauuugaguugaauuugacugagaaacuuuccagguuauaaguaaaauauuugcuuauuuucaguuguaggguauuuuccacuugcuaaauuacauugccuauagcauauucugugaaccauuuguuccacagaaugcuaagagguauuaccugagaaggauauucuuggcuguaugaguuucugaaauucagggcuaggcacaguuaaauguauuuguugauuguaaucuuuuuagguucccuuacaugcauugcgaauauccaaaagagguauguaguuuuugguguuucucaaacuuacuugacuugugaaccauuuggugucuggaacacauuuugaaaaauguuggccaggagguauugauuugguagauauguuccuuuagaaguaaggcucuggcuuacucuagauauugccuagucuuaagaccagugucuagauaagaaaauuuguuuggugagugggucaacuaguuaguuucaagacaaauuugggaauuuaauuuaguccagauuuucccacgucccccacaaagcagcccuucuuucuuaguauuuaagaauaaugaaauggucauguuaauucuguucuuaaguuucggcaaaucuacuaaaauuuuaucucaacaauauuuuguucuugcucuuauuuuuaauccaauuccauuuuccuggauuagucacagccaacuuggaaguuauugauuaaggauggauuugcauugccauucacuuuuauuccaaaggaaauaaaguagcaccgaucuuuucuuuccaaaauuaaaugagcuacuucuaaaaaucaaaguuaaguaacuuuucuacgggauccaaguacauauuuuaugcuugccguccucugaggguuugacaaaaguuuaucgcuguguguaguguuugaauguuuuuaauagcaaaacuauuauuuuguuaaaauugaaauuugugaaguccauauacuaaguuuuauagccaaaaaaacguauacacaauucauaaaagcuuuguuucggaugacugaaagugaguaaaauuagagaagggcaguuuuaucagauuugguugaggugcaggggcagcaguucuggacuuaggagucacaguguuuguguauuaaccauuguuuugacaguaauuauauguuugacuuguuacauuuuacuaguccauauuuaugauucucauaugcaguaauugugauauaaauuuccuaguuuguauaauuuuuugacuuggauagauaauaugguuuuacuccaacauuuuuacauuccucuucucugaguccaugucucuauuugcagaaauccuaaaauugccacuuucuuuaaaaauauuaaaauucuuuguaaacauuauaagcaaaguauuuuccuauaacaacgacaacaaaaucuagcagaaacuuaguauuaauaaaacuaaguacacugggacaaaaguaagccuauguguuaguaaggucuucuggugcuaccaaaguaugguccacagaccaguguccuaaaccauuaguuaccauucuguauaagaguacagaaugugagugucacaaaacacuuugacauugccucagcauccaagcauauuauaauuucuauuguauuuuaugaaaguauugguccuugauggauuggaagaaauuuuuuuaagcagaauauucuucagucacuugagaagcacucccuuaaugcucauauaagguaaaaggaguuuggcuaauaaaacugaguaagcugaguucuggcaggaagagcaacaagcucuuguguggguguuuuuguuuuguuuuguuugguuuugguuuuuuuuucuggagagucucacucugucucccaggcuggaguacagcgaugugauugaucucagcucacugcaaccucagccucccaaguagcuaggauuacagggaugugccaccacgccuggcuaauuuuuguagggguuucgucauguuggccaggcuggucucgaacuccuggccucaagugaugcacccaccugggccucccaaagugcugagauuacagguggcagccacugcaccuuggugcuuuucauaucucauucaaaaccuuaccaucucccucuucaagacagaaaguuggcuuuuuuccucucucuuuuaguuaaaacuugaaauggauggaucugcuucuugcagaaagcugugaaaagauuguuuugcagaagcaauauaaauaaaugacucuaccucuuuaagguuaacagugaauuaaugaauagaaaaugccccugaucaacauuuaauuauucauuugauaucuugaugaauuucuuuuuuuuaaaucaauuuuguauuguuuuacccuuuuagcuguauucuuguucccuugauggcacaauuaaacugugggacuauauagauggcaucuuaauaaagguauguggauugaucuuuacuuuucguuaugugaauaaaaaaaggcaauguaauuuaaugguagauguacuguuucuauaaggccaaauauuuaaauagacuuccuaaacaaguuacaaaauaacaucaaaaaaauuaauuugacuauauaaaaauuuuccacuuauaaaagacaagguaaagcuggaagaagauauuuacaaaagauauuauuccaaauauacaaaaaucuucccaaaaaccaauaaggaaaaacuaauagccugguagaagaaauuggcauaaaguaggaauauguaaauucacagaaaagaaauacaaauagucaauaaauaugaagagaugcuuaaacucauuaauaaagaaaucuaaauuaaaacaaaugacacaauauuuccccucauaaauuuagccaaauuguagauugaaaaaaaaucuagugauagguaaaguauggagaaacaggcacuuuuuuacccaaugagaguuaaaacugaaaaucaauaaacacguuuugcuacagcagucucaccucggaauaauggccuguacacaaaguccuuauagcauuguuuaugguaggaaaaaaguuaaauaugaccuugaugucaguuaaaauuaugauacauucaguacaauaccauuucagaucuauauguaggaaacucgaaagaguauuuaacaaauauguauuaguugucuucuguaggccagguacucuccuuauguugggaauacagcaaugagcaaaauacauaaaaaccccugccuugauggaucuuauguuccacuggagggaacagacaguaaacacuauggugcucuuuaucuuucagacuuucauaguuggauguaaacuucaugcccucuuuacucuugcccaagcugaggauucugucuuuguuauagugaauaaagaaaaaccagguaugguauaauuaacuuacuauauauggcauugaguggcucuuuacauuuuacaguuccucaaaauuuaacauuuugguuuuaaucugaagccaacaguuuuuagaaugggcauuuaaauugcuuuugucauuauugugcucauuuggagaugguuuguaugaauucugaaauaugcagugagggagggauuauuuuuuaugugguuguaauaguagauugcagaccucaaauuuuaaaucugcuuuacaaagguggauagaauuuugucuuucuacugaacuuaaaucuguuauuaagcaucacuaucauuuaucuaucauugaacacuucucacuuucuuaagucaggguggaaauggcauagaaaauugguugauauuggccaggcgcaguggcucacgccuguaaucccagcacuaugggaggccgaggugggcagaucacaaggucaggagaucuagaccauccuggcuaacacggugaaaccccgucucuacuaaacaaaauacaaaaaauuagccggguaugguggcaggcaccuguagucccagcuacuugggaggcugaggcaggagaauggcgugaauccagaagguggagcuugcagugagcugagauggcgccacugcacuccagccugggugagacucugucuccaaaaaaaaaaaaaaaauugguugauauuaagaaccaauaaugugacuaaguuauuauuaauuacauuuucacugucuuuagaacauugguccauugaaacugcugugcaucagcauuuuaggaauuccuagaauauugucagugauuagaaauaauugucccuuaccauagaguuugauaaaacagaacacugacaugaggacacaucuauagaaauuuucugauccccacauucaggaaugccacuguaugcuaugguguccuccauaaaauacaguuguguucagaaugaagaauaugaagcagcuuuaagaugauaguggggccgggcaugauggcugacaacuguaaucccagugcuuugggaggccagggcaggaggauugcuugaggucaggaguuugagaccagccuaggcaacauauaccauggcccugucucuaaaaagacaaaaagaaagaaaaguaaguuagaugugguggcuacaguccuagcuacucaggaggcugaggugggaggaucacuaaaccaccuccaaaggacauuucaaaaaauguucuggagauggcaacguucuuaaaaauaauuaagucaucuugccagaugacugcuucaaacauagcacucuuuuugauauuuaaguucgguuucguauguugaauacguggauuucugauaacaguucacauguuuacgaaaaauucagguuccuaaucuuccugacaggugguugaucacuagguuugggauguacuuuaggaaucugcauuuuuaauaucgucccaggugauucugcucaucacucguauuugguaacaacuuccuguacucacuccaugauuccucacuuggaaaaguaguugccaauagcugcuagcaaaacuuuuuacccaugauucuaaacacugacuacacauaagaaucacaugaagaacuuaauaagauucugugugcuggggccuaguuuacugaaaaauuucucaguugugucuaauaugcaagacaggauggaaaacgacugaucuaaaguaaagaucuuguguuguaaucuaaauucuucucauaaugagaucuauuauuaaucuucaguacuuggcauauaaugggcacccagcauaagaaaaucuggauagcugcuacauaaaaaugucagucaggcuugaaaagauccccugugcuagcuggcuugcuuacugcaccacuggccucucauacucaaauacaaaaacauauauuauacauauauguguacccuuuuuguguuaucuauguuccacagcccaaaaccagacucucugauagaaaauugaauaaaucauguugcaguuacuucucugguuuaaaaacaaauuagccuuucauuuacguguuauuuuugaugguauuauuucuugacuaugugucauauagucauucaacaccuaauugagcacccaccgugugcuaaauacuguuaugauugcacaaaacaaaacacuucuaagucccaguaguaaacugacuggauuaguuaauaugauacaguaagaugaaagguggucuagagaaaaauaaagcaggggagggaaaugagcaacauaggaggaguaaauacuaaaugagaggaagaagggcugugcagcuguguuggagaagggaggccgguggaagugagccaguggagaauagauuauauuuagcaucguaggcuauuggaaggacuuuugcuuuuacucugaguaaaaagaauacccuuaaggagauauuuuuuaaagggauauaaagagaagaaugugucaguauuacagaaaaggagauuuuacccuaauauuauggcaggcccaucauagcauuucugaaaacucucagaugauuuguugcuuuuagcuacucagcugaccaacauucauauucuuuuuccauuuuaaaacccagcuuaauacuuuggaauguaaaaugcaccaguaagauacaaguugauuuguauuucuuuuguuuuuuuuuuugaaacagagucuugcucugucgcccaggcuggagugcaguggcacagucucggcucacugcaaccuccaccucccggguucacgccauucuccugccucagccucccgaguagcugggacuacaggcgcccaccaccacgccuggcuaauuuuuuguauuuuuuuaguagagacaggguuucaccguguuagccaggauggucucgaucuccugaccuugugauccacccgccucggccucccagauuuguauuucuauauauuuggggcauuuauguacaugaguuauggaauuagacuuccauuuaaaacuugcucauucaaacaaagaguccaccuuuaagguauguuuuguucaagauuagccuagaauuauuaucuugcaucaaauaaauucuagaguacugauuagcaguuucauagggccaggcacagugccucacaccuauaauagcaauuugggaggcaagauggguggaucacuugaggucaggaguucgagaccagccuggccaacaugguggaaccccaucgccacuaaaaauacaaaaauuagccaggcuugaugucacaugccuguagucccagcuacucaggaggcugaggcaagagaauugcuugaaccugggaggcagagguugcagugagccgagaucacgccacugcacuccagccugggcgacagagcaagacuuugccucaaaaaaaaaagaauaaauuccuuacacauguuugcucucucuagagaagcuuuauauuaauauagcuuucuuuggcuagauauauuucagcugguuucagugaaacugccaaaauccucaagccaggaaguagaagccaaggagcuguccuuuguuuuggauuacauaaaccagucacccaagugcauugccuuuggaaacgagguaaauuuuguuuuguucguuuucuguuuuguaccuaaaauuucuuuccugcaaucucucuucugagcauuuuauguuacagugauuuuauauucccuugaauuacuauauuuguauuaguaacuaagaagccucuucauugcuuuagcauguauuuaugguauagauuuuuuuaggacuauccuuauuuuuguguguucuguccuauugccuuuguaaacucucuuagacuaugugucuuuagaaauuauggccucccauauguuaauuaauuaauguuuauaauuaauaugcccauuauagaaaauuuggaaacuacagaaaaauauaaugaggaaauaaaaccuauaaucucaccagugauaauugaagaaucucuuucuaggcuuuuuucuuaacauucauaaaauaacuuuucccgaaaagaauuaagaucagaagucuuuucaucuuuuuuuucacuuaacauugcagcauguguguauacuaacauguuuuucauaaauuauaacugauguuuuuauacugugauuucuucagccauucccuguuaacaguuacuuuacuauuuuaaaaucaaaugcuaugaaaagccuccggacaucacuguagcggcaugcuucuuuagucuuaaguuuuauagcauuauuuuggcauuauucugaaaagaguuaauuucucagaguaaacuucuuuaacaucauuaaugucagcauucuucagcauuguuagucaucaaauaaauacuaauuaaaaccguagcaacauaccacuuuagguccacuagaauagcuaauguugacaggauauagagcaaaguuaaauacauuuaccuagcgauuccauuccuacauaaagagaugaaaacauaaccacaaaaugauguguacaagagugauuauucauaguagcuccaaaauguaaauuaacccaaauauucaucagcaagagaauaaacaaaugugauaugcauacaauggagugccgcucagcaauaaaaaggagcuaaugacacacaugagaacguagauuaaauucaaaaagaugauggaugauguugagccacagaggacaagcagaaaagaguguauauuuuaccauuccaugaaugugaaauucuacaaccggcagagaaauaagcuauggugaucgaaacagauaggugggauggaaacauugaggaaugacuguaaagagggaggagggggcauuucugaggaaggaaauguucuagauccugauuguggcagugguuauauagauguacauguauaucaaacauugcauuuuaguguauauaaguuauuccuaauucuagucauuguacuuuaagcuugagagucuaguuuuaggauuuaggaccuaaguucaucuuuuaauuuucugucauuguuucaauaguaugauuauucuuucuauagccaaaguggaauauaucauauuaauauacucuuaucagcugaacaaaguuacuguuaacuuuugugggggaguguuucuuuuuaaacaguguugggccgggcgcaguggcucacuccuguaaucccagcacuuugggaggccgaggcaggcggaucaccugaggucaggaguacgagaccagccuggccaacauggugaaacccaucucuacuagaaauacaaaaauuagccaggcguggugguaggugccuguaaucccagcuacuugggaggcugaagcaggagaaucacuugaacucgggaggcagaguuugcagugagccgagaucgcaccaucacauuccagccugggggacaagagcgagacuuugucucaaaaaaaaaagaaaaaaaaaagaguguugacuauuuuugugaauguuuaucuucuuuuugaaauacuagggaguauauguugcugcaguacgggaauuuuacuugucuguuuauuuuuucaaaaagaaaacaacaucaagguaagaauuauuuuuuauuagcuuuauuuuauuugcucaagaguucuuuauaauuuuauuucuuccuaauaccuauaguccaaagcuauuccuaguuuuauguugcaagagaguguaagacugugaaguauggagguacaguuuuuaaccauaccguauaguuuuuaagcauacuauuagucaccaaaaccuaggaagcuuuuuccagucaaaagcccuauacacugaauucuagucugcauucuuggagucaaaguuggauguaguuugacaggguuucaccacaugauucucauugucauuuuaugaauguaggaaugaauguaggcuuugacauauguaaguuuuaauuggaucagauuuagucuauuugauccccacugcaccucaauuuaaaacauauuuaaaauagagauaauaucuaccuaacagaguuguacugaugaaugaggugacguauuuagagcagcuagugcuaaguauugaauaguuaacuauuugaaaauaauaacuaccucuucccuuuuacccugccaagauugcuuuuuuuuuuuuuuuuuuugagauggagucuugcucugucgcccaggcuggugcaaugguguguucucggcucacuguaaccuccgccucccggguucaagugauugucccgucucagccuccugaguagcugggacuauaggcgucugccaccaggcuggcaaauuuuuguauuuuuaguagagacgggguuucaccauauuggucaggcuggucuugaauuccugaccucaggugauccacccgccucagccuccgaaagugcugggauuacaggcgugagccacugugcccggccaauugcuuucuuuuuaguauaauauugauccugacuucuucagagccugaagauugacaaguauucagccaaagaauaggaaauaggcuagauauuauaacaaguagauugaucccuuuggauuuguccuuucagaugcauuagccauuugucucagaucuaaugucucagguuugauuaugccucaugcuaagauguagguucaaugagaaauuugaacaagcuuugaccaggccaaaaaaaaaucacuaaaaucuuuacuuaaaugucaguggcuuccauagauaaauuauuaugguagaauauuaguuacaugaaguucauguuguauauugauauauguuuacaaaauagaaugcuugauucuugaucaaaauuuucuuuuuaaaaaaaauccugcaguuauauuuauugaauucugagcucuacaauuuugguugcuauugcugggaacucucuuuuacuuaacuacaucaccacuuaucaagagacuuuaauaauuaagggaauuuguuuuuuuuuucuccuagguuuacuuuaucaucaucaagaaauaagaagcaugcuaaaaacaauuuuacauguguagcaugucacccaacggaagacugcaucgcaucuggucacauggauggcaaaauucgucuuuggucaguuugcucaugaagagcauggcgaucauuuauguacuauuuuacguuaguccuguagaacagggcuaucucugggucccaagaaacagccucccuuuccuuuuuugugugcuuuucauuucauacuuacuguuuuagaauuucuagccuuggacuuauaaagugagugaaacauuuuuuguugccuguaaucauuuuauugaagaaaacuuuuuguuugccuuucuccaaaaaggaaagacugacaauagugaauaucuaggaggguaccacagauggcauauuauuuauagaagucagucacucugguuagaaauagaaaaugugcacauuaagaccagaagccuuuauauuaugauuuaguauguuugguauauauuauguuuauuguauuuggcaugccauuguuuuccuaacuuaaaccuauggucaaaauaagaguuuuaucuuucuccaauaggaggaauuuuuaugaugauaagaaauauacguacacauguuuacauuggcaccaugauaugguuauggauuuggcuuuuucagugacagguaagugcggguuuaauuauuaaaaugaacuuuugaagauaugauucaaguguuuuaauucacuguauuuuuaguuuggaagauuuaaaacugcaugagccaaaugaauuccaaacacuuguguguuaccccuguauuuugggcuuugcucagcacaauaugcuuuagguuuugaagcccuucaaaguucuaaaguguacauuugugauaaaaaucucuguuguuuacauaaauaaccuauuuaaauuauaugacuuuuugaagguauaucugucuacauaacuaagugugugugguccauaacuguagcuuaucaggugcaaguaacuauucuaacacuacauccauuaucugauuuaaucauuggccguaggaaaugaguggcauuauacucauuuuacagauaaaggaaguaggauuuggaguugauaauuaacuugccuaacaugacaugguggguagguggguuuggaccugguucugauuuuagagcucuuguuuuuaacuguuacauggccuuauuugacauuagcuauuuuaaauuaaucuccaucauuguuucauuuaagcugcaugacuucugucacagcuuuguguaguguagcuauagcgaguaaaaauaccuuuaaaguaaaguggucuucaacagaaauacagggaaguacaucuugucuuuguuuacuuuuagcauccucacacccauguggugagaguuaugucaguuuauuugacugguucuuuaagaaaguuacuacauacuagagaagauugugugccuaaaaaaugagaagccaggaaaagugauuuuucuuucugcaggucuuccuggagacugacaggacaagucuuagaugguaccauaugcugugguauccuuagagucuuacuuggguguaaugcccggaagccccaggaaauaggagacaccuucaacccgauuaugguuuggggaguaaugacuaguguauggagacaauguaggcugcucauuuguauucucuacccuccuucccacuccacacccucaaaauacuagugagugcuugguauccauauguaugugucuguauauguuccaggcagggguuuuuuuuuuuuuagacaaggucucacuuuguuacccaagcuggagugcaguggcaccaucuuggcucacugcaaccucgacuuccugggcucaaaugguccucccaccucagcccccuaaguagcugggacuacaggcacgcaccaccacgcccagcuaauuauuuguauuuuuuguagagaugggguuucaccguguugccaggcuggucucaaacuccugaccucaggcgauccccccagccuccaccucccaaagugcugggauuacaggcgugagcuaccgugcccggccauuauuugaauucuugauauuauauuucaaguagcaugaauauuuuuaaaugagaaauaaugguuacaguacauaguugucagugaaauguccuuacugacuguguggguaugaguuauuagaaaaagaaaaaauagcugcguaaauauaaaagaaauacagauuuuaguuguuuuugagaacuucauaacuugaggcauauaugaacuauaugcacaauguaucauauauguguauauaucagauuaaacuucuuaauuuuguuuguguacaucacaacuacauaccuuuagucuucuguuuagcuagauuuuaucagcuugcagcuuuagaaaauuugauaaaaaccccauuauaaaccagugaucuuuaaaaccaguuguuuuagauucaugaaagaaugaaaaaugguuauuugauggaauacuuuugagaaaacagucugaaacaguguccuauuuauccauuuagucauuaagguagucuuuugcaggcuuuuguuaguuuucaaaccauuagauuuaauuggccacauuugacugguggcuaccguguugacaauacagcuguugcuauauuugaggagaauugauguuuuuauaguauugaguauuuuaauuuguaaucauaauaaauacuuuuccacuuuuuaggucuuuauauccaugaguuaggauuuuuuuucugugguucucauauauauuuuucacuagacauuugauggucuuuugauaguauguuuuacucuauauucuaauugacuugcuaguauuuaaaaauaaaauugauuguuauauauuucucuuauaaucagcuaaauuuacuuauuccauaaguuuaucuauaaacuauuuuggcuaugccuugguguagucaugcugucugugaacauggaagugauuauuuccuucuuuccaauccuuaagccuuucugguuucauuucagugcacuagacauccaguuaacguugaaucaaaaugguaauaauauucuuaaucacaaagggaaaguuuucaauaguuuaacuuuuagugugguguuugcuauagauguuauccagguacucuugaugagauucaaagggucccauccauuccugaguuucugagagguauuaucaugaauacguauagaauucugucauuugcuuuuucugcaucuauucaaauaaucaugguguuuuccuuuuguucuguaagugggguuacauuaauuuauuuuucagcuguuaagguaaucucauucuugcaguaaacugcgaugacaugauacccuuuaauauaucauugguauaguauuuugcuuaagaauuuucaucugucgugaaaucggcuuuuuuuuauauauauauaauauuuuugguauaguauuuaaauguuuagaaaaauuuaucagugaagcuaucuuggccuaaaggauauuuguuuguccagcuuuucuaguugucaacagaggaguuggucagcaacaaacuaaucagauaucacuggaaaaaaaauuccugaaccagugaucauuugucuucagaguauauuaaaagauacgaagacacuuuuuguagcuuuaaaugaguuuauuucucuaguacgguagcaaaaacaaaaguguuaauuauauuuuucuuucucuuuuuuccucaaaacaccauccuuuuaauuuccuugaauggauaugaaggcaccagucugcugaguggcggucgugaaucuguacuuguagaguggcgcgaugcaacagagaagaauaaggaguuucucccgcguuuaggagcuacuauugaacauaucucagucucgccugcaggagauuuauucugcacuucucacucugauaauaguaagucuaaauuuuuuauuaugaggaaauauauaaacaccauaaauuagcuagcaucuguagggaacagagaauaaagagaccuaaaacuaagaguagcguaugagauuuaaugagccuucuuuuccuugcauuacuccucucuuuuccaccccucucuaccccuaggcaccaccagaauucaacauuuuugagaauuauuuuuauaaaauggaaggcuaaguguauuugguuauugaugugccacuuacauuuucaaagucuuuuagugugggaugacaugaggaaauaaagggaagguuuggaaguggacauuggugcuuucauaaaccuuccguuuucaaaagaauacugcaagauucucuuuugauacagcuguuaccugggggcaagaguccuguagauuugauagaaauagaggcagucuuauauuucuccaaaacuuuguucauccagugacuacucagccuagacuaggauaucuuuguaaauccacuuccuuuucuuucaaaaaagaacauaacugugagcaguccauuuaguggcaugaaaaaguuaaacuauuuuuauuagauauacucuauagauuuugcauuaacacuuaaaauguguucauaggcacaacugauaaaaacuuaaagacuccaacagaaaagccccuauccccaccccuagauuuuccacuaacucacaaaauguauuccugauuuucuaguaguacucugaguucauugaacuuacuggguuguuuuguauucugguauauuucagaauauaaacucaggugacuccuucaccuugaagcucuaacccagggguguccaaucuuuuggcuucccugagccacauuggaaaaagaauugucuugggccagacauaaaauauacuaacacuaaugauagcugaugagcuaaaaauaauaauaauaauaauguuuucagaaaguuuaugaauuuguguuaggcugcauaaaaagccacccugagccacagguuggacaagcuuucucuaaccuauugauauuuaaauaccuauuuuuuucuacccacagagauaauaauuauucaccgaaaccuugaagcauccgcaguaauucaaggccuagugaaagguauugcagaacucaguggauuuggaaucaugaacauuuuaaagagugcauauuucucuuauuucaccuguuauuugucaccacuucugcagauaggaguaucuucacugguuugaugauugauccaagaacuaaagcuuugguuuugaauggaaaaccuggccaccugcaguuuuauucucuccagagugauaaacaguuauacaauguaagauuuugaucauuagccuugaaauuaaugaaagcucuuuacaguaccacuggagucaagcaauuuguuuaguagcuuuuaaaacaagauccugugcauauguuuacuugaacauaguauuauccgugguuacuuaguucaguuguucagagcauaauuccauugaggccacaguugcagguuacauguaagccaguuggcacuccuguacgugcugucucugucuuuuguuucagaaugcccuccuauuagcuaucccauacaucugugcuuuugagucacaaggauaaagaaacaaaaauagguagauugacaguacaaauuuguaucugcuucguggugaaacacuaucauauucacauauugaagauaaaauuuucaguguagauuaaagaggaacacuucuuccaauccugauaaguccaauccagaugucccacuuuucuuguuccccacaguacucuuuacagaucucugucauagcaacugugacacuagcucuuucucaccguggccuuuagaccccucaaaaaaaaggaagcauauuaaucauuuuaugcuuaucucaaguauaaugccuguaaauuguaggcauuuaguacacuuaauaguaggcauuuuauuuacuuaguauaggcaaggaaaugggauuuuuuuuaaaacaaccauaaauaaaugcuggccuacuuacauuggcuaucuuuuuucauuucuuaaagauuguagguuuauuucuguucugcuuguuucuguugacagagaaucuagccuugagaugauguaaagcuguuuguucuuagaaacaaaagaaaagcacuacuauaaauuaacgguucuguuguaucauauaguggguguuaguaaucgcuaauauucaaggucauugaagaauaauuaccaccaaauugauacuauuauaauguguucccuuuuuuaauggcaauuuugguguccauaguaacaauuaguucauuuuugccuuuauuuaaaaaucuauuacuauacaguacagaaguugucuuggauguaguuaauuaucauuucuugaaugcuguaacauuuguguauuuauguuaauaaacauuuugguuuuuugguuuuuuuuacucaucaguuagauauuauacagcaagaauauauuaaugauuauggucugauccaaauugaacuaacaaaggcugcauuuggcugcuuugguaacuggcuugcaacaguggaacagcggcaagaaaaggaaacugagcuugaauugcaaaugaaacuguggauguauaauaagaaaacacaaggguaauacuaucuguguagccacuuaauuucaaaguauaaaauauuucacuucccauuuuacaguuucaauugucuuuaagauguuucaucuugacaagguuuagauuuagagauaugggagagguuuuauucuaauaaaaccuuuaagcuuucugcucugagaagacauugauguccucuaagucauaaugucaucucauaaugaauaaagaaacauggaaaagugacaccuccucaagggcauaauaccgaauucuaggcaaauccaggguuagaauccaaauguucccuugcucuuccguuaacagcauacugccuuuugaaaagagggaguguagguagaaguguagcauaguauaauguagcauggauguugugauuagauaaggaauccacucucguacuguggcuauaauaaccacuuaacagaucuuugcugugugccaagaacuuggcuuagagcuuuguacccauuaucuuacucuucaaaagaacacuguaagauaagccuguugucuauauuuuauaggugaagaaacaggcccagagagauuaagugguugucccuagucacuguuguuauaacuugugcuuuuuuaaaaucacaauccuaugcugccuugauguucuuuuaagaacacaguccuaguugucuuucauucacagcguugcccucuaagcucgaaauaagcuuuaagaagucauuuaggugacuaaaaauaguaaauaaugaccagccaguuugacuaaguaguuuccugucuauuuuuccuugccccagguggggcguuucacggccuuuccauuuuuuauuuucaaaaguaggcaggaaucuggguucuauacaaguuuccuacagaguuugauacaguaggcuuuugaguaucauugauuggugaccuguauuauccucauuuuguaccaauguacuaguggguugacuacuacacagaauguucucuaaagucacacaagggcaaaggugauauauuagaacucuuugcguccuguggccauuagagguagagcacucaauuguuugucauucuacgugauuaucaguugccuguuguucaagaugcuauuguaaaauguacagcaugucagaaauucuuauauacaucacuuuguccucaugcaagaauaaauuugugguuuccuucccgcuagguuuauucuuaacacuaaaauuaacaugccacacgaagacugcauuacagcucucuguuucuguaaugcagaaaaaucugaacagcccaccuugguuacagcuagcaaagaugguuacuucaaaguauggauauuaacagaugacucugacauauacaguaaguuauuaaauauguuauguuuaaagugugcacaauuuuaggaauuaauuucuuuuucucaugacuuguauccauccugggaggacauuuucuacuuuauugaauucuacaggauauugcuuaaucuuaauagauuuaagagauuacauuuuacaugccuuuuuccucaaaucuguucuuuuuaaauggcauucuugauuaaucaugugcugauuauucuguuuuuuuaggguaaaguaaaaggggcuuuuaccaagaguccuuucacuccuccacuagagggaggucaaggucuccaggagagggcauaaauuucagaacagucaguauuuuguagcaguucugacuuaaagaaguuguggggaacagguuuucuuguuuugugucuuuguuucuuuuuuauuuuauuuguuauuugugugugcaucuuuguuucuuaaucccuacugcuuauaaugucccucauuuagcagucucccuuuaacagugggggauacaauccaagacccccccgccccaguugaugccugaaacugcagauaguaccgaacccuguauauacuguuuuuuuccuauacauacauaccugagauaaaguuuaauuuauaaauuaggcacaguaagagguuaauaacuaauaauagaaugauuacaauaauauacuguaauaaaaagugaauaugugcaugcucugugucugccuuucucucucuuucaaaauaucuuuuuguacuguacacagcuauuuucagaccucaguugaccccuaggaacugaaaccacagaaagugaacccucagauaaugggaaacuagggggaacuacuguagcauucucuagcauuuacacaauuucugaacauuauggcuuauauuuccacagaaaaagcuguuggcuggaccugugacuuuguugguaguuaucacaaguaucaagcaacuaacuguuguuucuccgaagaugguucuuuacuagcaguuaguuuugaggaaauagucacaauaugggauucuguaacaugggaacuuaaauguacauuuugccaacgagcugggaaaauaagguagguaaaucuucgggaaguauguaguacuauuuuuuaacuuauuuaaacaagucuuaaaacuuuaguagucauuuaugcccucuccaaaaguagccugaaggucaguggggcaagcagcuaaucaaaaugcuggaaagccaaaaauucugaguccacaaacugugccaacauuucugaaauucagguuaacauuuaacucuuggccuacauauuuuuucuuuggaauacuuucauggaugugcugaaugguaacagaagcuauacauaagccucaggggauccaaaccuucuuauuuucuguguauucccauaaaaaccguguuaugcgccaaccucauuguuuccgagaggugcaggggaaaguagcagcagcauuuucagguccugcuucagguaguugggccugaggacagaaucagaugccuaaugagaucgucucuaauucccagcaugucugauucugaauuuacuuuguaaaacuuucuucacaauugaaaucgcaaguuuucuucuucuugguaaauaggauuuuugucagaugacuguacguuucauguacauuuucucuguuagauguaaauugguauaccgcacaguguguuaaagaauuggucauccguucuguuuuccuaaagaaauagcuaacuagacccuuccuuuuguacuccuuagacacuuuuuucuucaggauaauuauaaacaaaaauauauaugucuauauaaaaaucugcauuacauagaacagccgcuggaagccugcaguucuuuguaacugaauuugcuagaacugacuguugcuaacuuccuugugguuuuaaucuaggcaccuuugcuuugggagauugacguguucaaaguaucuacuuggugcuacugaaaauggcauucuuugcuguuggaaucugcugagcugugcauguaagauauuuuuuacucuaaagugaucuggcaaagcgcauaaggaguugacauuaaacuuuggcauuuuaggacuuagggaucauaucaucaggucuguacuuggaauagucaguuuuuuacgugacauaugaugccaccaaaauuuggaauacugggccuguaauagacauuauuuauuaacugcuuaauuguugguacgucagcuuccauuauccuuaccuuuuucuacuguuuucagugugugugacuuucugaugcccuccauauuccccauccucguaacaauuugaauaauguuuucugcucauuuuuaauacuuacuaaucuacauuaucccugacagcuuaaauucaaauguagucuaucacaguccuaacaaaugugaacuuaguggcauuuuacccauuugaguguauguuuggaaggcauaguagcugcuuauaaaugaauguguaugguaacuuuuuucaguauucuuuacaguuaacucugguuaacauacuguacacauuuagcagcaucagaaaagcacuagacauaaauuucaaugaaauaauaaucuuuucauaguuuguacaaggagcacuacaguuccaguauguuuuucuuucggccucucacuuuagugcagcauucuacaaaucauuucagugugucuccauguguguuaguuggaagcauaagauuccucuuccuaagaauaagagaaguuuuuuaaagcuuuugguaaaucuuuccuuagaagugaaucaccuuuguuuuuccccucaguggaguggaaugcaaaauuaaauguuagaguuauggaacccgauccuaauucagagaauauugcugcaaucucucagucuucaguggguucagacuguaaguacaaaccacacuuuguaguaagagaacaucuaugaccuaaguuuucuucuuaauauaauuugagccaaacuugccuucacaucagauguuaauuggaagccauuuugcuugaggcacggcccuucuuugccccaacacuuugucauugugugcguccauacuuaguucuaggagagcuccaauauguuucuuauuuuuccacaagccaauucguacucaaucuuuaaaauucaagagauuucaccaguuugacauauuuccaacugccccugagaagcuuuaauuggucauccucuauguucuugaagcaguuucuacauaucucauuucuaguacuuacagacaaaauacuacuguaauaauauuuugguuucugucuucugcagugggcccuggccucuggagcacgaauucuucuuucuguuuuucauccucauagcccucauuccuaaccugccuggcccauaguaggaacacaguagauaccucuugaaucaaagccuaaaacagucaugacuugggccaguuacucaauggggugagucccaggauuagugugaucugccagucugaggcuagaacuaaccuuuucaggcaaaauguuauuguuucuuuguuuuuucccucuaguguuuguauuuaaaccuagugagccaaggccauuguauauucaaaaggguaucuccagagagaaaguccaguggggaguguuuguuccacgagaugucccugaauccuucaccucagaagcuuaccaguggcuaaauagaucccaguuuuacuuccuaacaaaaucacagguaacugccucccucaaaaaaggcgaucacuuuguacauggaauuuuagacuaauagcccaugacuauuggugugaguuuguuucuaggugaaacagcuucauuaaaggauuauuucccaaaaaauugucuaauaugcucaguacagcagcauuauuaauguaaauguauuaccguuuuaccccacacuuuugagguuccuuagguauugcuuguauuaacucugugacagcaaaaaagcagaagacaacuaaaauacuuuaaauugcaugauucuuuuuucuuuuucuuuuuuuuuucaguguuugauuugcaauuuuuaaaaugguggcuugaguuuugucugucaguuauauuuuuuauucauuaccauuucuuaaguaucucucagacauaaucuuguaacucucaucgugguuauuaaauagguuuaaaucuuuuauuccuuuucuguugucaaauauauauaucaaagugaaaaauuugaccuucucauuuuuuaacacccuguaacaccuuguuuagauuugcacucuacaguuugucuuuugcaucauuaauucucucuuuucagaguuuauugacauucaguacaaagucuccagaagaaaaacucacaccaacaagcaaacagguauguuuuagccauucauagcaggauguauugccucccuaaaaggauacaauuaccuuuuagaagucaacuaugaaaaaaauauuucacuuggcccuaaaauagaauuaaaagccauauacuuauaaacugauaugugucucuugaaaguuuuagugcucuuuuaaaauuauuuuaauuuauaauaucaguaauauauaauucugauuuaaagagucaaauauuuuuacaaggcucuucagaaaaaacuucuccaacaccacuaccauuacccacaaagacaaucacucucaaaucuuuuagcugaaguuuuuauuuaacucugaaucucuaagaaaucucuaagaaauguuuauauuucuaauuauagguuuuucagauuuagguauuaucuguuaacucugaucuauugacgcugaauuuuuagcuguuuuucacaucagcacucccugcauauacacaacacacacuuucccuacuugucccccaauuuuccccauauggguaaauguuaaauugguuaguucaguagucauugucauagcuguguuaacacaauucauagccaagccauguaguaauaggcagauuguuuuuccuuuugugaccaaguuuuuauuuucuguggaguuaaugauugccuuguuuuuucauuugcuuaguuuucuauucucauguaauucaaccccaaauucugcucaaguuguguaaguauucucucaguguuuucagauacauuagguauucuuucaagucauaaaggauuauuuccaagagccuucugacugucuucagucuggacugauugcucuggaaaccugcuacacaguagucauccuaggaucuauauucaccaucauucuggggauuuguuugaccucuacucuauuaguggugugguuuuucucuuucuuuggucacuccccuguuuuggugaagcauucuuuuagugcauuggaggucaauuuaagaccuugcauguuuggaaauguuuuuauucucuuucacuugauuauuauagaguuguagguugaaaaucauucucgcagaacuuugacauuauuguccuauuauuuuauaauuuccauuauuacuagaagaccaauaccauucuuguucuuguuccuuugucuguaacuuggcuuguuuauuuuccuuuaaaacucauuggauuaauucaauaauuuuuuguuaauuauuuacuguacgccagggaccauuguagacaguugggauacaguagugagaaaaguagucaagucucuaaacuugcgguauucacaguccaccagaagauagagacaguaaacaacaugcauuaaguaaaauauggaguagagaaggugguaagaauuguggugggguagagaauagacgaaaagauggcaugcaugggaugcagcuuguaauuuuaaacagggaagucuacguaggccuuauugaaaagauucugacuuuuucucugaguuacauauagggccccuuggagaguuuugaguagagaacuaaggaggagcuaauuacuucuuucucuauucuuuuucuagaacuccuauuauuuagugcuggacuuucuagaaugguucucuauuauucuuauuguuuugccuauuuuuuguuuguuuucuggaagauuuccucaucuuuaucaucaaaucuuuuuuucuuuuucauggucuguuuccauuacauuuuuuuuuguuuuugguuugucuugguugcugccuuucaucuagagguuuucaucagagucugaugauucuuggcugucuuuggauuuaaaaguggguuaaaaagccacuuggaaguucucugccugugcagaacuuaucccuuggcuuccacuaucugagcuaauuuauugagacagucucaaaugucauuacaauugacccuugaacaauguagagauugaaaaccuauguauaacuuuugacuucccaaaacuuaaccugaagccuuacugauaacaguuauuuguauuauauguauuauauacuguauucuuacaauaaaguaugcuagaggaaaaaaaaaaguuaagaaauaucauaaggaggccgggcacggugguucuugccuguaaucccacauuuuggaaggccaaggcagguagaucacuugaggucaggaguucgagaccagccuggccaacauggcaaaaccccaucucuacuaaaaauacaaaaauuagccaagcaugguggugcaugccuguaaucccaccuacucgggggcugaggcaggagaaucacuggaaccugggagauggcgguugcagugagccuaggucacaccacugcacuccagccugggugacagaacaagacuccaucucaaaaaaaaaaauuauaagaaagagaaaaauauauuuauucauuaaguggaaauagaucaucacaaaggucuucauccucaucuucacauagaguaggcuaaggaagagaaggaguugaucuugccaucucaggucuggcagaaauagaagaaacuccacauagacguguuauucgaacccuuguuauuccaagguuagcuguaucuuuaggucuuacuuaggcuggucaaauuaaccauaaaaaauucuaugcguuccugccuaaaggauuuagaccuaccugucaguguucugagaacccccuacaugaaguacaacugccuagauaugaagauaccaccaccaccaccaccgcuauccauaccuagccuaaagauguagagcccucugcuggggcugaggaggagcuguggggugcuuucuaaguagacuuuccaccagcccgucugguuugucuagucccauuuucaccccacauccagaguuacuauuauuaccaacuccugagcauuugcaggauucuguaguaugaauugggaugcuucuuggcuuucccuacagccagcuuagaauugugcuuucucaggucuacuaaguucaauaccauccuucagccugcucuccaguuuccaacauguuacuguuaaggccuuuucccucauuuucuaucauugugaguaugugcccuuugaaaacccuuuugcugucauuuuugugggauuuggugaagaagcagugguaaaugcauguauuauucugucaucuaaguguucacuguuagcucuucucauaagugggaugcuaggccucaguugcuuucucugugaaaugagaggaucauacuaacuggauaauuuguaaaauuccuuucaucccagacuuuuuaugauucuguaguacuuacuguuaagucaaacacaguucuuccuuuuuucugaaauaauuucucuuugucuuaaauccuuaaagcugcuagcagaagaaagucuucccacaaccccauuuuauuucauauugggaaaacacaggcaacagcaggaugaaaaacuaaacgaaacuuuagagaaugagcugguacaacuacccuuaacagaaaacauacccgcaauuagugagguaaguaauuaugaaaaccaugugaaacagauuaaaugcacuuaaagcaccugaaguuggaguuuugacacagucaaucuguaauuuguaugcuguacaacuuuaauacccaaacuaaauaacuaacaacaaaccgaguaacuuaaccuugugaucugggauuguuuuguccuggaccugguguagggauaggggugguuguuggcauaaauguaggaagguagaaauguauuuuucuuugguuuggcuuuuguauagggaaagccuuuucauguuucacucuuggcauuuacaauaaaagggacuccgugaggacacuguaggaacagacugcgguggaggauaagcuuuuuaauugcaaccguguuuucuguuugacuccagcuucuucacacuccagcccauguccugccaucugcugcuuuccugugcuccauguuuguaaauucauugcugcugucuaaagagacuaagagguaaagcaguucuuaagacagguuuggacacucucuuuugggaaacaggaucguuuguguuuauccuuuuuuagaguauucuuccacuguauuucuuuuuauuucauaaguuuuaaaauagauuuaaaggcuauaggauuauuaagucaaguaacauacauugaaaauaaguuucaaaaaagaucuuguauguguguguuuuaagggcuugguacauaauuuaaaauuacauguuuguaaauucaccugcucuuuuauaaauaacccauaauuuuuaaaguguacuuaguaacaaaauucuucauuuacuuugugugauuauauuucuacauaggugucaaauuagaaaguuacuguuuagaaacauuuaauaguguuuauauuuuauucuguuauuguuaaagugcuaaggaaauuccugaagauguagauauggaagaagaaaaagaaagugaagauucagaugaagaaaaugauuuuaccgaaaaaguccaggauacaaguaacacagguuuaggagaagacauuauacaucaguugucaaaaucugaagaaaaagaacugagaaaauuuaggaaaauagacuacagcuggauagcugcccuuuaagccuuggagauggggaggauccuuggacuuuguguuuuugauuguauguugauauucuaaaaacaucuauuuuaauguuauuucuguucuaaaaauaagauaauaaa

SEQ ID NO: 12703 - RNA, 1978 nt, Homo sapiens
gagggcccagagagcaaguuuauuuggugaaugcugacggcaaacaucauccaagagagacaagaugggaaaguugcugagacaagaaagccuagggaaacuuuaggcuagauacaaaauucacacagggaaaggcacggacucuggggagacugggaagguccucagccauucagcaccaugcggacgagcucuguggaaaggaaaggugggaugagccagggaacagggcuguggagggguacgccaagggccaggggacuaccagacugcaaagguagcauaagcgggaacaugcccacagcaaccaacccuggggucaguuugcagaggagccaccuugagucugaccaguucuccaugccccuagcuccccucccagcagcuguuagucccccacccaaaccuaagcagcaagaacacagcagaggcagaaaaguucuccacuacaccuacagcuacugucagccacuggcgggaggagaggacagaguuuuggguuaggguaccuccaagcugcccagcgagggaaggggaaaggacuguucagcuauagcagcagaauggggcaggcaacccauaccccucuaugccagcuacccaugcuccagggccagaaggucacccuaaagcaagacugguauacaggcuggugagaguucccagacaccagcacccagggccgcauaaguaaaaccucagggcccauucuagagguaaggagguacuguacccccagguugucuuccucuuugaggaaucccuccccucccuagucagcuccaugcagaaacaugccaggaggaagucagaugguaguaggguaagggcaggggauaaagagcacagguuggggaaaaaagaaacacuggggagaucaacuagaggagaggcugggaggagccguacccgccccaugggcccgucaccccgacaggauaugccucacaaacgcugcaggaaggaagagacauucauggugaagacaagacaaagacauggggugaggggucaggcaguggggacagacauuccauuauuucacuucucauuccuucccacccucuacaauacuacccccuuccuuuccuguuauaccgcccugaccucccacuccugggcugggcugggcagggcccugcaccuugccuccuggcucuuuuuggagcccaaguccagggauagggaaagccccagacacuauacuugaccugccccauauggcugcuuucucugagaaagcgcaguucaccucuuaccuucauaguugauacaaccauugcuguccucaugcccugccaccagcaucucuacuucuuccucugucaucuucucaccugcagggggaaagaaagcauuuuuggaauugggugacaagugagguaccucagggugccaucucagcucaaggacaaggacacagaaccuuacccagugugacaagaacaugccggauuucagcacccaugacggugccauuuccuuccuugucaaacacccgaaguccuucgacauaauccucauaggugcccugguccuuguucuuggccacugucugcagcaugggcagaaagugcucaaaguccagcaccuucacauucaucucugccauaaaggagguggaagugucaggccagagaaguaacacaaguucucaggacaggggauuauagagaccucaacugaacagagagaugacagaugacuccccacuaaaagcaaggaaauccaugggauuugcuaauccagacuugcuugaguuuggggccuaugaagauaaagggaagcucuuagcugaagaacugugggcccaugaccacacugaggaguuguucuuuaggccccucaccaucacucuugggguuccccaggaccuugagcaccucggcguugguaggguucuggcccagggcccucaucacauccccacacuggcuguacaggaucuugccaucaccuguucggucaaacagcugga

SEQ ID NO: 12704 - RNA, 1978 nt, Homo sapiens
uccagcuguuugaccgaacaggugauggcaagauccuguacagccaguguggggaugugaugagggcccugggccagaacccuaccaacgccgaggugcucaagguccuggggaaccccaagagugauggugaggggccuaaagaacaacuccucaguguggucaugggcccacaguucuucagcuaagagcuucccuuuaucuucauaggccccaaacucaagcaagucuggauuagcaaaucccauggauuuccuugcuuuuaguggggagucaucugucaucucucuguucaguugaggucucuauaauccccuguccugagaacuuguguuacuucucuggccugacacuuccaccuccuuuauggcagagaugaaugugaaggugcuggacuuugagcacuuucugcccaugcugcagacaguggccaagaacaaggaccagggcaccuaugaggauuaugucgaaggacuucggguguuugacaaggaaggaaauggcaccgucaugggugcugaaauccggcauguucuugucacacuggguaagguucuguguccuuguccuugagcugagauggcacccugagguaccucacuugucacccaauuccaaaaaugcuuucuuucccccugcaggugagaagaugacagaggaagaaguagagaugcugguggcagggcaugaggacagcaaugguuguaucaacuaugaagguaagaggugaacugcgcuuucucagagaaagcagccauauggggcaggucaaguauagugucuggggcuuucccuaucccuggacuugggcuccaaaaagagccaggaggcaaggugcagggcccugcccagcccagcccaggagugggaggucagggcgguauaacaggaaaggaaggggguaguauuguagagggugggaaggaaugagaagugaaauaauggaaugucuguccccacugccugaccccucaccccaugucuuugucuugucuucaccaugaaugucucuuccuuccugcagcguuugugaggcauauccugucggggugacgggcccauggggcggguacggcuccucccagccucuccucuaguugaucuccccaguguuucuuuuuuccccaaccugugcucuuuauccccugcccuuacccuacuaccaucugacuuccuccuggcauguuucugcauggagcugacuagggaggggagggauuccucaaagaggaagacaaccuggggguacaguaccuccuuaccucuagaaugggcccugagguuuuacuuaugcggcccugggugcuggugucugggaacucucaccagccuguauaccagucuugcuuuagggugaccuucuggcccuggagcauggguagcuggcauagagggguauggguugccugccccauucugcugcuauagcugaacaguccuuuccccuucccucgcugggcagcuuggagguacccuaacccaaaacucuguccucuccucccgccaguggcugacaguagcuguagguguaguggagaacuuuucugccucugcuguguucuugcugcuuagguuugggugggggacuaacagcugcugggaggggagcuaggggcauggagaacuggucagacucaagguggcuccucugcaaacugaccccaggguugguugcugugggcauguucccgcuuaugcuaccuuugcagucugguaguccccuggcccuuggcguaccccuccacagcccuguucccuggcucaucccaccuuuccuuuccacagagcucguccgcauggugcugaauggcugaggaccuucccagucuccccagaguccgugccuuucccugugugaauuuuguaucuagccuaaaguuucccuaggcuuucuugucucagcaacuuucccaucuugucucucuuggaugauguuugccgucagcauucaccaaauaaacuugcucucugggcccuc

SEQ ID NO: 12705 - RNA, 742 nt, Homo sapiens
uggacccagacuccucacaguaaugaggcgagagggguggucaugcggccagccaggaccuagauggggacagaacacacacaaccacaagaccacccacgacuauaggacuuuacaauaaaagcaccggucagugccauuauucacauuguaaggauaaaacaucacaggccaaaaaggcgccgucaggaaugugacacccgcgaggcugcgggauuugaaacuccaaugcuuuaugaccuaugucaaugccuccccucccgucuucugcuuccuuggaaagcuaacagggcaggccguuaggugcccacaacgccgggaucaugcgccgauucuggaagcggggaaucggagcagugguacaggaaacaguuuccccagcagcuauagcagauaaggaacagggcugccaggaaaaccaaggcacaaauugugcaaggcuuccguuccaggaggaagcugagcagguagaagcccaugaacauggaguggcugaaccacagggcgggguugaggggcuuggggaugaggaggacgggcagcagccacuggaggcaauacaugaucucugccgggcagggccuucaccaaggcugccgggcaccgcugcaggaaccgaccuaaugggagccagcgggcgcaggcggcugcccuccgcuuucuucaacccucacucuccaggagcugagccgcugugcucucuggcugucagcccgggaucaccaaggcagcagggauccug

SEQ ID NO: 12706 - RNA, 742 nt, Homo sapiens
caggaucccugcugccuuggugaucccgggcugacagccagagagcacagcggcucagcuccuggagagugaggguugaagaaagcggagggcagccgccugcgcccgcuggcucccauuaggucgguuccugcagcggugcccggcagccuuggugaaggcccugcccggcagagaucauguauugccuccaguggcugcugcccguccuccucauccccaagccccucaaccccgcccugugguucagccacuccauguucaugggcuucuaccugcucagcuuccuccuggaacggaagccuugcacaauuugugccuugguuuuccuggcagcccuguuccuuaucugcuauagcugcuggggaaacuguuuccuguaccacugcuccgauuccccgcuuccagaaucggcgcaugaucccggcguugugggcaccuaacggccugcccuguuagcuuuccaaggaagcagaagacgggaggggaggcauugacauaggucauaaagcauuggaguuucaaaucccgcagccucgcgggugucacauuccugacggcgccuuuuuggccugugauguuuuauccuuacaaugugaauaauggcacugaccggugcuuuuauuguaaaguccuauagucguggguggucuugugguuguguguguucuguccccaucuagguccuggcuggccgcaugaccaccccucucgccucauuacugugaggagucugggucca

SEQ ID NO: 12707 - RNA, 14952 nt, Homo sapiens
gagaugacuuuggcacauaugaaauuucccuucagauaagaauguuuuuuaaaguauugaaagaaugauggcugcuggggccauggaaaaagagauugacuggggaaggcacauuacagaggcuucuagaaugacagcaauguucuguaucuugauagagguugcgauaaagccuagguauuuguuaaaacucaacuaaugcacaacuaagauuuccacauuucuuuguaaauuuuacaaaaaaaaaaaauccugaaaaauacugaacuguaaugaauaggcauguugcaacguuuagggaaaauuguacgaugucugcaauugacuaaaaauauauuaaaaaugcauuaauggcuggcugggcacggugacucaugccuguaauccuagcacuuugggaggcugaggccagaggaucacuugagcccaggaguucaaggccagccuggggcaacaugaugaaaccccuucuuuaccaaaaauacaaaaauuaaccgggcaugguggcuccccucuguagucccagcuauucaggagccugaggugggagaaucgccucaaucuuggaggcagagguugcagugagcugagauugcaccauugcaauccagccugaguaaaagaaacucugucucaaaaaaauaauaauuaaaaauguauuaauaggaugcacagauaugugauaguggcaaaaucuagguggugaguauaaauucuuucaacaugccuauauguuuaaaauuuuuaauaaaauguugggaaguuauccaauacuauaguuaucagaagccaauaaauuacuccgcaacucugggugcacagcaauuccaagggcugucaccgggaacagagaauuccuuccaaugugcccucugccuggcccuaagcaagccacuaaccuccuuucugacacaaaccuggacccacaaguucucuguacuuucaucaucuuguccugcugggcagaggugaauggaaaaacaccaguguacucagcuagugggcagaucuuuguaaugaagacccaacccuacaugcugucacgguaaaccgucagcauaagugcuugucugugcccagacaagacaggaaaaacuugguuugacuguuuaaaaaagaacauaauuguaauaauucacauaaauugcuuaauauuucagauuuuaaauuauagaagauuguuuucuaauaauggcauggagaaaugaacaguauuuuaacuuauuuccaaugcugauggagaaagggcuuaacauuuguugacccuuagauauggagcagauguuuugcauacauuagcucacauaguccuccuaacacuaugaguacauagccccacuaucauuuuauaacgagguucaugguccuggagccaguaaauagauccaggacucaaaccaagaucuccucagcccaaaaccauguucuucuucauggaagcacauucuggcauuuaaaauagguuauguucugcaaagcucacauaauuacaacagcagcagucauuuggccaggauuuuaccaaauaccauuggguaaaggaaugaaauuucuaagggcagugucguguucuacuucaauuguuuuuaccaaaccaccacucaccaaaaggcauuuuuaacaguuuacacuucucaccaacaauauugacaaaugugaugagaauacaaaacuuggcaaccuuucccauauuuucuauagcuuuaggggcaguucaggguuucaucuacuuaacugaaauuuaaugucaguguugauuguucauaaacuaaacaaauggcccaacugccccuuaaggauuuuccauaucauacuuaacaccacuaucaggcaaaaaucgcuauucauuggaacagaaccauuucccccacguguuaaacuaagccagauuucuaaacagacagaaacuaugcagcaaugacccaguagauggcacuaguugugcugacuaccuuucuauucaaguaguccagcaacuuaggucagaaguuuguuuccuacgagggcuauaaacauuuaauacugaacauuagaaacacauggcaaucaaaucaugauuuccauguuacuugcagaaaauacucauuguaguugccucucuguacagaacugagaucuuuacguggaagaugaagggugguuucucuaaguauuuucaaaaguauuuaucaagucuccaacucaacuacuuuucaauuuggccagccuucuuuuaguaaaguagggaauugagggacaggaggaaggcagaagaugcugguaacauuaauuugcugagaugagcaacaauaaacucuaaauuuucaaaaacguaggaaaaaaagcauuuuacuuuuaucuagauaggcucaaggaaagucaugugaccucccaauuaauaucugauccucgaauugauauauaauuuaaaucauuuuauuugagccuaauucaaaauuugcaauacccucauccagaggccauacugaaccucuuauucugcucugcgcuauaugcuuuacccaacaauucugcccucuggagggacauucuuuuaagcacaauuuuuuguuuuacaauccaacacgucagcauauauuagccucacaaagguaaaagaaacugaggggaaaaaaaaaaaauauauauauauauauauauauaauuucaauacaagggaagaucucaagggcaggaggcagacaaccucaggguuucaaaugcagaucucccaaauguacacugauguuauucuaguaaugcagaggugcaaccuguacuuuuaacaaguuccugggaagccucauguagaugguuucuaaaucacuaagaauuuuacucaauaugcauuuaauauacaaaccaagaaacuagacuuacccaaugcugaaaagcauaaauuuugauggaguaagagacauaacuucaauuucugauuggaaauaacagguuuuuuuaaacaucacuagcccuucaacagagguugagacauauugugggggucugaucaguagugugucaauaaacucucaagagaccugugcucuuuuauaggucaacaaugaucauccaagcccacacguucucaaagccuggggagccacaauaaaauuguggguugucaaccaagacccuccaaaagacuuaaacgaaaugucuacuagucaaacuucuuaaaauguucguugucuucacaucacgcugguucucucacaguaguaaaaagcucuuaguaacaucuuuggguccaauguuaacauggaaaaaaguuugucauaaaccagacuugauuuccucuuuucuuacucugugaucuauacuuugagaaacaucaauagaucauuuuaguucagaaaccuggaguaauuugguuacaauauuugaauuccaaacucaggcagucuccaguaaagcacacugaaacauuuggauguaauuuaaauacacuugaaaaguaaaauguuuuucuagcuuuucccucagggcguaacaccacaccauucauaacaaugcuauuuuccaaaggucucaauuagauuuccucagaagcauaccugaacuguuaaucauuacaacuccuuugugaaacaugggacugguugauuacccaguguaaucacuggcugaaaccucagcacacuguuuuucaccccaguggaggcagguuuucaccuccccucuagcuguaccccucucuuaaugcccauauuagagaacugugaucuucuuucuccacuagaaauguucacuuucaucagguaagggauaaaacaaaaacaagagacagaagaucuuaaaaaaaaaaaauaguaauagggcaaguaaacucagugagguuagaggaauuuguuuggggggcauucuauguuguuaguuucauaucauguucaguuuguuguuucuagaacccucugaaaugcauuagaagaccuuaagagucauucucagccuaaaauggcuuggaacaaacagccaguaucucaaugacaccagaaaaagucauuucaguaacuaaacugaaauguuagaguuauaugucuucagacugauguaaaacuuuuaccuucugagaaaaccuuuuagggucauuuaccuacuuuccuauaguuaagaaguucucguaucauaaauuguaacuuuaaucuuuuacuaaccucacaucuauuuguuuuuagcaucauucccuuggcauuacucaacccagcaaauuaaacauucauuuaaaauguuaaaugauaaaaauacaaaugacuaacaguaauacccauauucagguuauccuaaguuaaacugucaucaaaguuaaaauuacaaaggcuauagggacaaaguauaaagcguuggaaaaagugaguguuuaaaugccuaugggaaaacauacuguagccuuccccacuaaauaucauuaucauuaucuagcuuuacgauuucaucuuucaguuuuuguauuacagcagcuucuccuagaaccugcccaaacaagaaggggcaagcugaucugaugagacuuugauccacuccagaacuguuuuguagaaaugauaugggggacccaauucuggugggggauauuuuuauacuaagugguuuuuguuuucaguagguguuguuuaaacuuauuucaaaguugauagcugagagcacuaggaaggaggaaggcagaaaacuuucuuccucuuaaguucuugaugaauguguuccaguaggcugguaaggcaaauauucauuauggauuguaacucacuuuucuuugauuuuggaggcuucccuuaagaaaaaagaaauuuguuaauaaaugauaaaaacacagaacaagguuacauuauugaagcaagugucaaucacaaaaguaaaagcuuaagucuuucuccauuuaaucucaacauguuaagcagggguccccaaccccuagaucaguaucaauucuggccugcuaggaacaggaacgcccagcaggugaguggcgggcgagggagacuuacugccugagcuccaccuccugucagaugagugguggcauuagauucucauaggagcaugaacccuauugugaaaugaguaugcaagggauugagguugcacgcuccuuaugagaaucuaacuaaugacugaugaccugagguggaacaguuucaucccaaaaccaucccccgaucccacggaaaaacugucuuccaggagacuggucucuggugccaaaaagguuggggaccacuguguuaaaggguaacaauacuuucauacugaauucugcauuuuuuuccuacuguugggguauaagacgacauuauuaugugucagaagucauuauaauuacuuacauggaaaucuuaaacaagucuagaaaggauacuguuacuuacuuguuuucauacuuguggaaccuaaggcuuaaagacauuucaaguguaauaacucauccaacaucacaggugaggagacaaugaggccaggauuggaagcccagcauuccauaccugacagcauuuaaauuuucuaaaauuccaaauuuuuuucuuuuaaaaucaccuuuaaugcuguauucucccacaaauaauuuaaaguguugcuccuaucuuacuuauauaaaacaaucauauacuaauuuguaggguuuuuaaaaauucuaaacaucuacaauuuuaugaaacauacucucuaucccaguccuuagacaacuucuuuugagguauucuauaaugugaaaaucuuaagaaaacauuaaucacaaacaaagccaaauuauaaucaugaauaugcauaugaacaaaggaaaaaaauuucuauaauuuuuguaaccccaguuacaaaaguacuauagaccacaaauaaacuuguggagauuauucgguauuuugucuaccccuuaacacuuuccacacagugccuaauacauaguguguacugaaauauuuguuaaacacagugaauuagggcaaacaaucuggcacaacuuuuuguauucaaaugcuauggaguuuucagaaaacaaaaucuacuuauuuugugauuugaaguggaaaaaaaacaaagcaacaaaugcagagcuaaguaaccaugagguugauaccaucacuacaacaguaguuaagauguacuggcucuccacuguaagucauugaaagggcaaaaauuacguagguuuguuaacauuaacacaugcuuuauucaagagauaauauucaaagaguuaaauccuaagaguuauccacccuacaguaaaaaggggaaguggguaccacuuaugacauguacauaaauuccacuuuuauauuucugaauaaagcugcaauugcuucuuugauagagccauuucuuaaaacuuuugcuaauaaggcuaugugaacuguguucagaaacuuugacaacaugcacacucacuccucucaaagucaguacccaggauuuucacuccaggcugaguaccuauuaaguaacuaggacuucagacugcauguuacuauaugaauucaauuugacucaccuccaguauguuuaucuaccacaacuauuguuuaaaauaaucagaugaauguuuaucauaacuuuauaacucccccaaauuauacuucaguauuuaacaugguaguuucaaaaaauaaauauucaaggccccaguuuuaaauuuuccuccaauguaauccacaaaguugauaauacauguuaggagcacuacucuaaaauaaauguagcuuucuuuuaaaauuacuuguugcaauagagaucacauucuauuccaaauucugauaaggaaucuguuuuuuugguaauacaacaaaaauuugggaugagucaguccuuggaaaaucuuaauaguagucacugaacgaagucaaucauuccgagagccacaaacacucaaaaauuacugcuagcauugacaaguucuuguguuuuuugaugguuauugcuuuaguuggcaauaucugaauacaagacaaaagaacaucucccauuaagccuuauguuaaauauuacaaaacuuauacagaagauagacucauagaggcuauaaagcugaugucuuaaguaacucacccaugaaaugggugcagguuuuuuaaaggcuauccaauaaucuuuuuacucuaaaaauaaaugccccuacuuuucaguguucccauucuucaacaggagacucgagcagcuuaacaguuuugcuauaaaaacaaaccauucuucuuaacaaaccaagaauauaaaaggaaacccaauaaaggacguacuuuucacaguuaacaauaaauaaaagugcaauaaguguucaaguagggcauguaguauaaaaacuacacaugaguauuuagcauaggucaucuuuuaaaggcucuccgagggucccugccauuacuuauuguggucaucacuguuugauuacuagcuguuccuuguaguuguggauuuauaaguccccggccauugcuucugccagcaugugaaaacugguguucccuugauucagggccagugugaacaccauuuccuaaaaaagaauacaaaaauucaucacuauuuucagagguagucuauagaaguagaacuaucuuaagugccaacauguuauuaaugcuuaaaaauauuaaagcacacacuuuuauuuuuauacagaaaaaaaaaacaaugugggcucuaaguuuuuccaaauguauugcuauaaauaugcuaacuugaugcuguauuaauagagagaaaaaagccaacuugggcaucaaaauuagaaauuaauagaguaaaaaaaugcauugccuacacuauaaaagaaaaagaaagggcaaaauagugaauauuggaauuuggcucaaauaugauuaauaucucaaaacagacaauguuauucuaacuuuuuaaaggcaaaggcagcguuucccacaaugugaucagcaaugccaagacauguagccuucgagucaaauaaaacaugagcuggccagguucaguggcucacgccuguauguaaucccagcacuuuaggacgccgaggcagguggaucauuugaggucaggaguucgagacuagccuggcccauauggugaaaucccaucucuauuaaaaauauaaaaauuagcugggugguaguggugcacaucuguaaucccagcuacuugggaggcugaggcaggagaaucacuugagccugcgagguggagguugcgaugagccaagaucacgccacugcacuccagucugggcaacagcguaagacccugucucaaaaacaaaacaaaaccaaaacaugagccauccuaaugaacucuaaucacaaaagacugacuuuuccucauauauuuaagaaaaaagacuucagaagaccuuuaacagagcuacaaggaucaugaacaugaugucugggggucauguuaaaugacaucugagggucacuagccuuuaaacggcucagcucaucuuuuaaagcagcagcuacuuguaugugaaaaauuaaggugaacuaugacucuaaagauaaaacgcuuucagugcaccaaaauaaccaguaauucugcaucuacuauaaguaaucacuagauuauagaaauuuuauaggaaucaauaaaaaaaaaauagcaugguaucucuucacggacaucacaaaaacuuagaauucucaauaaacuggcuuaaguuuaucaacuuucuagaaaaucagcccuuuggggauucccuguuuacugguaguucaccuuuaucacuaauuuaugccuaaagacguugcuuuucacgugaaucuuuacagcucucuucauucuuauaccugaucacaaaugaaacacacaaacaaaaucuuacccacugguccaaauguaccuguacccauauuacuauucauggaauuauucuucuguucacucugugccuaaaaaaaaguuuuuaauuuaaccaaacgagaauaaaaacacaauuauauuauuacaacauuauuauauccuuucuuuuuuaaaguuuuggguuuggcuuuuuuuuuuuuuuuaauuaacaaauuuuuuaaagauuuuuccuaggucauuaaagguuauaauguuaagaaacguuucccaaaccuuucagagcucuguuacauccuauuuccugauaauuacucagcacaccacaaagugcaaaauggcacauauaucuaguagaugacaccucagauacauauccucacaaaacauacaauaaaaauuaaguauccuuuuaaaaauuaucuucuuuauacuaaguaucaacagggcuagccuaaucauagaauuauaacacagucaaaauuagccuaaucauaaaaguauacuacacaauuaccccuuuguucugcuguccucgauaaucuggguuggguucacugaaauuuggcacuucugaauaaaccauacaaaaucugaaagaaaauaaagaaaaaauuaaaugacuucugaaauaaaguccucaacccuucuuuauguaacaucucuaacuuuuaggaaugaacuuaugugucaaacaaauuaauagcaacaaacuaacucuucauuuacaacaaaaacuucccaaaugauuaugucccauaaaacaucaaauauuugacugucuacaagauauauaacauucuauuuuguauuuaaauucuucuuuagugcugaaaaaaaaaucacaucaaaaaucaaggacacaaaaacaucucuguccuguuuuuccacaaaagcugaucaaaggaaaaauaacaugagagugaaccauguuuaggguuccagggugguuucuccagcagugguaauggauuugcaccgauccauucacccacucccauucagucccucuuuugaucgaucacuguggaucugcaaagauaaucauuuaggguuaagagugguuucuaggcaauaaauaauaacaacaggcuacauagccaccaguuuauccaagugcuuccuguaaguugaccauauaauguguacuaacauuacaaagaagcauuuuauuacuccucaccauacugaagacaaaucagaaccaguuuugguaaauccucgacugacccugacaaagagcagucauuaagaaaugagugaccucuaacgguuuuucacguaacugaccuccauuauuaucaacaccucuguaugaauacaugaaggucaggacagaauccugaaccuuucaguaacagacacuaagaccuuucauaacacauaacucuauuaaugcuacucuaagugaauccuaacuucccuucuaacaaaggcaaagcguuaaguguuucugaucuuuaaaagcuagcaugaucauuucuuuuccuucauuauuaaccacagguucuccaaauaagcaucuuauucccucaguggcaaacaguuuuccuuuuuuaucuggugccauuuguggcuucucuuuuuaaauaucuuccaauuugacaggcauuaaguagauggcagagcauuaaccaaacagaauggacugaugauuuggcucauugccuguaccauacuuuaugaauacaacccaaugucuaggcuaacauggaggcugaauuaccuuacaccccuagagaggauggcuccuccaggucaggguggagaucauuaccaggguaguaguguauggaaucucgcauugcggcugccugcaccgcaccuagacuguggauaaauagaggacuucaguuuucguugcugcaaguccuuuuuaacaugaguacauauucacccauaaccauagaaaaagaaaauuuaaacuuauggccugaaacuuggugaaucacuagcuucguauauggugaaucacuacaaaagagaaucuacuucaaauggcucuugugacaccuaaaaaaugcacauuucuaaaaccuacagaaaugcuuccacuagggcuggucucaacugcagcuucuucuacugcucuuugccaggaaaaauugacacuuuuaaccacagaaaacaguacugacaaguguuaaauuuguauacacgaaguuauuuuuucaauuaagcuaccaaagacauucaguuuacuagucaaaaaagccaaagagguuuacaauucauaccuaccaaucauuccguagauauuauuuauaauauaugcaauuauacaaaaugcauuuuaauacuuacuccccaauuuuuugaaguucaccaccccuuccaguauaaagugucagacauccuuuccacauggaugcauaccuagagagaaaagaaacauuaauucuuuagaaauauauuuauuuucuucuauuuaaaucaaguaaaucuucacacuauauauuuuuuguauuaagguagaagugaggaucaagcccucucuauccaccauaguaaaucaaauacaauaaaucuaacuuugauaacuugcuauuuacaaaagaauacaaaaauucugucgaauuuugacauaauuaucuaaaucauaacaaauucuggaaaauaagucuuuucgcaaagccaguauuauuauacccaaugaucacaucuuuagucaauuaacaaaacaaaagcuuuuaauugcagaaauuuaaacagaaacuauuuuucagccacaagauauguaaaaucauccuaauguuucauuuacagucuagucaaauaaugauauaacaguuuuccuucugccuccauaaaagacacaggauuccuaagcuaccgaagaucugguagaauuucaaagugcuaaaaaaaacacuaaggucacaaagcuucaccuaucugccuuuccaaacaugugauuuuuaauaccaugcuggguuuguaguaaacaaacuggcaaauguuuacuccgaacaauuuugaaagcagacagcaucacuacauaaaauaauccuagauaucuaagaaaaagguaaauuaauauuauaaaaucaauccaagguuugguucucaaugguucucuguacaacuacuaugguaacuucaugacuuuaacuuacuauacaguucucuuuacuuuaauuaaaggguuauuuauuaaagacaccauucaccacucuuaaguuauacaaagaguggcuuaggauacagugcauuaacauuucaccuuacuaaaauaaaaauuaacccauauuuugagaaaaaauuugguuacaauuaaaauauuuaacauucacuuuaagaaaugagaacacugagguaaguuuucaggguauucugauaaacauguugauauuugaaccauuauuuagauguuagguauguuuuucuucaaaagcuacuuuucuuagauucaaccagaauuuaagggccuuagaaugagccagacuccaagcugaguguguuguuuugguaaauaagguauaauuauucccauuucacagaagaggaagcugaaguaugagguguaguaacuucucaaggucauacugaaguaguaaauagaguuucuauaguuuuuaauuuucguuuaaauuguacucccagguaauuguuccccuuaaaauucuauaguaccuaacuaauaaguuuaauuuuccaauaauuuuuuugauggaaacaccuaugacugucacuacagaacaugaaauacuugaaauaagaugccguuuuuagcguaaaaaauacuuucaaucauugggugaaaaauauuuggggagccaaaaacuccaauuauacuaaucaauccucaccauacuucccuaagaaggaauucucuuuuguuuuuuaaagauguggaaguuuaaauuacugucaugagucaguguaugagaagaaaaugucuaaguccugacucucacuuccugcuuugaugacacuuuaccucacuuccugaagauguuguaagccugcaagguaacaccaaggagcucuaagcuccuacucucagugcuuuccaauacuucuaagauucuacuuauuaggccaacaucaaucuccaccacuuucccugcaguuaaugauaaauuauuacaauuuuauugaucucaaaagcuuccaaauucuguuuuuaagauccuuuucugcccuuuuaucuuccuaagauaaaaauuugguaaauuucuaaaagcaaucuauuuuuuaaaaaaaaaguucuaguauuuuuuaaagccaccuauccgccaacugacucuuuuggaugaagguauuguagaugccuuucugccaaacauuuucuguguaucccuuugguuuuugcgcaacauccaccuuacagcagaagacacaagaaaucauuuuggagaaugagccuuccagauacuguaaaguuucccucuuuuuccaaguacaaauuugacauaucacagaauaugcuaaauccuuuaccuauaauuuucauuuauguccacauuucuaaauaacauauguaaaauacuggccaggauuucaagucauuaaaaauggagaaggggugggaaacaacugaguggcaacuacacuagagaaaacaacuuauaaaaaagaaaaaauauggacuauaccagucuccuaaaaagacucacugacucagaauagaacuaaaaaucuaugccgggcgugguggcucacgccuguaaucccagcacuuugggagguuggggcgcgcggaucacuugaggucaggaguuggagaccagccugggcaacacucugaaaccccgucucugcuaaaaauacaaaacuuagcugggcgugguggcacacgccuguagucccagcuacuugggaggcugaggcacgagaaucucuugaacccgcgaggcggaggcugcagugaggagagaucacgccacugcacuccagcuuggcgacagagcgagacucggucccaaaaaauaauaauaauuaaaaaucuacuuaaccuguaaaccgggguagaggcgcggauuucccagcugaaaccgacugccuuucacugcaaaggucuguuacaucccagcgcugcccaccacccaaaguuaacaccaaaggaguucaaaacuccucaagaguggcccacagaaaaggcgggggacuucagggcuugccaagaucccaggagccggccaaucccgauucugcagacuguuaggucccccgacuuuuuugcacaccuacccucuggucaaccgaauaauauccccuggcuguauaagaccuccgaucucaucccacacggaaauagugaugcugcccguuuuaucugcuacuuugcacgaucucacuucauggccgucuuugguuuuggucacgcguccugugaggauuuaaaaaucaaagggagggguuguuagauaaugaggacauccagaaaggcuaacuccuccuccgguauuuuaauacaucuggaaggugggaagugaccaagcccagggcucccgccucagguaggauccgaucucgggcggaggccacuagagccacgugggugggggaggggagggaggaggaggggagccccgggcgcgcagcggccggcgccccugucucccgccccgggaggcacagcgggcgguggaguaggcugcaaaccccacuuaccuaucuccaggacaauaaagacgacauuuaaguuuuucaguccgggcuuaauaucucuuauaaaaauaagugggucguugacccuauucauauugggacaggcgcggcuacggcugcggagacgcgagugggcagggcggggucaaagcuucccacccucccgggacaggggcgaaggcagaggggcgaccuugggcagggguggcgagagaaggggcagaaagccguuagucagggaccgggcaaaccagcccggacagcacugagccuaaaaaaagaaaaaaaaaaaaaaaaaaaaaaaaggcucacaaguucuaaagaaaaaaaggcgaaccacuccgcacaccaaccccgcucccaaccgggcgacaggaaggcaagcguacuaacugccccguucuuuggauaaaaggaaaaaaaaacgcagugaggggacacuucugcccugagucccgcucacucacacgggcgcgcgcccagccugucccgggcuccgggaaggaacgggcugugacagcgaaacgggagcggagacagaacaccgcacacccagcgucccaaacagcgacugaugaacacgcccgcgcgccggcagga

SEQ ID NO: 12708 - RNA, 630 nt, Homo sapiens
uuuccgucuggcggcagccaucagguaagccaagaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucucca

SEQ ID NO: 12709 - RNA, 36723 nt, Homo sapiens
gaucuggcgaacggcgaugccccagacgcggcugcaguuuucaaaccgcgacugcaagcuucgguaguccucuccgcugcugucgccaggagucacuucacgagaagccaggucacaaccgucggcccuugucuggaaaaguaaaaguggauccugccacguucggagcucccuggcgccucgcccggcuggagcuagagaacucguccuguggcggcccccggcguggggcgggacagcggcccccuggagggggcagucccgggagaaccugcggcggccggagcgguuaguguccugcgggauuggcggguuggcucggggcugcgauggaaccagccgccucgguacagagaccucauacgugaggaaggaggacccgaggaggguuuaggcgguacgguccggcugagaggggcuuggacuccgccgccccugagguggcugauugcugcuggcgccucuccgcuuugcggcuggaguccggguucccuggggcuccgcgcggggggcggccggcgguccucccaccacccuccucagcccggggcgcgugucugugucugugcguguccguguguccccgugcgcccuccacccggccggccccggcucuccccaggucgcgccaggcagggcccccuucgcggcgggcccgcgcgggucccuuccacagcaaggccacgcggucccccuagccucucccgagucccagcugcggcgugggcgcguucccaucgggacucguggacgcguccugcucccagcugccuuucgucuagagaaaguucguguucaucuugugggacguuuucaguuacugcuugggaacaguguuuuaaaaccagcgagagaucaagacgggcuacagcuguuuccgugauuuucagcgaucugauuuuugcuuugaugccuugugacccacuuagugugcacgacucauccucaaacuauaccacuacuggaugccaacgauuuuugacauuuacccaggcucuuuguuuuauuguagggaaaagcguuucauuugaauuuccuccgagggagaaguagagacaaaguugaaagaggcuuuauagcagcugguagcuggcauuaguuucugucuggacuagaggcacucugacaucaauuuggaaauuggaauuaagaaaauacguuuuuaaaaucguaauacuuaucagauuucacuaauauuuaaacacaugaggacuguguaucacauucaccgauuguuuugucgacguaauguuuacaucuguggugcuaaugauaagcagaaccuugccagggacguuugacgugguguggccacuuuacguuuucaagucuaugagaaugucugcgcggagacagcauagcucuguagaaaugaguggcagcguauguaaccuggcauuuugaacccaggagcacaauuuuauuaaaggaaaauaaaccuacuuucucauugauaacacuguuuuuuaguuuuauggugaacuguucggaaguaauuuucaacaagugcuuauuuuauaaauauuagaccguguaccccuaggauuguguauuuuuuaagaaaacugguccauagaagcggugcaaaaguuuuaaacucaucugccucggauccuccuccucugagcagaugcucaauuaaacuuuuucuaguaucuuaauaauuggagguauuaauagauguuuuauuuuugagauacauauuguacauuuuagaucuuuuuuuuuuucuaaaguagggauccaaaauugaggugaaauauauuugcuuacauggcaagacuuuuuaaaaguagaauuucuguaauugaagaccauccuuuuuugugugugaauagaaugguugcgguuucucuugggaucauugauuagugaauuacgauuugguuaagauagaaugcguuuuuaggaaguuggagguuugacuaaucgcuguguuagcauaugaguaacaaauuugaagaagauacaagcauuuuuauggcugacguuucuaaucagauaauuuuauuuuuaagcuugcucuguuuuacuuuuguuaagugaacauuuuaacauguuuuaaagcucuuugauaauuauaagggagaauuuccuuaugaaaauauuuuugcuuuaauuuuagagacacaagaagucaaggaauucaguuaauaacacuuucacuuaaucguuaaauugccuuaaaauugcaugcauaguauauuguaauucacauuuucuguauguaagauuggcaguuaagaauaguauucuggccgggcgcaguggcucaagccuguaaucccagcacuuugggaggccgaggcgggcggaucauaaggucaggcguucgagaccaauauggugaaaccccgugucuacuaaaaauacaaaaauuagccgggcauuguggcgcgcgccuguagucccagcuacucgggaggcugaggcagaagaguugcuugacccggaaggccgagguugcagugagccgagaucacgccacugcacuccagccugggcaacagagggagacuccgucucaaaaaaaaaaaaaaaaaaaaaaaaaauaguauuccuaggcuuacuacuuuuaaaggauacugauugauucuucuuuucauaaagaaaucuucugcacuguauggguauuuguuuugucagaaacauuagcagucauuuaucuacuaccuuuccacuuaggaaaacuucaaaugucaguugcuuuaguuuuucauaauauugaugacaaaauucagugauuuuauguuuaaguacuguaguuuguauucuaugcugggcuguuaucaaaggcuauuucuuugaauauuucaguuaagaaauguucuuauaaaguuacaagcauguauuuuuauuuaaauauguuguaauguugcaauuuucagggcauacuuuauuaaguuuuuuauuauccuuuuuccagaacauuuaaccucaaacuucagugccauuuaaaacauauauauuaguuucuuuuaauauuuauaugcauuguauuuugguucaucccugacccuuugcaauuacuccaaaagaggguguagugauacuguaagcauugaaaaauuuuaacagugagaugguaauuuccucuuuaauccuuaaaggcagauuccauuuugcauuguaauaguuacugaauaaauaguacuuaagcggugcuauuaaguaaacaauauuuuacaacagaaacccaauuuuccgucuugugagugacaagcaccaugcauuuguugcccaccccggaaucccccacucuauuuccguuuuucaaccuuuuauccugguucacaauuaacagguuuaacucuuuuucuggaggugggaagacacagcauuaggccuuagggucuuggcacagagucaggccuaggagucauugccugacacuucagcccuuggauaguauauacuagaaugguuggauuagaguuaguuuagcugacuuccuauugugauuuuuagaggauuaaguuuaugaauuauauuuucuguucaaaauauuuuaaaaaacaaaaccuguuggcagaauacauaugaggaauauaaucucuuccuugaaauugaaaaucaucaucauuuccaucuugauaccaauacuucuaaucaaugacuaauuaaaaacacauacuucugccacaccaggagaaaguucuuccuuuacuuuugauggacguuaaaucucuuuuucaguuuccuagggaaagcuugcuagcaguaaaugccuuaaaugccuauguagaaaggaguugcuucccuuagaaucuucgggcuuacuuugcuuccuguugccuuuccaauguacuucaugaugaucuagacuuaucagugauaaaucuugauaggacacuuaccugaaucuccugauuuuuggaggcucuuaaaagagugauguucuuaacugcaguagguauuuguauuaguagcuuauauuaaaaacaaguagccaccuugucuggaaacagugguaaaaacaaaaggucuauuggcauuacauuauaguauaugacaaaauaauuuuaucuguguuuccagacuuuguggcuaccuguuuagaacugacauuuuguaagugcaauuuaaaauaguuacuuuauuuguccaaaugcugaauuaagcagagacuagcugcauucagagcuccaguacuguaaauucaagauggaucucaaguucuccuaaccccucgaagacaugagauauaccuacaaauucuuuuuucuauaucucauaauucuuacaauucaguucaucaaacauuuuuaaaauuccuaccggguggcagauaccaugcugguugcuuaggcacaaaaguaaaaggaugcugcccuuuaaacacugaacagaauugcaaucuaacauguuacauuuugagguaaagaaguaugccaaggauccucuuauuugaagcauaaaggagaagccuuuaaaucagccugugguuuuuaggcaaagcuuccugggggagaggccauucuguguugaguuuugaaggauguguaagaagaguuagccauuuaaggaaaguagaaaggcuuuuucaggcaaagaaguauaacaaagaugugguggcaaaauaugaaauaugagugcggcaggaaauguagcugguguauacuuggccucagaggccuuuaugugucaugcuguaaguacuugaaagcuuguagauacuggggagcuaaugaaggaaucaaaacagacaauuugauuuucuaaaugucuuuauuauuguauauucuauuuuuuaaaaacuuucuuauuugauaauuuugaaauaaauaucaugauaaauacuuuuuaaaauagagcuagagguuuauagagauagucuugcuuuuguucacaucacacuugcuuucugcauucaaguaagugaaggcccagaucaagccuaacauuuccuucuuuuccuuccuucacugaucuacuuccaaauucuuuugguaauuauuauaaugagaauuaaugaaaaaaaucuuuaaaaauaagugagauaccauuauuuguaguaguacugugugauuaaaagcuuaauugugucuuaccuucuauuacacuuuuuauaggaucuaaucguguauacacaugcauauaaauuuacuuaccaggucccuuaagauuuuuuuuaaaugcuauaaccugauaaaauguuaugaaaugaauuucaaauggagugagacauauagguaauuuagaaucgguaauaugaagugugguagaagacaagaaaaggccugggaauuguuggaguuaaagagaauuuggugggaaauuuaggaagauacaagaaggagcgacagagagcugacucauaaccugcauguaccuuauaugaagggcaaccagauguuugaggagggcuugguggacaaaggugacauucaugcuccacuauaugcaaaacuggccaaaggagaggaaauggaaaaauaucuuggcucugacaauugguucagaugcaguaaauaaaaggaaaaugaacuuaagaaaugcuuaauggaugccuaaagcagcuugugauguagguauauuuuuaauaaauagaugaacuuaugaggaaauugguacccauauugaucuuucagaacaauggaaaaaaaucagugaaacugagcgcuaucagaacuaagaagauacauaaguaguuaaaacagaaaacaaaaauacuuuuaagaaugaaguuuagacuaaguugggaugagaauuuuguacauggaaacaguacagcuguucaacaauggcagggaacugcagggagaguauuuuuggguagaauguuaauuuuguuuuguggaacaauagcgauaugcccuugugacuugcacuguaccugugucaguggacaugaguucagcauauuuuaauuuuuaauccuugcagcacuggaagaucaauucuuuuaucauccauacuuuagaggcagcaaaaucgaagcuuucuucaccaguaaaagggaaugcgaaguaaaucacaacaaaauuccauuucaccuucaucacacuagaauagccaaacuuaaaagucugaauugggcaaguauugucaaaguagugauaaaccgucccauccagugcuagugggaguguaaacuggggguggaaagaaggggcuaugucuaauauguuuuauuuuuaauuuaaaugaaauaugaccaaguaauaagauuggaaaguaaauguuuguauauaguguuccuuaucuuacauuugaaauauuauauauuuuguuuucuuuuuaaauaacuguguugccgcagaucaggcgacuuaacagaaguauauuuucucaacgauucuggaggcuagaaaucugggaucagggugucugcgggguugguuucuucugaggccugcccucuuggcuuguagauggcugccuucuccuaguguguucacauagucuuuccucugugugugucuguguccuaauuggcccacuuuaaugaccucauuuuaacuuaaucaccuuuuuaaaggcccugucuccaaagacagucacauuaugagauacagggguuaggguuuuucaacuuaggaauuugggggaggacacaauucagcccauaacaauagcaaaguuaaauaauuuaauuaaggucucauagcugguaugauggaugaauggaauucagacccaggugucuuucagucuaaagguuauucucagaaugcuacacuacaacccuuugacuccuagagauguaccccaaaacuaguuagagcuguuuccccaaagacuaagagauguagagaaaacaauuuuacuaucuaguuaugugaaagcuauaauuuuaauuuaauuuuuugagacaaggucuccaucuaucgcccaggcugaacugcagugacgcguucauaauuugagaauaacaccaagaagagaaaauguagaaacugaaaacgcugaacucuaaugacacugcuuuuuggcuaaguagacuauaguuggcauuugaauuuaagaagauaaagaacaguacauauaaguagaaaauaggaaaaaaagaugucagaggaggaacaaaugcuuagcggguuacuacaggagggugcuaaaagaauaauaauugauauuuuauuaaguaggcauagcaauaagucauaagugucuugaaauauaguaucuguuauuguuuuaugaaugcaauuaauauaauaguuuugauaacacugaaugcauauaaacaucacaaauuuccagauacauauaugagcuucagauacagaacuucgaaauaaagcuuuauguauagguuagucacucuuccaacaaaauuauugagcacuucauacauagcaggcucugugcuagguccugucaaaggagggacucuuaagaccuuugagaguuucugaguuuaguacugaaacauagccaauccguggaagaaguucuauuucuuguaguccuucacgucaguaauauaacucacaauaugugcauuuaccaccaaauuucuuuagccaugugaaaauaaguuuaaaaugaauaauuauuaucuugucguauuaaauuaccuauuaugugaaaccuauaacuuuauuuauuuauuuauuuauuuauuuauuuauuuauugagauaagaucucgcuuuauugcccaaacugaacugcaguagcacauucauagcucacugcaaccucaaacuucugggcucaagugaugcuccugccucagccucccaagcagcugggacuacaggugcgagccacuacacccaguuaauuuuuaaauuuuuucauagagaugggaucucgcuauguugccaggacugguuuugaacuucuggccucaagugauccuccugccucagccucccaaagugcugggauuauaggcguauaccaccauguccagcugaaaccucuauaacuuuaaagaauggaguuuuaugaugaaacuaagugauuguuugcauuauaauuuuaucauaacuauuuuuuuuaaauugagaggauuuuuaccguaguuuuauucugaaaugaagucaguaacuucguucaagugccauaguguuauuaugguuuauguguaugcuuuuuguuuuuuccuccuuguggauagaaugugcucuuuaaaucuuuuuuuuuuuuaguuguauuuuauagcuauauuuggagcuguguaauguaaugcacauccugccugagauaacaucuuuucucuguauucucuuuuuuugcauagguaaaaauaagugacuaaagaagcagaccugggaaucaccuaacaugucgaggaggagauuugauugccgaaguauuucaggccuacuaacuacaacuccucaaauuccaauaaaaauggaaaacuuuaauaauuucuauauacuuacaucuaaagagcuagggagguaagaaaaccauaugacguguaugccaucuaaauucaaauuuuggauuuguguuuuuauaauucuauaaaacucacuugggaucauuauuuaacaaugauuaggaaggaaaguugugaucucuguugcuguuaccuaggguccagucuuaacugacuugaaaaucaaaucuguggaggguuuagugaacuuaaaucauacauccuaccuagccucagagccucugauaggaggucucugucguuacaugaggcugugcaugggaagaggcagcucagcauaguggacugccgaguucaaguuuggacuccaccaguuacuaggugugugacuucaacuaaauaacuguaccucuuuuuuuaauuuuuguuuguggcggggucucacucuguugcucaagcuggagugcagugacaugaucuuggcucacugcaaccuccugucuccugggcucaagggaucugccaccucagccuccuaaguagcugggacuacaggcacacaccaccacacugggcugguuuuuuguagagacaggguuucuccauguugcccaggcuggucuccaacuccuggguucaagcaauccucuggccguggccucccaaagugcugagauaauuggugugagccccugcgcccugccuacuguaccucuuagugcugucguuuccucaucugaaaaguaggggugaagauaauugugucugucuuauaugguuguuaugaggauuaaguuaguuaauauuuguaaagugccuaguacagugcucuguaaguuuuuguuaaaugaaauauuuuuuuaaauuccuaggguauugugcuuggcuuaaaaaaaaaaaaaaaagaagaagaagaagaaauagggagauucucccccucuccuaaguugaacaaaaagaaugaauucauauuucauagucugauucuaugucacaacaaaugagugguuuauaaguaaaaagccuuuacaaauuguuuucucuuaaccaguguauaaacucuguacggccaaggagugacaugauauuaugaaaccauucuguacuaccauuuuaauauaugaaaaguuauaaaagauauaccaaguuauuuaaguuauauauucagcaucuuuugagcuuuaaauuaaaggugcuuaaugaaggguuggaagaugguagucaucauguauuuucaguuugauuuuaguucuggagguaaauguuuuguuguauguuaaaugguuuacuaaguccauauuuguguugauaaaugugcagcaaaacaaugugauugauuuuugucuuugaaaaucucgaugugagaagaaaaguugacugaaucaugaaaaguaauuucauucuugguggccuuuuaccuuaagggcagaggcaaguccuggcuuuuucacguugcagauguuggaugcagccuuucuuuugcaaaauaagaauuauaauaucuggccagguguggugacucacgccuguaaucccagcauuuugggaggccgaggagggugggucacgaggucaggaguucgagaccacccuugccaacauagugaaacccugugucuacuaaaaauacaaaauuagccaggcaugguggcgugugccuguagucccagcuacucaggaggcugaggcagaagaaucacuugaacccggcagguggagguugcagugagccgauaucaugccacugcacuccagcuugggcaacacagugagacuuugucucaaaaaaaaaaaaaaaaaaaaaaaaagaauuauaauaucuaccucacugaccaagaauuaaauacaaaagcacauuucauaauuccuggcauacuaauuuaaugugcaaaauauuuggguguuuuaaugguguauuaaaagauagaguuuuuagaaccuuuuaaaauguuuuuaagaaauuguucuaaaucuuaauuacuucauuuugcauuauaauaggaagaaagguuuuuuuuuucuuuuuuucuuuuucuuuuuuuuaaguuuccuguaucucacauugaaccauagaaucucugcauuggaaagacuucagugguccguggucuuacuaauacaauguuuguaugcagcgcagcaaucuuuccuauaauuucccgaacaaacuguuauccagccucaguuugaaugcuucagcgauggggaaaugaauauuaugcaagucuugaacaguacacacaauaaaagucacuuucuuuucuauuuuucugaguuacuauuugaugaguaaauuuacuuacauuuuuuaaauuaacuuuucaaaauuggggacauuauaggagcuaaaaaaucuauaaaguauuuuugcuuugagggcuuuggauaauuuaaacuuugaggaugauauuaguaauucuaaauugcuuuauaaaugaggugccaccauaaauaaaguugaauuaggcauacuuuuuagaauuuuagaucaaaaacucaugauagaauuugauuaaagcaaauuuagauugauugcuaaauucccauuuuaaaauaucuuuaugaaagagaccaaguaacaucuuucuuuugaauugauaugggcuaaugagucacaugguaaauauugauauguuuaauuauuagaucuugauaaauuagaaaucauggcuuuucaucugccaagaauguacugaaaguucuuucaauauuguuaccaauuuuaauauccuaugcuuuugugaaauggaaauuagaaucauaaucauuucuucugagguuugcacauuuugaaaguuaucuuucugaaucaacuuuuuuauuucagaguguuaguguuuaauaauucauuuuccuuuagcaaauuaaaggaaauuauguaaaaguuaacaguucauuuuuuacuauucucaaaaaacuugaauuguuccuguuuuuuaacauguuggguaaguuuuuucuaccccucccccaacugaggcaaagguuucauaggacuucuugugguuagaagggugaggcagauucagaaauaaacgucagcuuccuuuguggcuuacccucccgccuccuuucacauuuuauuguguauucuagaaugcagaaggggaaugcagaaggguaacuacuagaccuuuucgcugcugggaaaucuaguuagccuugccuuuuuaggguauaacuuaaggauuauuuuuaaaugcuuuaacuuuucuuaaauguuucaauuacauuuggaauagaaacauauuuuaaagaucauuuuuuauacuuuuaaacuauagcauuuuagaauggaaaacaaauauuugguuuuuuuccuaagucaucugauaauuaugguaaaaauguuuaccuucauaguauauaaaugaauacacacgcacacauauauauaauuuuauuggaaucucaaucuuuuaagaaauacaaacacuuuaaguacaggauacagaauagcacaguauaugguauuauaguggguacauauuucuggcauucauucaacagauauuucaguuccuauuauguguuaacaaacuguagauuuuauaauuaccauaauaauuaggacagauauggucccugcccucauggagcuuuuacuuaguggugaacguugacaaauaaauaaaucauuauccacaucauuuggucaccuuugcccuggauuaaugaguacuauacuuguuuaagaaagccucuugggcuggugcaguggcucaugccuguaaaauuucaacacuuugggaggcugaggcaggagaaucguuugagcccaggaguuugaaaccagccugggcaacauagggagacacugucuguacaaauuauguaaaaaauuagccaggagugguggugcgugccuguggucccagcuacacaggaggcugaaguaagagaaucuucugagccugggagguugaggcugcggugagcugagauccugccacugcacuccauccugggugauagagucgagacccugucucaaaaaaaaaaaaaaaacaaccucuugguaauaccuggaacaauuagauaagaaguguuauuuacagauaaaauaaauaauaaaauuauugcagaacugaauugucacaagcacuacuauaaacuguuuuuucagaugcacaguuuucuuggcuaacuaguuucuguuuccuaaauuuuacaagugaauuucuuuauaaagcccaaaauuuccuuccuguuuuagucaaguuuuugcuucgaaaucuaaguaagaauugauagaagcaagugaguuacacuucuuuaacaaaacuguuuuuuuguuuuuuuuuuuuuugagacacagucuugcucugucccccaggcuggagugcagugacguggucucagcucacugcaaccuccgucugccgaguucaagugauucuccugccucagcuuccugaguagcugggauuacaggcaugugccaccaagcccggcuaauuuuuuguauuuuuaguagagacgggauuucauaguguuagucaagauggucuugaucuccugaccucuggaucugcccgccuuggccuccccaagugcugguauuacaggcaugagccaccacgucuggcccaacaaaacuauuuuaaagggaggaauuguuuuauagugauuagaacagaaaguuaggaauucacauuucacaguuuuauucuugaggcuccgauuccauuuaugagcuuucaugagguauuuaaucuuauucugacucaauuuauccaguauaaaauuuaugaaacaccaguggauugaauauaaagggacuaauuuuugugugugugugcucaucgaaacccaucaauuuguauuccuucugcauacaaugagaaaauauuuuauaguuaagcauucucaaaucuuaaaacugcuuucaaagaaucagguuuuuauaugcaaauuuauuuaguugauguauuaauauauuuugauaaauguagaagagucaaauuauaguuugauuuccaguacuuuccacugacaucaauuuugaggaaauuuggguaauaaaaaguaggacucuuugucaucuuggccuuugcgaauagcuaguaaaauacagucaagcaguguagucccccaguuuccaccccguacccccuaaacaccaaguuuuguuuuccaugcuaagagucugauagacuguguuagaaauauauugaagggaauugaggcaagaggaguuauggaacaaacauugcuuccuaaagaucuuuuauuuauaccugauuuguuaguaucagaauccagagaguaauucaaaauuuaagguagagguucuuaauuuuggauccccuauacucagccuuauaagguuuauggaugggcuuuaagaucugaaaacccucuggaauuauauguaaaacuuccuauuuaagggcuuguguauauuuuucuggguaggcagucaauagaauagcuuuuauuaauuucccaaaauaauccuugacucagaauagcuuuaggcuuuugugaaaauaaauuuuuggccgcuguagacuuacaguaacacguaugccaauagaaaugaauuuucggugucuuuaaauuuuggcagagguacuaagcacugccauuggagagagcuaaaagcauacuuauuucuaaaaugauaaacaugaccuuaauggguguguuuguacauagcugugauaaccauuauuuucuuaguuuaucaugaaguaucuuugaauauuuucuguaggacacauauaccuuaguuaucuguuacaggcuucaaagacuacugagcauuacuaagagacauauugcuaaaacaauugacaauugugauaguuucaaaggugguaaaaauuguguugaaaggaaaaauuacuaauaaaauuaaauaagucaaauacccauuuuugcauucacuuuaauuucuuauauuuaaagguaagcuauucuaauuagagaguuaacaugauacccuaugaaggguacaguuuuuggaaauagaccugaguuuaaaucuuuaccuugacuaaauuacauaucuucucugaggugugaagaacaggagagcauuuauuauauaggauuguugugauacuuaaacacaauaauuuauaucaagagcauggcauggaguuggugugcaaaugagauuauuucccugcaaugauaauguaucuuuuuuuuauuuuuuuuuugagacagucucacucugucacccaggcuggaguacaguggcaugaucuuggcucacugcaacuucugccucccagauucaauagauucuccuguguagcugggauuacaggcaugcgccacaacgccuggcugauuuuuauauuuuuaguagagacaggguuuugccauguuggccaggcuggucuugagcuccugaccucaagugaucugccugccucggccucccaagauaauguaucauuuuaguagugaagaauaaauauaauucugucuuauccuguuguuauaguuugccauuuacauuuguacgugauagcacuauaaauuuuauaaaaguacguaugauauuugaaucaauuuagagaacaaagauaaauuccuaaugacacagauauuucaaagaauugacuuuaaguuggagguauaacagaaucuguaauauacuaacguuguucucugcagaaaaauuaaaauugauuguucucaucuucccccagaggaaaauuugcugugguuagacaauguauaucaaaaucuacuggccaagaauaugcugcaaaauuucuaaaaaagagaagaagaggacaggauugucgagcagaaauuuuacacgagauugcugugcuugaauuggcaaagucuuguccccguguuauuaaucuucaugaggucuaugaaaauacaagugaaaucauuuugauauuggaauaguaaguauauacuaaauaguaccuauuuuaguugguaugaaaagaugauuaaaaugucaagaauaagaaugauaaaggugugacaagaacuuguaaagauuccuguuaauaaaauguaaaagggaccuaauuuauauucagauauuuucauaagacuaaauguauagccucgggcacauacacaaaaacuaacagcacagaauaagcaaaugacaaauacaacauuugaggaauguggagaaaugaauauacauuauuuucuuaauggcuaauugauugaauuuuucuggaacacaaucugaugggcagauagaauugaaguaauuuguauauuuucuucaucuauuugaaaaauaccuucaagaaaauaagaauagaaaggagaauugaaguaauuuguauauuuucuucaucuauuugaaaaauaccuucaagaaaauaaggagaauagaaagguaaacugcauaaaacuuugcuuaauacauuguuuguuaaagaaauacauuugguauauguaauguguaaagcacuauguuaguuguagcaauaauaaauauaucucuugccacaagucugugaaaaagugaaaacacccccaguauucuacaguucaccaggugguagggguagaggauuguuaagguaaccgguuuguuaccuaguauauugacaugugacucuuacagagugccuuuguugcaugauugucugucacguuuauucuaaggauguaaaauguguuugaacaucugcaacaacuggaagagaucagcuagauuuauguuuaguauaccuugggugccaauaguuuuuaaugaaguaaauauauuuuaugauaaaccaagaagagauaaguguuuauuuuaguaaaaaauguauugcuaacuauaguaauucuuuuuaguaacuaacuugcaucauugccuuuuuaaauuuaaagguauauuaaccuuauuuuuguauuuaguuauuuuaaaauuaauguuuuuguuccacgaaauagauuggcuggaaucaacuugugaaugaaaaugaagauuuugcaaaauguuaaacugacaaguaguucauuuaagaaugaauacuauguacauuucccagaaccgucuuaaggcguguuauauagcacuuucaaaauaaauuagaauugcagaaaaggccaagauacuaccaauaugauuucaguuuucauauauuuuguaauuauuuuugucaaagauucuucagcugaccuuuaaaaaguuaccuacuugcauaacaucugcauguuugaaguguguaaaaaguagcuaacauuugucaaaacaguaguggaauacuagguuuggaggaugaauauacauaagaacauugacuauuuucauaaaauccucuuuuggggguucauccaaacagcaacgacaaaauacaucggaaagauuugagacauuuuauggauggaccuuguucauacuccggaaaauugacucagguaccuuacccaguaaacuggcagaacuuacugaucucuauaccucuggcugaaauguagcaagcacucagaaaauguuuaaguagauuaauguauuacauuucuuaccagagugacuaagacccacuaaaauuuauugcuagaacuucggcuuaauuacuaugccuuccgcuuuugggguggcauugucacauuuaguagucucaguugaagguaaaaauuuaaucagguuuaguuguuuuaguaguguggcauaauuuuuauauggugaaauuaaaacgguggaaucuuuaauaacuaucacccagucaauucuguccucaaaucauccuacacacuuuuucuuccccaacucuuauuuuacaaaauuccaaaucuauagaaaaguugaaaaacuaguacaauuaacauccuuauacucuucacuuuuacucaccaguuguuggcauuuugccacauuuacugaaccauuugaaaguuguagguauuaugauauuccuuuuugugcugaaguauuuggugugggugaugauguguauuuauuguaucacaucagguggcaauaaagucagguuuuauuacugguuuugcuaaauuugaacaugcuuaagguguagucuucuagcucuccucauuguaaaggaacauuuucccuuuuuaauuaaucuguguagugauauuuacagaccaugugauuauuaucuuuuguuguuguuguuguuguuguuguuguuguuguuggagucuugcucugucaccaggcucgagugcaguggcgcgaucucagcuuacugcaaccucugccuccuggguucaagcgauugcccugccucagccuccugaguagcugggauuacaggcacgugccaccaugcccagcaauuuuuuguauguuacuagagaugggguuucaccauguuggccaauaugucuugaucuccugaccucgugauccacccaccucggccucccaaagugcugggauuacaggugugagccaccgcuccuggccaauauuaucuucuuaacuuuucgucuagugauuucccuuucccacuuuuuaauauuucuguggauuucauguuuuuuaaauuaaucuaacacauggcauuaauggaaaauaacccauuauguuuuaauuaaugaguucuaaucaguuucugccacugucuuuuuuucaugcucaaauugucccaagcuuaucagugguucccuuucaagcuacuuccuauguccuuuugauauaaugucauugguguuugaagacucccuugcuuuaugcacaccaaaauuuccagggucaucuuguuaucuugccugccccagaccuguaaucagccaucucucugagaaguucugguucuuuuaaguggggaauagcauuuagaaaccaaauauggguguuggacaugcucacuuuuaacggagcaucguuauuuuuaggacuuuucuaaggauaguguuaggaaaucauauuuuuucaaaaucacgaauuuagucucauagcuccaauucaaguccaccacuacaagguucuucaucacuucucacauucuauauaugcaucuccccucucucacagugaaaacccagguucucagcaauacuugcuuauucacuuuauccaacaauacguacaaaauaguuucagcauaacaauacuaauacugcuaccaacagcaaacuacuuaguacaacuguuuuuuuuuuuuggacauuguuuuugcacuuagacuauaguccauuaaggguaucuaguuagaguuauauauauaguuagauacauuuguuucuguugauauucaguguuaggaugugauuuuuuauauucuuauucugaaauucuaaaaaagguuugcaugauucaaaacuuaaaaaaauguggccaggcauaguagcucaugccuguaauccuagcaauuugggaggccgaggccggaggaucccuugaauccaggaguucgagaccagccugggcaacaaacugagacccucaucuccauauauuaaaaaaauaaaaaauaaauaauuguuuuuuuaaaccacacaaaaaauguauaaacauguauccccuguacugcaaaaucuugcucucauuccuauuccuucugcucucuuccaaccauaccuauguagcuaaccacauuuauucauucuggcucauucuuuauauguuucuucuugcauauauaagcaaacuuguauauauuuaauauucuuacuuacagaaaauguaguauauauacuccuuugcaccuuguauuuuuguuuguuuacuuaagaauauauuccagaaaucauucuacauuaguucauaggcaucuuuuugacuauuauuauggccaguuucuuaaauggcugcauaguacucuguuguaugguuggaucuugcuuuagucgaccuucuguaaaugggaauuauuauggagauguagcuuuagaguaaauuccuagaagaaugauugcuggucaaagaguaaaugcauauguaguuuuauuagauguugucaaauuuccuuccauaugagcagcacacaaucacuuuuaaaaggcacuuuuuuggccgggggugguggcucacgccuguaaucccagcacuuugggaggccagggcaggaggaucaugaggucaggagauggagacuauucuggcuaacagggugaaacccugucucuacuaaaaaauacaaaaaauuagccgggcguguuggcgcaugccuguagucccagcuacucaggaggcugaggcaggagaauugcuugaaccugggaggcagagguugcagugagcugagaucgcaccacuacgcgccaggcugggcaauagagcgagacuucgucucaaaaaaaaaaaaaaaaaggcacuuuuuugauuuguacauuugcuaauuauaugaaucaaucuagaacuuucuucuggaacaacuauagccucuuuuugcuuuuguguuuuguuuugccucuaccuaaccuauuuuuugaaucaguuuacuuuugugaauuaaucucaaauucuugcaaccugcuugucacuuuuaacaauuauuaaaaucuuucccuucuuauuuuaauacauaguucauaggaaaguauuucauugccaguuaugaagucuacaugauuguuuuagccuuuuauuucuucagaaaguaauauaaaucuuacuuuucuggaagguaguauuagaucuauuuauacauauggaggaaaauuugaggauaauugagucauuccaucaccacuauccaugagacaaagacuuuuccauaccaagugucuuuaaagcauauuuguagaauuaaauaaaauauagcuauacauauuaaaaaucuuuuuaaaaaacuucuggaaggaagguauuaucuaauuggacauacuaaguuuucagugcugcauuuugagcaaauuaaaguuggucauaaaaaauacuuaccuuuggcuggacacgguggcucacaccuguaaucccagcacuuugggaggccaaggugggcggaucucgaggucaggagaucgagaccauccuggcuaacacagugaaaccccaucucuacuaaaaauacagaaaauuagccaggugccuguagucccagcuacucgggaggcugaggcaggagaguggugugaacccaggaggcggagcuugcagugagccgagaucacaccacugcaccccagucugggcgacagagcgagagucgucucaaaaaaaaaaaacuuaccuuuuggagaacacagaacaaaaacuuuguccuagaaauagugaaaaucaaaaggggaacuuacauucaucagagacaacucugagauuaugugagaaugcuauuuucuuuuugucaagaaauuuugucuacuaaacaucucuaaguaaauauuaaguacccaacagaaaaggauggagacuguaacaaaacaugcaaaacagaaagccuuaccuucuggaaugaucucaaucaccagagaaauaacauuuuaauaugaucuuaacaauuucaaccauaacguauguugaacauuuacacucuggcaggcacugugauaggcacguuaucuguauucucauuugauuuuuaaaacaauccuccaaaaagggagauugguauucacaucauaugucuaguuaauauucuaaugucuuuccauucuaaaaucccauggacuuuguuucucccauuagcauaggaauauaauuuuaaagagacucuuaauauucaaauuuuaaaacaaguucguuuugaucacuggaaauaaaugcuuauuuuaaaaaucuuuaccauggcuuuucaaagcuauaugacuagauuugcauuuuauggguaauugagauauuacuuuguuuuacugaaaaucuuggcucucuauaacucacagaaaucuaucauuuuugauaggaaaauauucugauuuuaaucuuucauguauuaacuuuauguuauaggaauauuucuaaaagaucuucucuacuugcuguucccuauaaaagacagauguagagcuagauaauauauagcacauagguuuucaugacuguguaaccugugcuaaaguacucuuaucacguauucucacacauagcacauguauauaugcauuagcaagugaacauagaugcugaauuucuaaauuucuuuuguugauaucccugcaagggacaaacucuuuuuagagagaaagagcagaagucaccugauuuaucucccaggucaaugauaaugauauaggcggcuuuucugacuguagauauuuuucuuuuucuuuuuugucuuuuuuuuuuuuuuuuuuuuuuuuagucacugcucugggugacugcucagggugguuuccuuaacagaagucuuguuugcuacucacugcuucuguuucuuuuuccaauuucugccaacuucugcaauuugcugcuuguguuaucaguucuuucccuccucuuaagucuuccuaauuuucguauuuucuguagcuccaccuauguuccucuguugugugagaaauggcaguccuacgaaauacauuggucagcuugucaaacuaaaaggaagagacagugugauuggcugacaaucauaguauuuuauuugaucuuauuauuaaaacaagcaaaaaacucugaggauacuuucccugauuauaaaaguaacacccauucauuguguuaaauuuaggagauacagaaaagggaaaucacauguaaaugaugguuacuuuaugauauguuccuguauuuaaaaauuauucuuauuuuuuggucugugcguauguacuuuuagagacaacauuuugaucuacugggcauauucuauuguaacucuccuuuuucacuuaagaauauagugugugcaucuuuauauguaccauauaguguuucuaaaaauagauuuuaauuuagcaaagacuuuaaaaauuuccuucaaaaucagaguucaacaaaaagucccaaaauuuggaaaggcgagauguuggcuagauuugcaauuaauguuuguuggcucauuauaauagcugauauuggcugggcccaguggcucaugccuguaaucacagcacuuugggaggccgaggcgggcggaucacgaggucaggagauggagaccauccuggcuaacacggugaaacccagucuccacuaaaaaauacaaaaaauuagccggguguggugccacgcgccuguaguccuagcaacucgggagacugaggcaggagaauugcuugaacccaggacggggagguugcggugaguagagauugcacuacugcacuccagccugggcgacagagcaagacucagucucaggaaaaaaaaaaaaaaauagcuguuaucuauugaauauuuaccgugugucagacacugugauaaguauuuauugaaacgaucugcuuugauucuucuaggauguuugugcucaauacuuuauguggauuauccaauuuaauucuuagaccaugaaguaggagcuauucuauuauucacauuacaguagaagaaacagaggcacauuuugucccaguucaccuagccuaguuagugacagagcuagagugaaacccaggcagucuugauuucaguaagcacuccuauaugcaccaugcuauccugucucuuccuaggcacugggaauugcuuuccauacuuucacuuuacuuucuuguauuuuguuuuuaauuuuagaauugguggaguguucugguuauugaaguaacuuuaacgaauuuguaauauaaaauguugguaaauaaucauaaaguauucaagaauaaaugucuuaccuaaacaauuuauguugcuguacaaaugaagaauacacaucuauuuuuuauauauuuaggggguguaaauauguaaauucauauuuuauacuguuuucuaauaauuucaaguuauuuggucugauuuuuauaagauaggacuagauuaucaguauuuauaucuuguaaaguaccuaacaaaaaauauauucuaagagaaucuaaaguguucuuucuucauuuucuuauuugcuuaugauugcauuaguacuauuaccuaauauaauauuauuuguaauauuauuuugacugucuuugcaggaauauauuuagaccacuuucuguuuugagacgauuuguaucauugaaacuaaacaguguagccggaaagggaaggagugauggugucacugccagucugugccuggauucccacucugcccucaggagaccuugagaaggggugugagaaaugaauacugacaugcagaccaagggccgcuaggcaguguguauauuaauuauucuugaagauuaguguauuucuuuuuuuagauuaagaaaaugugaauucccaaaauugucuuucuauaccuuauuuuggaguucacuacuauaaauuuaauagcaaacuacacuuuucaauacucagauuaucuuuaucaugauauguugagguagauauuaaaauuaaugucucggccaggcacgauggcucacaccuguaaucccaacacuuugggaggccaagaugggcagaucacgaggucaagagaucgagaccauccuggccaacauggcgaaaccuuaucucuaauaaauacaaaaauuagccgggcgugguggcaugcaccuguagucccagcuacucgggaggcugaggcaggagaaucucuugaacccaggagguggagguugcagugagccgagauggcgccacugcacuccagccuggcaacagagugaaacuccaucucaaaaaaaaaaaaaauauauuaugucucaugaauuuacagcaaguuuuggugaguguaaugggguuaaagugacauauaugugauuggagcuuucacguguauuccuuauaagcuguccuacagaguuuuuuucugcaaagucagaaaguguaaagcaccauauguuugcggcuucuaacuggcuuacuguguuuagauugcucaauugcaaauuauaucuagagugugaagugucaguccuugugacuuucaacuugggacugaaauuugagcccaccauuauuuuuucuucuuauggcuccuaacacuuaugacauauuuuuuccucuuggcagucacugagacuucugaauccccagcuucaaccccucuaaagaaucgcugcccauuccaucauucauucauucaacaaacauuacugaccaccuacugcagugcaugcuagauacuguucuugaugugguuguagcagugagccaaagaaguaaaaauagaguaauaguauuuuccagagugaguuacuauuuuaucaaauagaauauacuuguguauucccaaauauaccuuacaaauuugaugaauaacuguauaaauguuuuugcaugauguucuaauuuuaucuuauuuagauuuaaucccuccuaaaaaaaucuguggauuuuauugauauuucugcuuuauggaugacuauaaguaacugacccuaaguuauauugcagguaaauagaagaguuaggauuuauguuucgauaauucauuccaaaccuaggaauuuuucacugugccuuuuucagcauucuuuaaauuucaguucuuuagaauuuauuuauuuauuuauuuguguucuggccccaaguauucugcaugaagcuacaguacaagaugguauuggcuaagaaugcagauucuuacucauauucaaguuuguuaaccuaauuguacuuguuucuacuguaaaauggguguaguaaccauguaccucacauguuugucaugaggcucaaaauagaugauauauauauaagaauucauauauaugaaaacauauguauauauaugaauacauauagauguacauauaugaggagagcacaaagagcuacuauuuuuauuaucuuuauugcagugaaggcaggcugcaacauuauuggaucauaaagcaauucaguuuuauuuauuaauauucaaguauuaguacccagaauuugaaauagucucaucacuuauuuucuuuuuucuuuuuuuuggggacggagucuugcucuguagcucaggcuggaaugcaguggugccaucucggcucacugcaaccuuugccucccagguucaagugauucuccugccucagcuucccaaguagcugagauuauaggcaccugccaucacacccagcuaauuuuuguguuuuuaguagagauguuucaccauguuggccaagcugaucucgaacucccaaccuucagugauucgccuaucucagccucccaaagugcugguauuacagacaugagccaccgcacccagccaucaucacuuauuuuuuuccuuaaagaucucucacuucccugcccuauuuuuaaguguaacguauuaacauuuauauaguuguaugucuuuuacuuaacagguacacaauauuuaaaaguguuuaggugaaugaauuuucaagucucuguucuuugaauuuuauuuuagugcugcagguggagaaauuuucagccuguguuuaccugaguuggcugaaaugguuucugaaaaugauguuaucagacucauuaaacaaauacuugaaggaguuuauuaucuacaucagaauaacauuguacaccuugauuuaaagguaacguaacgugauuuaaaguaaugcaacaucuguguucuucuucugcucuuaguaugcacaguugcaaacugguauuaacaggaaacaaugguugguuccuggucuucuagacugcacuggugugcucuuugcuuacgugugccuauguggccuuaauuuuauauuggcagaaaggagaagagugcauguguaagcagcucaaauuacugggcucuuaaaaugcaucauuccuguguucuaauccuacauuagauggaauuauuccauuccaucccacucuuacaaccacauccuggaccuucuuauuuuaaaaugcugucuaucucugaaaugcucaauuguguaaucuccaucucugaaaauaaauccugcuaauccucaugcauuugcuccuauuaccuucauucauuuuugucuugagguuuucagucuuuuggcuucuuccagaucguucaggcucuuuacccaagccccgaaccuccagucucuuaucuccaucucucauguuguuauccuuucuccuuauccuucuuucauaaccacacaaggaccuuaagaucugaaucagucugugucucauuuuuugagcauuagauucuucuguuuuuauaugguguccuugcaugacccuuuggcuucuauuaccacuuuaauaauaauaauaauucaaaaaucuccaccuacagcccaggccucucccuuaauuuccaaauccucuuaccgcuuuuucaaaagaaaaaacccuguaguucuguuuugggccccacuauggagcagggggacaguauuuaccaucuaguaucccugcuauuuccccaacugauaaaauauuggaaaagaagcaacacaguaaaugccaagauaaucacgcucccaccagcuuccuguugggucauuuuccugcuaacaucaacccaaguacauuacauagcaucacauagcccuugaagugggauggcauauaaaccugugguugacaacaacagagcuaauuaccuuuaccuuuucuccuguaauaggcucugugcuuuaguaauaaacaagcaugagauugccccaaaguuaagcgacuguuauaauucuuugcacagauuuugggagcagcaccuuggcagagguauggguuaugacagcagcaggggacuuuguaauaggccgugggccugcaguaguaguaaagcaaagucacgugguuuuaggaggcaauggaugagguguacuaugcccucuuauugucuaagcuaaagccagggaacagucagaccuggcucauccagaaucaucccauuguacugaaccauuuuucauuucuggaaauguuuacguucucauuccuuuaugccuucuuuugugcuguuccccagagcaccuuucuguuguucuuuuuuuuuuuuuuuuuuuuuuuuuuuuuuuuuuuuuuugagacagagucucgcucugucgcccaggcugaauugcaguggugcgaucuuggcucacugcaagcuccaccucccggguucacgccauucuucugccucagccucccaaguagcugggacuacaggugccugccaccacgccugauuuuuuuguauuuuuaguagaggcgggguuucaccauguuagccaggauggucuugaucuccugaccucgugaucugccuaccucagccucccaaaguccugggauuacaggcgugagccaccaugcccggccucuuuuuuuuuuuaauuuuuuaauuuuuuuuuuauuuaagagagggucucacuauguugcacaggcuacucuugaacuccugagcucaaacgauccucccaccccugccuccagaguagcugagacuacagguugacaccaccguacccagcuacccagagcaccuuucuaaccagcauacucuuuuaagucucagcuuacgcaucaucucuacugcaaagccuucuuggaauuucuuauugacagaaugaggcagucuuuuuauuacugaguauucuauaucuuaaucuuuccauuuaacuucuuuucucuucaaaccuagaauccuuuuuggguguguuuuuggcuuuaugcaucauugaauaauagcuccgccuaaguaguaagucaguaaauguuugaugcaugacucaaugaaauguauaauagcugagcaauaucuuccacuuaauauacuuuccaucugagacuaguaugcuuuuuuguauauuacuuaucauguuuuuguuguacuuuguuuagccacagaauauauuacugagcagcauauacccucucggggacauuaaaauaguagauuuuggaaugucucgaaaaauagggcaugcgugugaacuucgggaaaucaugggaacaccagaauauuuagguaagaauuuccuuuuauuuucuauaccauuuugaaauuuauuaaguaaaugauaccucuguagaacuauauuuuagagcauguaauucgauucaguuaaaaggauuugauugguucaaguauuuugauacauuaaaacuugguuagguuaagacacauuuaaaugaaaugaauaaaaguaugaaacauuuacagcaauucaggggacacugaauauguaaguguacaaguugaauguuuguguauaaaggauuuguacauaaggaaaaaagaaauggguaagagggaaguuagggaaaaagagaaaaauggaaaaagaaaaacugcugcagugaaguggcccaugauugucuuugaagccuggcuguuggcuagaucucacuucuauuucuggucccaauuccagagcuguucacaauacagauaucuucaguuuaaacuuacaggaauuguuagccggccaccucauuuuuguuuauugcugcugcuuuagaauaugagguuuugcauaggguugugaaaguaggguuuugaagaagagugccaaaaagaaccuuugauuagguaaucugggcauauugugugaaaucaacaaauuagauuaugcauaugaaagguuuuuaaguuguaugaagcaguauauaaauuugaaguauuuuaacuuauaaucuuuuuucuuuuuucuguuuauuguuuauacugauguccccauguggacauugaaaagauacaguuaaacagaacagaugcgacucagcuaggcagcugucuuuuccaaaaauaaaaagcagagaaaauuacuaacuuuugaaugcuaacuggggcuauaguccuagaauaaaugaauguaauuauugguaacacagcucacagaaguaugugaaaauguaggugguuuaacagaagcugacuguauaugauuuaaaggcuuuauuaauaaaaauguuaggcuuuaggaaacaguuucucuuuggagaaauuaugaaaccauauugugaaacaagaaacuuauuuuucacucauaaauccuaguuuggacuguacuaauucgaaauaauaugguaauguuuagaaagcauagagaauuuauuuugcacuuuuuuuuuuggcaagugaagacagcagaaaauuaauugcuuuggaaauuagguccuugauaauuuaagaggaauguuuaauucacuggaaaaucuagcauuucuggcugggugcaguggcucacacuuguaaucccagcacuuugggaggccaaggcgaguggaucacuugaagucaggaguucgagaccagccugaccaacauggugaaaccccaucucuacuaaaaauacaaaauuagccaggugugguggugcaugccuguagucccaccuacuugggaggcugaggcaggagaaucgcuugaauccaagagguggagguugcagugagccaagaucaucaugccauuuguacuccagccugggcaacaagagcgaaacuccgucagaaaaaagaaaaucuagcauuuccgagaagcaaaauuugcucaugaugucauugcagaugcacaugauccuauuuaccccaaaagaaaaaccuaaauuaaucuaagaaaauaaugcaaauuaauucuaaaguaauaaaacuaauuuuuuuuuuaaauucuagcuuccagaguuuuacuuuuuuauaauuguuuuuuucugagauuaaccuaaaugaguuuaacuaccuagccacuaauuacuccaagaauauuauccauguuuuugaaccaccugaucauauaauuuacucaauaauagggauguuuaaauguccaaucauaggauaauuaauacugugcuaaauuucuaaauuucuaucgucuuauaucacuaggcuuuccaaaauuaaauccaguuacaauuuuuauuuuuuccgagacagagucucacucuugcccaggcuagagugcaguggugggaucucagcucacugcaaccuaugccucccggguucaagggauucuccugccucagccuccugaguagcugggauuacaggcaugugccaucacaccuggcuaauuuuuguauuuuuaguagagacagcguuucaccauguuagccaggcuggucucgaacugugaucucaggugaucugccugccucagccucccaaagugcugagauuacaggcaugagccaucaugcccagucccaguuauaacguaauauaaagugauuuucuuguuuuaaaauuugucaauauugaauuuaaguuuuaucuuuucuuucagcuccagaaauccugaacuaugaucccauuaccacagcaacagauaugugguaagauguuguuaguuaccuuaaacaucuuuauggaaaguugggaaacguauauucugggguucuuugacuccaagaguaauaaauaauaaggcuuucuucaaaagauuuuauuugaauaucauuauuaugcuacaggaaaauauuuaccuuuccauuauuuuuaaauaacacuuaacuucugagccaaaaguacagaaauuaauaggaaaaucucucucugugaugaaaacucaguugaguaaaagaacaaaauacuugcaguacauugcuacauauuuuaugaugaaggugaaaugcuuaauaagcauagaagcagcagcagacaguccauugccgggcuccaccucacaaagggagacaucugaucuaggucuaaaagaguuggccgggcgugguggcuuacaccuguaaucccagcacuuugggaggccaaggcagguggaucaucaggucaggaguuagagaccagccuggccaacauagcagaacccuaucucuacuaaaaauaugaaaauuagcuggacgugguggcgcguaccuguaaucccagcuacucaggaugcugaggcaggagaaucacuugaaccagggaggcagagguugcagugagccaagaucaugcuauugcacucuagccugggugacaaaaaaaaaaaaaaaaaaaaaaagcuagaagaagguauuuguuaagcagaauaauuaggucaggcccacccaaaaauguacuuuuaugagaguacaucucugggaaauuaugaguuuuuguagcuagccaagagagaauaccauagggaauagaaccagaacugauacuggagcuucaguugagaccacaaaggggacugacuccucagaccaaguggaagguuuagaccuguucuguguucuguggaacugcucauggguuugcccaggaaaaaagaugguauggcuaaauaaguuggugaaacauguacuauauugucuuuuucuggcuccugggcaccagacuugccauuaacacauuuacagauuuuaaaagguuugcagugaaaaaauuugccugcccagcuuugugcuucgccaaacuugcagccucuauuugugcagaaccucucuuuacaucucacaagucauuacuuugccauuggaaaccacuuaggaaaugcugcagcagcuuuguguacuccacggcagguaucugugugaaggauagacgguagcaauaauauauauugaauacauuguauuuauauaacacgugcauucccuuguguucucuuucugugaggcacacuuugagaucauuauuuuaguuuuaauaauauaggaacuuugaaaagcaauguaaaucuguaguuuaaccguaccaguuuugaggagaggaguauguugaaugucgauuguacuuuguauaaauguuuaaaaauuaacauacauuuuaaguuccccucccuuguuuuucaggaauauugguauaauagcauauauguuguuaacucacacaucaccauuugugggagaagauaaucaagaaacauaccucaauauuucucaaguuaauguagauuauucggaagaaacuuuuucaucaguuucacagcuggccacagacuuuauucagagccuuuuaguaaaaaauccagaguaaguaauaauuuguuuaaauacuauuacaaauuuaauuuguuuaaauacuauuacagaauaaauaauauauaccuauuaagaaaguauauucuaaaauaguauaaaauuauuagaaauauguacaaguucuagguaaaauaggugguaugagcaaucauuaacaaauacauaacuucagauauaaaauauacaacaggggauuuugaaguaaagaaaagauuugaguuacuucucucacaaaccacuacuaaucccugaaauuaccuaaaauaauuagucauagaaauuuacaauacacauggcugguuaugauaagacuuuauuguaaaugauuuacaguuuaaugauuuuacggccgggcgcgguggcucacgccuguaaucccagcacuuugggaggcugaggcagauggaucacgaggucaggagauugagacccuccuggcuaacacggugaaaccccaucucuacuaaaaauacaaaaaaauuagccaggcaugguggcaggcaucuguagucccagcuacuugggaggcugaggcagaauggcgugaauccgggaggcagagcuuccaguaagcagagaucgcgccacugcacucuagccuagaugacagagcaagacuccgucucaaaaaaauaaauaaaauaaaauaauuuuacauacauaacaaguaucauuuacugauugugaaaucuugaaggauuggaugcccuuugacaaccuuacaaaagaagcgagucagcugagcgagguggcucacgccuguauucccagcacuuugggaggccaaggcggccagaucaugaggucaggaguucgagacuagccuggccaauauagugaaacaccaucucuacuaaaaauacaaaaguuagccgggcaugguggcaugcaccuauaguuccagcuacucaggaggcugaggcaggagaauugcuugaacccagaaagcagagguuguggugagcugagaucgcaccacugcacuccagccugggugacagagugagacuacauugcaaaaaaaaaaaccaaaaaaaaaccaaaagugauuuggagguuaguuaagcaccgucuuucaaaauauaaagacccacuagcuuuacuaguaacucauccuaugaacauaauuagagaagaucccaaaaaacauuuucucaauauucauugaagcauauuuauaauagcaaaaugcuagaagcuucaaugggcaucugguuaaauaaauuaugguguauccauauggaagaguacuaaauaauacagcuguuaauaaauauguuaacucuguacugauguggaaaaaugcuugagaugcauuauugaguaauaaagcaaauugcagaaacauggaguaugugaagcuguguauguguauguguguguauauguuuguguauguauaugcacauauauguagaaaaaauaucuggaagugggauuggggaaugagaaaacaauuuuacuuuuuaucuucaugagagauaauaugguguaaugcuuaaaagcacagacgauagagucaaaguuccacuuaacuaccauuuacaaguuaggagauuugggguaaauuucaagccuccugguacccuacuuugcauaucuguuaaaugaggguaauaauaguacccauuucaugaguuuguuaugauuguuaaauaauguauuugaagcguauagaauagucccuggcauauaacuaagcauucaguaaauguuagcagcuauuaucauuauuauucucuucuguacuguuuggauuuuauacuaugaguauguuuuauuuucacaagaaguaaaaaauaugucuauaaucuaucaaacugaagacauuuucaacuugauuuuuaguucucaauuuucccuuggugcuuucuuucaaaggaaaagaccaacagcagagauaugccuuucucauucuuggcuacagcagugggacuuugaaaacuuguuucacccugaagaaacuuccaguuccucucaaacucaggaucauucuguaagguccucugaagacaagacuucuaaauccuccuguaauggaaccuguggugauagagaagacaaagagaauaucccagaggauagcagcaugguuuccaaaagauuucguuucgaugacucauuacccaauccccaugaacuuguuucagauuugcucuguuagcacuuuuuucuuugacucauuuggacugaauuugaaauuuuauauccacuccagugagauuaugauuuguagcuucauauaugacauguuuauauuguaaaugcacuuuuccauggaauaauuuagggaaguguuuuaauguuaaauuacuaguugcuagcauguuaugauuucauauccugagauagcucugcagauaagaaaauauuuaaauauaugacaaaaaguaaaauuguacaugugaguuuacauguuaaugaaauaauucaacuucaaaugaacuuaccagaauguuuugcauaucaacaaaaaaaguggcuugaguuuuauuauaguugguguaaacugaacacagugaagacauuggaauuuaauagguucucucucuaaggugacucuuauaccaugccucuaucaacauaauuuguuuaggaaagcaguaugaaguuuaagccaaaauaauuucuacuuuauagaugcucaagagacauuuuacaauugaaaaugucuuucaauuacaaauauuuugaaacuucguaagauuuucauucucuguggucuguuauaugagagagauccuuuaacuagagcaaagagggaguuagaaaccugaucagggauauucuuuacaaguuggagcagaggaaagaguagcaugccuucguauuuuaacgcaaaugucuuuuuccuccucccaaccuacuugagaucugauaaggucuggaagauggagauauuugguaugcaaguguagaguuuuuuaauccuccagaauuucuagaguagaagauacuuagguauaguuaaauauucuguauuuuuagucaaacauauuuauuaauugaauauagaagaaaauguugacacacucagacagcuuacugaauuuuagaugucuucugcaucuuagaauacaagccagucauucagaguucuaaaaguaugcauaaaaaauuacagcaccgguaggucuauuaacacagugcccgagucagcgguagcaagacugaugugaucauaaaacaugacaucaggcucgucugaaguucuugugugaaauuccuagugagugaggaggcucagcuuaaagccaucugcagaguggccccucauuguggucuuuugcugggaccaaugcaagagacuagggagagcaaaauguuugcuuauggcuagagacuauauccagcccuaaugauggggaaaguuaguccuuuucggguaaucuuuuaugaauuuucaccugaugaccguuauauuggucuguuaucauguuacgauaacugugaucucaugaccauguugcuguaucagaagaaauaguuugacaaaugguaacaacaaccugauguucccccuuuagaccuuuaacuucucaaaauuuugguaaguuuccaaauucuuuaauaauaacuuaaaacuuuuugaauaacuaucaggucacuuuauuugaccacauggugaauuccuuuaaugucuucagcauuuguuaaggaaaaguuuucucuacuuguguguguaugugugcacauguguguauguacagguguauguauauaucuauagauagauacaauacauucuuuagacacuuuucaagauucuuugcugugguauauugugcucaacucaggugccaaaggagcuuuuuuuuuuuuuuuuuuuuuuugagauggaguuuugcucugucucucaggcuggagugcaguggcaugaucucagcucacggcaaccucugccucccggguucaagcaauucuccugucucagccuccugaguaguugggauuacaggcgcaugccaccgugcccagcuaauuuuuguauuuuuaguagagacgggguuucaccauguuggccaggcuggucacaaacuccugacuucaagugauccacccgccucggccucccaaagugcugggauuacaggcgugagccacugcgcccccgcccaggagcucuuuucuuaugacauauaaauuaugacauuuauauucuuuauaugacuuuauguucucuucuuaugacauuuaaauucuuuaaguaguuuguugguccaauaaacuagacguuguauaaucuaaauugagcccuuguauaucuaaaacugaugaguuguuucuaaauuguugauuguccauuuacuugccuuugguauuaagauaaugcaaguaaaguuuaguaagucauuggauaaugaaaugauuauguuucugaagaccauauuauauuuuuaauuuuuagaggaaucaugccaucccccaaaaaaucaagaaauauuugaauuuuaaauuauaaguucauuuguuaaaagacauuuuuacaaaugucugaaaaucuuaaaauacuuuacaucuaccuuuaaguaguagaauacagagcuguaaauuuccaugccuuuuuuccugauauuaaguuuuauaguaaaaaagcaacuagugauugcacaaagaauauaaaaauccacucuuuuuacaaaggugugaauuuaaauaacguuauugauuggaauaugaaaauagaccaaucauuuaagagcuuuuuagcaa

SEQ ID NO: 12710 - RNA, 1354 nt, Homo sapiens
uaugggacauauaacaagcugccauugcacuauauacuaauugguuucuuucccccacuaggauauaagcucugugacagugaagacuuuugcucacuucuccagcaucuaguaggugccacacaaauaucugacuacauuuaaucaacaaucucauuuacacccaaacuauauuaaauagguaguauugucauccucacuuuacaguuugcaggaaaacuauuggugcacaaaccuuaaguaaagaccugaaaacaaacugagggaacaagaagucuggacuugaugacugaucaccaaaacaaguaaaucaaagcgaagucgucugauuaguauggaauaagggaaacccaaaucauacgagaacaccaauuaaaaugugggacacgcaggaagaaggcagacggaacugcugcuggauaacugagucuuuccuaaugacaggaccuuauguugcccucacaauuaccccgugagauaggcaaggcaggcauuguauuagacaaucauuaacaagcaggacgcugacagccaggcuucgcagccaggagugguggccugucuggcuccgcacucacggguucggacaguuacagaauuaacacucaagcccuggggcuucccgcagcccccggggggguggggcucacugacuagccucccggaagcggaccccaggagaaccaggcaguugguuaauccaggaacagcuccugcgcggggcguggacugagcagucacugaguauuacgcaaauugcgcgagcgcacgggaaaagcgauuggucggucaggagagagagguguguccuggcgggcccgcagcuccgauuggccgacaggcugacgggaacguuuacggucagcgugugucagcgacgugcaacccggaagggaagaaggggcgugucaggcugcgcaggcggccaguccauuggcuggaagagaccggagccgggcuccgggcccgaccagaggagggcggugcugcagggcugguccgggaggugacgaccggcuucggagagucuaucauggcagcucggacuggucauacggccuugagaaggguagucucgggaugccguccgaagucggcgacagcggccggggcgcaggcgcccgugcggaauggcagguaaucaacagcgggggcgcugagacgagaguaguuuucgauuuuggcugccgaguugggggaccggaaggauuugggggugaggcagagccggacucggugcauuuccgugucuuuagaggagaaggcuuuuuuuugcguuuggcaucugagggacucaagagcggcgcgcaucaccuugggcccaaggcuguguucguggcucguuugccucgug

SEQ ID NO: 12711 - RNA, 13677 nt, Homo sapiens
uauuaacuuuaaacaaauuuuuauuacacaaagguugucacauaauuggauacuucucuacuuuguacacaauuauucucacucuccacagaaaggcugcuuaacuucucaucuggugguggcaagcacuaaaauccugauuuuaacagaauaguaguaaaaaugccucagugauuuaaguugaaagcaguacacugguacauggcucuuguacccaguaucaggaauguacaaauguuuuuuauucaaaaauacaaaauaaauuaucuguaggcauggacaaugacagcaguaaaccauuauauauuuugucaacugaaaccaguaacugaugguuauagugauuuucagccagccuuuuucuucauuuucuccaacugacuucucugaaguuauuggugaggaacacugccuugggcuuccugucacaguucauuaauaaagguaaagcacuagucuaggaguuagaacaugccaccucccauaccaccucccauuccacccauugcacccauuccaggguccuucucuucuuuaggaauuucugugacuacaacuucugcuguaguuaacagagaggccacaccagcagcauccaauaaagcaguucucacaaccuagaaaaaaauuuaauuaauuaguuuucccuuaguaaaauaugagcaagacuuauugaaaauuucugucugggcaugguggcucacaccuguaauccagcacuuugggaggcugaggcagguagaugacuugagguuaggaguucaagaccagccuggccaacaugaugagaccccgucucuacuaaaaauacaaaaauuagccaggcaugguggugcaugccuguaaucccagcuacucaggagccugaggcaggagaaucgcuugaacccaggagguggagguugucacugccugcacuccagccugggcgacacagcgacucugucuucaaaacaaaacaaaacccuguucugcguaucuuggaaaguauucuuacugccaggcaggaacaggguguuccagauccauccugauuuuuuccugccuccaggcauggacucaacugcuacucaagggauccugcuuccuuuuaguggaguauuaaauaucuaggugcuggaaauguacaugagaauuguugaugggcacaagagcuauugcuguugcuacugcuauuagacuauuuuucuggugacaaaaucaaagauuugggaugugaggauacauuaacaaaaugaacaacaaaagaauuuuuagaaaguguucaaccauuuaccuuuguugggucaaugauuccuuuuuccaccauauucacaaaaucuccagccauagcaucauaaccaacuucugaggaacuuugcauaauuuucucaacuaucaaagauccuucaacaccugcauucuuagcaauggucauugcuggaauuuugaguguucuuuuaauaauuucuauaccuacagagaaauuucagcaaaauuuuaauacuuucauuuguaaauauuguaacacauuuauaaguugugaggauauugauguagggaaaucccaauccuacuacagaucaaaucauuuccucugaaaaagaugugaugcauguuuagcucugacauuagcacuauucuacuucuguuauucaggaaaugaaugugcuauuccauuuaggggacugcaacauuauuauucuaagaaaaacuaaaaucaggccacaaacucauuuaaaagguaacuuuuuaccaauuuuuugaucuucauuagcuggagucaaugaguccaaggcuggaaugcaucgaaggagggcacaacccccucccaaaacaaugccuucuucaacagcagcucuuguagcauuaagggcaucuguaacucugucuuucuuuucauucacuucaacaucacuugucccaccaaccuaaagacgaaaagaauuccaguuaguauggccucuucauucaagaugcuaauugccaagucauuuaaaagcaguuuacuuaaaaagcaauccugaggugggcgugguggcucacaccuguaauccuagcacuuugggaggcugaggugaguggaucacuugaggucaggaguuugagaccagccugaccaacauggugaagcccugucuccacuaaaaauacaaaauuagccaggcaugguggcaagugccuguaaucccagcuacucgggaggccaaggcaggagauucgcuugaacccaagaggcggagguugcagugcgccgagaucgcaccacugcaucccagccugggugacgaagagcucaaaacaaaacaaacaaaauuccacuaugaaguuaauuccucaaguauucguuuaguucuaugguacuacuggggaauacuacagaagcaaaaucauucuuggacucagaacccaagaaacuuauucauaauaaugaauguuaccuucagcacagccacuccaucugaaaguuuugcaagccguucauucaguuuuuccuuuucauauucacuaguugugacaucuaacugcucaaugauuucuugaauacguuuuucaauuugagccuugucaccuuuuccuuuuaagagcauggcaucgucuuuggucacaaugaccucuccaacuuuuccuaagucaugaggcugaacgucuucaagauucagggucaaucccucuucuccaaacaccuacaaaaagaguuaaacguaaaccuguuguagguuacaguuucugccauuauaccaaguuuauuaauacaccaugcaagagaaucaucaaaauacuuuauuucuuugaaaugagagauuuuaagaucacuguuaguccagaacaagacuugaguauagucucuuucacugcauuuccaaauucucaauucucacaacugugguaauuauuaccagccuuacuugagaaaaaaacaucgaaggucacacuuacugguagagccaggacaagaccauaggccuugacucucaaguccuacaucccuuguagcauacacuucuaccuuucaaaacugagcucgguagcucaugccuguaaucccaggacuuugggaggcggaggcaggcauauugcuugaguccagaaguuugagaagccuaggcaauacagugagacccgucauuacuaaaaguaaaaaaauuagcugggcaugguacugcaccuguagucccagcuacuugggaggcugagacgggaggauugcuugaacccagaagguggagguugcaguaagccaagaucgugccacugcauuccagccugggugacagaucaagacacccugucucaaaaaaaaaaagaaaccccacagauuuaagucaauaagaauagucaauauagaucaagucaagaauagucaagacagaucaagacacugucuccaaaaaaaacaaaaaaaaggaaacccccuuauucagucaauaagauuuagucaauauagaauagucaguaagcucauucuuaggccagacuuguggcaaauuaacgggaauuuaauccaaccccuaccuuccaaagagccaaaagaaacagauaguuguaguaucuaauugugaaauguuaaacuaucuauaaauuccagacaaguauaaacauucagcaaaccauuaucacauuuauuuuacuuacugcaccaccaguagcaauagccauaucuuuaagcugguucuuucuauugucaccaaacccuggagccuugacugccacaaccugaagaccaaccuuuagccuguuaagaauaguugauaguaagauuuaaaugaaauaaaaaugccuaucuguuuaauuccccucaagcuguuacuagauuacuuaggacucccuaaguaaucugguuugguuuuuguguuuuuuuguuuuuuuuuugcuuccuagcaauuuuugaucaaauuaagacaggaaguaucugagacaguuuaggcuauuuucuauuaauuauacuuguccauauccguuuaccuucuuaauaaacuguuggccuggccgggcguggugacucaggccuguaaucccggcacuuugcaaggcccaggcagguggaucacgaggucaggaguucgagaccagccuggccaagauggugaaacccugucucuacugaaaauaacaaaaaucagccaaaugugguagcaggcaccuguaauccccacuacucaggaggccgagcagcaaaaaucacaucacaguaaguuauaggauacagugauaacuauuaugaaugguagaaaaacaguaauuacuaaauauuacauuugagggucauuuaauaaacaucuccauauauuaaugcugaguuuugaaugagcaauguucugaauucacuucuuuuauaaauguuauacaaaaagcugacaguauuguuaagcucaccugaaauuuuuaccagguaaaugaauacuuggaauguguaaucaaauguccauuugagagcagauugugaaacagaagcaacguucaaacuucaagacagcuggucuauuuuauuaaggacccaaauaaaaaucagaggaauaagcuauaugcuauguaaacuggauaucccacuuuucaacuagcaguaaaauggcuuaaugaaaacucuguaggcuuguuuuuuucuggccucaagucuuuuuuuuguguguuuuuuuuuuuuuuugagacagagucuugcucugucgcccaggcuggagugcaguggcgagaucucggcucacugcaaccuccgccuccuggguuuacgccauucuccugccucagcccgccaccacgcccagcuaauuuuuuguauuuuuaguagagacgggguuucaccguauuagccaggauggucuccaucuccugaccucaugauccacccgccucggcuucccaaacugcugggauuacaggcaugagucaccacgcccagccaagucuuuucuuaaucccuccaaaaaagcaaauccaagcuaagaaaaacauuccaggguaaggcagcucauuagagcuuuugggucagaugagcacguguaaugucuaaaacguaccuguuaauguaugcauuucuacuauaacaaaauggaaagaaaagucuugcuucugacauacuucaauucugagauaaggaagaacaaacauuuuaauaaugcccuuagauugucugcagcaugaacauuaccugucuuaaaguuuaaacuaauaguaaacuauagcuuaaaauguagauuuaaauaagugacuagaccucaccuuauuuuagauugggugcuauuuucucuacuucagacuauuuaguaaacauuuaacaacagacuaaauacuugaucacagccaaggguaguggcucaugccuguaaucccagcacuuugggaggcugaggugggagaaucacuuaagauucaccaacaguuuaagacuagccuaggcaacauauugaggcaacauauugagaccucgucucuacaaaaaaauuaaaagaucagccaagugugcuugugcaaguguguagucccagcuacuugggaggcugaggcaggaggauugcuugaccccaagaguucaaggcugcagugagcuaugaucgugccgccgcaggccagccugggugacagagucugucucucaaaauaaauaaaaauauucgauggugaaauacacuuacaucugaguuauuuauuuagagacagagucucgcuuuguugcccaggcuggggugcagcagcacaaucucggaucacugcaacuuccgccucccagauucaagugauucuccugccucagccucugaguagcugggauuacaggcacacgccaccaugcucugcuaauuuuuauauuuuuaguagagacgggguuucacuauguuggccaggcuggucuggaacuccugaucucaggugauccacccgccugugccuccccaagugcugggauuauagcugugagccaccaugccuggcucugaguuauuuggaaguuaguuguuuacuucccuguucuaugcaaaauaauauucugaaaauuuacauauuuuuaaccagaaaaaccuuaaaaaaacaaaacaaaacaaaacaaaaaacaagauugacacuugaaccccggaggcuugagcugagauugagccacugcacuacugcacuccagccugggugacagagacucugucuccaaaaauaaaaauaaaaaauaaaaaaauuacaaggccgggcgcaguggcucacaccuguaaucccagcacuuugggaggcugaggcgggcggaucacgaggucaggaguuugagaccagccuggccaauauggugaaacccugucucuacuaaaaauacaaaaauuagucaggugugguggcacgcaccuguagucccagcugcuugggaggcugaggcagaacuguuugaaccuaggagauggagauugcagugagccaagauuaugccacugcacuccagccugggccagggagugagacucugucucaaaaaaaaaaaauacaagauucagucaugugccuucaaaacaacuguaaacacuugcaaaauacagaaagguacccaugugcuaaauuagucuauucuaugagaaagcugaucaaaauaguaaagacuuugggguuccuucaaaaacacaaccauaaggauacauuagagcacaccugauuuacacaauuacaauucuagauacaaacccaacuggaucaaauguggagguacacaugauggaaacugcaaacagcaauacaaauaauucugucuuucaccgagaaauauaaaucaacaaauaccacugcuuauuaccuauucaagacgaguguacuuagagcuucuccaucaacaucuucagcgauuaugaccaaaggcuuacggugagcauuggcaauuucaagagcagguacaauggacuggauacuagaaauuuucuuuucacucaacagaacauaggcauccuggaauucacauuucugaccuguaaaaauaaugaagauuucaaaaauauacaaaaaaugacugcaauacauuuaaaugaaaagcgaaaccaagguuccaauacacuuuaaaauucaccagugaguugguuuuccuccuucauuucucauaugcauuaacuuuuggaauauauacauuuauuuuuuagaggaugacaccaacuaauaccuauaguuugacacauauuagaaaguauauuuuaaaaacuucaggaggccaaagcaggcagaugacuugaggccaggaauucaaaaccagccuggccaacauggcuaaaccuugucucuauuaaaaaauucaaaaauuggccaggcacagagccucauaccuauaaucccagcacuuugggaggccaagguggguggaucaccugaggucaggaguuaagagaccagccuggccaacauggugaaaccccaucucuacuaaaaauacaaaaaucagccuggcaugguggcgugugacuguaaucccagcuacuugggagacugaggcaagagaaucacuugaacccggaaggcggagguugcagugagcaacgcgccaccacaucaugccacugcacuccagccggggcaacagagaaugagacucugucuaaaauaauaaaaauaauaauaauucaguuauugauuuguucuuaccuuuugauguauuaauaaaguauggagaaauauagccucgaucaaacuucaugccuucaauaauuucuaauucaucauucaguguuuuuccauccuaugaaaagucaaagaauuagguauauggauuucauugaacacaaaacauggaauuacaggccagauuaauaaaaacagaccccucuggccauaagagaugcaggguagaguaugaaacagcccaggacauccaauuacacuucugcaaaaaaucccaaaagugcuuauuugaauaaucauuuaaguuaggauggauucauuucaugcagcaaaggcuaauucacauaaaacacaguaaguacuuuauucuauacaugugcugagacuacauaugaaggaauaaaaaaagcaguuuuuaaaacagaauuuuucuguuugaaaaauucaguuuugaucaucagauaacucaaacuuuugaucauaagauaacucaaaauuaucuuuaaaaauacaaacacacuugccuuuacugugaugacacccuuucuuccaacuuuuuucauugcaucagagaugauauugccaauuucuuugucuccguuugcagaaaucguagcaaccugaaauaauccaguuacucuucgaaauuaaaagguaagccuaguguccucagucaguucccuuaccuuuuccuaguaacuuccaaauugauacuuccauccaggggagagaaggggaauuuacguuaugguaguuuucaugaaguacugguucuuugcucuuuuccgauucauuauuugacuacauuguuuugaagaauaugauacauaaaacuauucuuguaacaaaaaguuuaaaaaugcugacuucauuacaaacugacaaaacuuaugcaccuuugacaauggcuaagaacauuuucacaaucauaugaauccauuuuacagccauguagaacuaaaaugacaaccacauguagaacuaaaugacaaccauuauggucauaauucuuuucaaagguuuuagcaguaagaaacaaugauucuaauauugaugauuggguaguauuguuauucugacauuggugugaucaagggaaaaaaaaaaucacacaugccauuaaauuuuuuuuaaaaaacguguaacauguuaaguccuuaccugugcaauuucuucagggguggucacagguuuagacugcuuuuuaaguucagcaauuacagcaucaacagcuaacaucacaccuaguucaacgauauaugucauuacaauguuuauuucucucauggcuucuaugucaaguagaaaucuugagauuugugacaaauauuuuaaugccuuaacuuaaaaaaaaaaauuuuuuuuuuuuuugagacagggucuuguucugcugcccaggcuagagugcaguagcacagaucauggcucacugcagcccugacauccugggcucaagggaguagcugagaccacaggcucaagccaccaugcucagcuucuuuuauuuuuguagacaaggucucacuauguugcccaagguggucuugaacuccugggcucaagcaauccucccaccucagcuucccauguagcugggacuacaggcauguaccuaugcuuggucuuuagugccuuaauauuaaauuuacacacagcuucugagacagugcuucuuaauaacacagaguugcguggcauguacuuaaacaguaacuuuagguucacacaguaaauaaaaucucacaaugccaaaauuuugaaaauaggacuaaaacaagguagauguguguaguuucaaaagucucaccacugaacucauccuaugcaaauuccuaacccaaucaugcuguuuccaauaggguccacgacacuucucauguccauuagaugaugcaaaaaaggaccaaaauggcuaacacucccuuauuuucaacaagaaguacaguucuuaaaugauaggaaucuguugugacuaugccucugcaggugucaauuaucugaaauccccucaauuuaguacguauuaugaacuaacaaaauauuuuuguuuuacaucagucuuaauagucccauuuugcucaauugggaauagugcuagcucucuuguuugagaacuguuacuucaaaaaaaauccaaugcaaggugcugguaaguccucuucauaaccuuaauuaauacuuguuagugauuuacaguaaaacugcuuuuagugaaguauauucacuuggcccauaaacacugaaauagaugagguaaugauacauuaguaauguaguaauaaauuaguaugccaauucugacaaaaaauuaccaauagcuccccccaccuucacuuacaagaggguuccugguuugaacccuaacauacccuagauauacauagcaauucugcugauaggaaaaccaagucuuagcacacagcuaauaaaugacaaacaugggacuagaauuuaagucuauacugccaugaaccucaugaggaggagcaaauuguuaauuaaguugcacucuaguuacaagcacuaacaaaacacaaaccaauaacauggugugugcuauuaagaaaaaauaaacugaggaaaacauuacuuucugacauucugaaugauccaguguauuuagucuuacuuucuacaaaacuaaacuaaaaauuagccaggaaugguggugagugccuguaguagucccagcuacuuggaggcugaggcaggaggauugcuugagcccaggaguuccagugcaguccagccugggcuacagagcaagacccugucucuaaaaacaaaagaaaccaacuaaguaaaauaucaaaauuaccuaacaguaccuacccaccauacagccaagcuugcuaaaggaaaacccaguuuaagauuucuccaggccaagaggaggaaugagagaaggauuaauuuccucaaguuaacacuuuccuuagguccaaggaaucaaugccuuaaagcacacugaaguuuagaacacuguggugacaacagacauuccuaccucuccugauuuccacuggauuagcaccuuugcuaaucuucucgaagccuuccuuggcuauagagcgugccaguacaguagcagugguagugccauccccagcuucuucauuuguguuauuggcaacaucuugaacaaguuuagcuccaauguuuuuguauuuaucuuuuaagucaauugacuuugcaacagucacaccaucuuuuguuacuuugggacuuccccaacucugcucaauaaucacuguucuucccuagaagaaaaaaauguaacaggaucagacauacccuaaggaugauuuacauuuuuaaaaaugagcagucuucauaauaaagcaacuacuucaaagucucaacguaaguugugucauuuuuaucagucuugcagcaugaaccucaagggcaaguuuaucgacauucuuugucuacagacaaaaugaccugauucucugccaagagcauaauuuugaacuagguaauuuaggagauuaaaauccuagggacuaaaacuugucaucuuauaaaaugaacaagaacacaagacaaagaauaaaacaaucuuccuaucacuuauacuuuaguuagugccuguuaucuuuuaaaguaaugugacuuguuuuaaaauccguuuaacuaaaauauuaaccaucaaggcaaguagcgugcucuuccagguucacgcaacauaaaacuucaaccauggcacaauuauuggccauccuuuggauuugaacuaaagcugcuacuuucuauuugugaggugugcaaauguuguauuuuaggcaguuguuggaucacuugauaucugaacugucuucaaacugaaaugaagcaccacuugacugcacaccaccuucaaaggccuccucaaaacauuaccccuauuaaaugagacuuauuuuaaauaugcuuuggaacaagagaacagcagaaaaccgauggguaaaacuagcaucuugggguggaggagagaaugggaagcuacugucuaaugaguacaaaguuacaauuuuuccauauaaaaaguuuuggagauggaugguggugaugacugcacaacauaaauguaauugauguccccaaagugcacacuuaaugguaauuuuauguuguguacauuuuacuacaauaaaccaaaaaaaaauuuagcaucuacaagcacauaccuaaggaauuauggaagauaaguuaaacucuucucucuacacuuggcaugaacuacugggaaaggauccaaauuuuaacuuaagccagcgaaauucuaccucgaguuuaagaauccaccuugagcuguaaguuacuaccugauuacaucacacauugaacaaaauaguuucgaaaaucuggcugaagcaguuuaagcuuuaagaucaugucuaagaaaaaaaggcuaaccaauacuucagaauucuuacauguaaacugaguucucucaaaaauggagaugaaaguacuguugaauaguucagugcgacuauuugugaguaaaaugcuauuaauaauaccguaauuacaauaaaauaaaaauacugguaccuuuggccccauuguaacggccacagcaucggcuaaaaggucuacaccuugaagcauuaaggcucgggcaucugcaccaaauuuuacaucuuuggcauaagcccgagugagaugaggagccaguacccuggacaccggucucaucuggcgaaagacuguggguaaccgaagcauuucuggggauggaagcaaaaagaucaucagaacuaccacccguggugcgcugcagaacaaacaugcccaccugugcaacagagcaagcaacgugagaugcugagccuggcugaccuccgccagccacuacgccugaaugacggaaggcgccgcagcuucggaacaucagccacuagcgcaagcuaaagaggccgccccggccggcgccugaccuauagcaccagcacaaagcacaugcggcuccuuccccacggccaccuaucccugccgccaaaaacgaguuaaucuuucaccgcgaaaacggccuugugggcagacccacuccaacuguggccccugagaaaccaagucagccggagagaggcaaguuacaaauccaagugaccagggaaguuaaaaguauuccugacggugcaaaaagccgcucagcaaagugucuccauggauccacccaaggcuacuguaucagagcaaccagcaaggccgcgaugcugggggcggcggcccggcccacucggcgcgagcccacguguccuucuuuccgaacgcccccagcaaggucaagacuggaggcgcgguaucccagcugccugcgggggaaaaaagcgguucccucacguacaccacccuccccgguucccugaagucggccaggcgcagguugcaccagcgggccuaagugguuacaaucccccaaauucaaaccccacgaguugucccucccgcgcccagccgagguccaggauccgcgucgcacgugauggaacccgcauggacccgcgaggccuggacccgcaggccugggccugcggugcggcgcggugcggaacuccagguugucgccgcccgcacccuccagcuggaccgcagaggaggaaggcccacucgggggucgcaggagccggggggagguggugcgggaaggccgcguaccugcggggcggcggcaaggcgugcgcucggcgagacaggucgucggcggcgagugagggacagagugcagggcgcacaccgcaaugagcccguguccccucccuccgccucuacucccgccccgcggcaccgcgugugcaggcagcucccacccacuucccgucagcccgggcccugcaaucugcacacccugcgcgcgagccccgccccucccuacccgcgcagggugugcuagcgcgcucagcccucuccggccggcuuagucuaguucccgggccucgcucgguuccagaacuuuccagaaaaugccgcgcucccuacggcucaagggucaaaucgcgucauuuccgggaggggacgaagggguaguucuuucaccucggcugggcgccuagaaaagccuagaaacagcuccuuuuuucuuccgccuccgagucuucgcgucagcguccugcgcagggcccuuggggcgaaucg

SEQ ID NO: 12712 - RNA, 803 nt, Homo sapiens
gaugccgaaaggaaagaaggccaagggaaagaagguggcuccggccccugcugucgugaagaagcaggaggcuaagaaaguggugaauccccugcuugagaaaaggccuaagaauuuuggcauuggacaggacauccagcccaaaagagaccucacccgcuuugugaaauggccccgcuauaucagguugcagcggcagagagccauccucuauaagcggcugaaagugccuccugcgauuaaccaguucacccaggcccuggaccgccaaacagcuacucagcugcuuaagcuggcccacaaauacagaccagagacaaagcaagagaagaagcagagacugcuggcccgggaggagaagaaagcugcuggcaaaggggacguccccacgaaaagaccaccuguccuucgagcaggaguuaauaccgucaccaccuugguggagaacaagaaagcucagcuggugguaauugcacaugacguggaucccaucgagcugguugucuucuuggcugcccugugucguaaaaugggggucccuuacugcauuaucaaggggaaggcaagacugggacgucuaguccacaggaagaccugcaccacugucgccuucacacaggugaacucggaagacaaaggcacuuuggcuaagcugauggaagcuaucaggaccaauuacaaugacagauacgaugagauccgccgucacuggggcggcaacguccuggguccuaagucuguggcucguaucgccaagcucgaaaaggcaaaggcuaaagaccuugccacuaaacuggguuaaa

SEQ ID NO: 12713 - RNA, 465 nt, Homo sapiens
ggggugaccuucagcuggccauucgggaugauggacuuuccaucccagaaccauggcuccauuuguccguaaccuuguggagaagaccccagcacuggugaaugcugcugugacuuacuugaagccucgauuggccgcauuuugguacuacaccacgguugagcugguuccucccaccccugcugagaucccuagagcuauucagagccugaaaaaaauagucaguagugcucagacugguagcuucaaacagcucacaguuaaggaagcuuugcugaacgguuugguggccacugaggugucgacgugguuuuaugucagagagaucacaggcaagcguggcaucauuggcuagaauguuugaagaccagucuuaacaucugauuauauuugauuuauuauuugaguguuguuggaccaggugugaucagacugcuaucugaauaaaauaagauuugucagaaa

SEQ ID NO: 12714 - RNA, 3993 nt, Homo sapiens
ggccggcgcucggggccgcguuucauuggcuuuccggccggaagcugcggcgcgacccggcugcgcaugcgccucucacacgugcugucagaacgccgccuccuccgcuugcggccggucugcaccaugcugcgaacguccguccuccgccugcuaggacgcacgggggcuaguaggcugucucuccuggaggacuucggcccacgcuacuacaguucgggcucccucagugccggcgaugaugcuugugaugugcgcgccuacuucacuacacccauuuucuacgugaacgcggcgccgcacaucgggcaccuguacucggcacuacuggcggacgcccuaugccgccaccgucgccuccgaggucccagcacggccgccacgcgauucuccacugguaccgacgagcacgggcugaagauucagcaggcagcagcuaccgcgggccuggccccgaccgagcugugcgaccgagucucugagcaguuccagcagcuuuuccaggaggccgguaucuccugcacagauuucauccgcaccacggaggcccggcaccggguggcugugcagcacuucuggggggugcuuaagucccgcggucugcucuacaagggcgucuaugaagguugguauugcgcuuccgacgagugcuuccugccugaggccaaggucacccagcagccgggcccaucgggggauucguuuccuguaucucucgagagcgggcauccagucuccuggaccaaggaagaaaacuacauuuucaggcuuucccaguuccggaagccacuccagcgguggcugcggggcaacccucaggcgaucacccccgaaccauuucaucacguaguucuucaguggcuggacgaggagcugcccgaccuguccgugucucgcagaaguagccacuugcacuggggcauuccggugcccggggaugauucgcagaccaucuauguauggcuggaugcccuggucaacuaccucacuguaauuggcuacccaaaugcugaguucaaaucuugguggccggccaccucucauaucauagguaaggacauucucaaauuccaugccaucuauuggccugccuuccuguuaggggccggcaugagcccgccacagcgcaucuguguccauucccacuggacagucuguggccaaaagauguccaagagcuugggcaacgugguggauccuaggacuugccuuaaccgcuauaccguggauggcuuccgcuacuuucuccuucggcagggcguccccaacugggacugugacuacuaugaugaaaaggugguuaaguugcugaacuccgagcuggcagaugccuugggaggucucuugaaccgaugcacugccaaaagaauaaauccuucugagaccuacccagccuucugcacuaccugcuucccuagugagccaggguugguggggccgucaguucgugcucaggcagaggauuaugcucuggugagcgcaguggccacuuugccaaagcagguagcagaccacuaugauaacuuucggauauauaaggcucuggaggccguguccagcuguguccggcaaacuaaugguuuuguccaaaggcaugcaccauggaagcugaacugggagagcccaguggaugcucccuggcuggguacugugcuucauguggccuuggaauguuugcgagucuuugggacuuugcugcagccugucaccccaagccuagcugacaagcugcugucuaggcugggggucucugccucagagaggagucuuggagagcucuauuucuugccucgauucuauggacauccaugcccuuuugaagggaggaggcugggaccugaaacugggcuuuuguuuccaagacuagaccaguccaggacuuggcuggugaaagcccaccggaccuagaaacucaguucuuaccggcuugugguaaaaaagcaaauguguuaucuuuuuauuuuuuauuuucaggaaaguuauacuaguauuuucuuaaguguggaaucaaaugagcacauaagcugugucccugugaaaagagguuuguagccuuucaggugccugcuccuauucauuucucugugaccauugaucacuguccuuugugcauugugugucuaagaugucuucaggggaaagauggguaagagacaguguugcuaaugcuguuccuucuuugugccuccuuccaaaccacaguuauuugcccaaacuaccucucguggcugguuuuucauuggccuggccucugcuucucaggcuaauuagugacuccuuucuuugagggucaggguuggaggccccuuacuggugguuuuacagggggauccuacuuuguuacacauguuggguuuccugauaaaaagagaguauuuuauuaaacccuugaaccaguguccuagaccagaugauuuuugcccauguguauccccauuuaaauuccuacaacuaagucucccugcuuuguuaauaguccaacaguuggguuguguaacaucacacuucaaccgguagauggcucuaaucucacacauuuacuuacuaaagauugaggauucggaauauuuagaauaaauuaguuuucugcuuucuaauuuugcagaucuuuacauuuuuauugcuuuucuuaaaauaagggauagcuuugcaaccacuauuguuuuaauggaaagcaaaaaacccccccaaacuuaucagaauccucguucuuuuucagacuacugaaaaaugacauuuacucuguuaaauguuuaauaagugaauaaguaaauguaucaaguuguuuauauaauaaauuauaaaacucuugaggcacuugguauguuaaaaauuuuaaacuuuaguaacauuagguuacagguaugauuuaaaaauuuguaaauaguucaaaagggcaauguuuucuuuauauuucuuauagucuuaauuuuguuauccaugugcauaauuuaccucaugauuucuuuuggucaaucaggaucuuuaauacaauauagaaauuguguaauaguuauuauaaauguuaauacacaacuuucagguaauuuuaacugauuauuucuuuugcucuuuuaacuuaaguuauuaaaguuuaaaaguucguaaguaccuuauucagaucuguucuguugcauucguugaaggugauggugaaaggaggaacugaccaaugcuucaggaaucucagacuggauuuaggaaucucucuaaggcuccauaagagaacaucacagagaagauguuagcaauuuauacagugauuacaacauaguaagccaguuaugucucauaggugauuagacagcugggccaaaguucaaaaugagaacuugccuuggaauauacauucuaaguaugguagcaaguagagagggcccacaaugaauuaaacuauuguacugguaguuccccuggauuuauucuaggugccaccauucaguuccaguuucuguuuauuaaucagcgaaaugaggaauuuuugguugcuggaauauugcuuagaagagaaugcuugaagguauucuaaagguggaaggacuguugccacaaaugucccuucagacccuucuuauucauaagucugggcuuuccacaugacauguucaaguuaacugcugggguuauuagcacagacuacuggggcauaggauguaggaguguaauaucuccuacagguggauagagcagagaguggaaaaagauaauauguauuuacguggaugaaggaaaacauauuugaaaaccagugagaugauaaccucugccucugaagugcucuuauagcaguguuacaguuccuaccauggauggagacagugucuucuacuugaaugaucuuuccuauagccuugugcuggucaauacaaucgaccuuugcuugcuggagggugucaauggaguucuuuuagugcagucugucauuugugcaggcacuuagcuggcuaccuggauauuugugauacuggaggacacaagaacauaggggaacca

SEQ ID NO: 12715 - RNA, 7336 nt, Homo sapiens
uugucuuuugucagaaagugaauaucaauggaccuaaaaggguguagacauauugacagauuauugacagauuauuauuauuauuauacauauuauuauauguauaauaauaauauguauuauaugauacauauauaauauaauauguauauauauaauacauauaauauaauauguauuauauguauaauaauauguguaauauuauacauauuauugucaauauguagacauauugauagauucuagaagaaagcccuugagucucuuggaaaacuaagauaguauaauauauguuauuucagcacaacaaaacucacccugccccuuccucuugcaggaaguuuggagaggauuaguuaacucuuaucaagaggaacacaccaaauuuggagguuaacaacaguuaacaaccaaguuaauuaagguuaaugggaauuuuaaccuuuuaggaagaguaucuuauucuuucuggagacaggacaggagaagcccugguuaaacuuccuuccuaugucaccaauaacuacuuugagcagaggggaagggacuaaccaauuuagaggugaaauuagcugcuucucuuuaguagguagucuuggguuacccagaauagauccucugaauuaaaggaacuaccuagcaggaaacaguuggccauauuuaaauaguuuguuuaggauuguaucacauuaguuuccacuuuucaugaugagggaagggaacuagaaggaacuacacaccaacaggaucuuccuauggccccgacaacuagaaauaauauauccucuaccaugccucuucugaugaguaccacuugggagguucagccauacuuggauguucaccaagguaagcaaggcauaguacauauguuucauccuuggccuugagcugaauuguacccccuuagcuaauggcacaguuuacucaccauggauuuuaaaguccacugcuccucacuuaagaacaggauggugugagauguucaagauguuucaggaaaccaagugugccaucugcaagaagaaaauuauagcuccaaggagggaugagcccugcccuugagucacuucuggaugaaacaucugcagagggccugacucacuggguaagcugaagggacagacccaggaauaacuauggaaauggaggaugccuuucuuagauuaugaugugggagaaaugguacuaacaccucugugcuacugcuauuaaggccaugccuuguacauguacccucauuaguugagaaucaauuguuuaugggauuuaacaugaugaugaagcuucaaaaacuagauaaugauuguuauagguugguaucaucauauuauucuuuuaauacauuccauaaaaauaugaccaauuacacauuuuuuccugauuguauauuuuuggaacacauuaaauaaaauagcuucaguaguuuggcuuccuuugaaaccagucuagaagcuucuauugguuaaaaagcuauagauauuaaaaauauaaaguuaauaaacaugguauacaucuuagauuaaucacaaaauaauacaaauggaauguauuucuuucaagccagaugaaaagagaagugaaagaaaacaauccaacagaagccaggaaggaacaaugcaauagaagacagguaggagaaaaaagaggcaaagaaaaaggaaaaauauuguaaauagaaagcccaaaauaaaauggcagaaauaaauacaaauaugucaguaauuguaauaaaauaaaacuucaugagucuucugucaaaagacaaaacuauucaaaauuaaauuuaaaaagcaauauauguaguuaaaagggauauacuuaaacauagaagaaacuaagacauacgaagaaacacuaggcauauauuaaccaaaagaaagcugguguagcaauauuaauauuacauaaucuauacuagggggaaaccauuacuaaaaagguggaauuuaauauaaaaggaguaaugcaccaaguuacaauuauaaacuuguaugaccuaaccacauagccucaaaauguaaaaagcuaagauugaaaauuacaagaaauguucaagucuauaaaaaaaaaaaaaggcccacaggguaaaaguauaacaacucauacuagacauuagcauuucagucuuuaaugcuuacuacuaaguguaucaucacugcuaaauguagggaaaaaaaauuauggcagucaagguuucgugacucuaaaacuuugucuuuuucuaucuauaccucugugaaaauaacagcuugcuuuuugaauauaacugucagccaaauauaucuauucaguaaguccucucuggguuaccaaaagcggggaaucacauggccauaauuuugccaaauuuucuguuaguucaguaauaaguugaggggagagaaccaacaguucuguuuuccuuauuuguguucucucauuuauuuuucccuugagguauucagcaccuuaagguacucuucuuguguuuaacccauuuaugccugagguugcaauuuuuugaauuuuugcaaucagaccuuggcgaagaccuugagcaggauauaaaauaacccccacaugcuuggcguuccaauaauggaacucuagguauaaaugggcuaaugagaaacggagguacagagauuaagcaacuuggcuagcguuauacagcuuguaaaacaggagagccugggacucaauccuguguuaaugccaaagccuuagcaccaccuuuaguaccaacaccacaaucagucaauauguauauacugagggcauuguuuuaaguauuguggggaagaggaaguaguauaaugagauuuaaagaucugaagaugaaaaguccaaauaagaaccuugaacugaaauagaucaguuaguguuucaagaugaggaaucuguuuguugauagccagauuaugaaacugaugagugccaaaauagaaauucagaaaaauauacuuaccuuuaucaugaaauaugguauauuucacuuuugcuuuuaguauuuucuuuuauauccuaaaucugcuuaugugugcugugcaaauuguuaaaauuuuaaauaacuguauagucccuauuuuuguuuguccuuguuuucuuauuuuguuucuuaauuuuagaaugauguuccaauuucuagaaucuagcaguucucuaagugaaaguauauagucauaaauucaugaaucuaaguauuuuuuaaugauauuuuacuaauuauuuaaauauacauuuaucucugaacaugaaaacaucaacauucaaaaguuuuauuugaauuaacuauuauagugacaaagccagauaauuuuauuagaggccacaaacacugaaacuuuuucauacauacaguuuuaaugcaaaugaacuuauuaauaugacauccauuuauuaacaauuuaaguucuaugaauuuaucgaacauuuauuacuguauucuuauaucuuuccuaacaagccugcagaaaccagauuaaauauccuugacagugguuauuaccaaagcaaauaccacccuguuagcuaaaaugccacagauuggauaauuccugguaaauuaaacaccucauaucacaguugagauaagcucuuauacccccaaacuaagagacuuuacuaugaauugcauaaugaauacacaaugcuguauuuuacauuuuuucugaaguguagcuauuuuguuggacaugaugugucuuugaagaaauguguugaaucuuauuuuuauauaggucucuuagcuaucaucgaaaauguauuuaaaaaauaucaaaaggcauuaaaguucuugcuaacuuggaaggccaggaagaccuauauuuuuauuccauguuuaaauaauuuuuuucaggauucugucuaaaugcaagcaguauagucccacagcaaagcaugaugggugcuuuuucaguuuuuuuuuuugguauggcagguuacgacuuuuugacagaaucagauugauagaucauacaaaauguccuggguagcauauuuuagauuaccuuuaaaacucacuuaaggaauuuauaaaggcuuucucuuuuuuuuuuuuugaggugaagucucacucugcugccuaggcuggagugcaguggcgugaucucggcucacugcaaccucugucccccgaguucaagcaauucuccugccucagccuccugaguagcugggauuauagccaccugccaccgugccuggcuaauuuuuguauuuuuaguagagacgggguuucaccaucuuggccaggcuggucuugaacuccugaccucguaagguaagaaaggccucccaaagugcugggauuacaggugugagccaccgcucccggcuuauaaaggcuuucguaaagagucuucaauuuugguaaauugaaguuacugcauuaauuuuuuacauuuaaauuucuauaaaauuuauuuuacagaaacauccuauauuuuauauaaaaagcaaaacaguacugaguucuguuugauuuuauaaguaauuacuggaacauuauaucaaguuaaaaugugugagaagccuauugauuuauagaauaaaauuauaaguacuaacauaagcaaauuuuugaaaauauauaugguuaauugcaugaacgcugaugauugcauuuucgugccauuuuaagaguugaaaaaaguauuuuuuggcuuggcuauaaaggaaauauuuuuaacauucauugugauauuguuugaccuacuacaaacaauaauaauaguccucaaaauaguaaguuuuuucuuauuuaaauguuauguacauaaaaaucagccucuagaagguaguuaauucauaacaaauuuuaaauaaaacuuuugguuguaacugauguccuaaaauuaguuuuuuagcuuaaggagaauauguagcacuucuuucuuuuuccauaauccauggagaugaucuaaaaguggagcuaucagcacuggggcauaaaaccaauauaaauguauaacuguguagcuauuguaaaaauugaaaucaguaugauaucaguuagaaaaacauaggaaaaauagugaaaucuuauugcuuaacacagaguagagagaaggggacuacccaaguuaaaccaaguuaucgaaacucauccuugguaaguugguugaggcagauguuuaaauauucaguaugugaagguagguaggugagucugagcucaagaguuuuaaacaaauugucuaaacagcuagggcauaagcaugaaaaucuauuugguaaacguaggauuguugcugcauuuauguucauuuuuccuuagacauaaggaaauagacaacauuaggauauuaaauauguuacuuuaauugaaagcuauucucacagacaguuggaaauagccugaauaaaauaaugcuaacagguuaacugaagucaguauguggguaccuauauagggcaggaaaaauuuacacguauuaguaucuuuuaaaauacuaugcguaauaguucagauacuaauaaggauuuuaggaaauuucuuuuauguguugcuacaaauauauaaaugaauauuguguagcuuuauuuugguaucaaaauuagacauguuaaaagcaaagauccugagugugauuagcaauuaauacacauuguauuaaaaucaucucaaauuguuaaugaauacuuuaaaauuaucauccuuuagauguuuucuccaaaacaucaaaggaaaaaaagguaugcuuuuuaggcaauacuuuuuauaguaaugaaacguuuauauacuaucauuguguuguuucacagcuguaugagguuaaagaugaaaguuuagucucgguaucuucauucauuuuuauaccaugauuuauaaaaaugauguugauaauuaaaaguuaaagcauugaucuuuuguaguuauuaaagguauuuuugcuaucauggauauguuauauuacaaaauaagagccaaauaucacaauuuaagcagaguaaguuuuuuggggggaauacauuaauaaauuuuccuaccaucucuguucuucuguacuuuauaguuuggagugagaaauaaaguaauauauaauauuuguagaacugaacgaaaguaauguggaagcacaucaauacauuuugguaaagagccaauugccuaaaauagcuaagaaaaacacuucgauaucaaucuuucuugaacuaauauacaaugacucucagacucuuaaaauuuacagaugguguggaacaaaaaugccuuguuguacacuugaauaagccugaauaauaaauauaggauuaacauguaugcugaaaacaucagacaagcugaauaugaaauagauuguuucacgauauuuugacuagggcucuaauaacacucuacugggguuguucuacacagcauguuauuuuaaaaauaacuggcugggcgcgguggcucaugucuguaauccuagcacuuugggaggccgaggcagguggaucacgaggucaggagauagagaccauccuggcuaacacggugaaaccccgucucuacuaaaaauacaaaaaaauuagcugggccugguggcgggcgccuguagucccagcuacucgggaggcugaggcaggagaauggcaugaacccgggaguuggagcuugcagugagccgagauggcaccacugcacuccagccugugcaacagagcgggacucagucucaaaaaaauaaauaaauaaaucaaaauaaauuaaaaaaauaaaaaauaaauaaaaauaacugcagaacucaggccuguaaucccagcacuuugggaggcugagguggguggaucaccugagaugaggaguuugagaccagccuugccaacauggugaaacccugucucuauuaaaaauacaaaauuagccgggcgugguggcaggcgccuguaauccuagcuacucgggaggcugaggcaggagaauugcuugaaccugggaggcagagguaggagaacugcuugaacccgggaggcagagguugcagugagccaagauggcggcauugcaagccagccugggggacaaggcugagacuucauaucacaacaaaacaaaagaaaaaaccaaaacagaacaaaaaaacugcaggaaaaaaaauuaaauaguuggaguggccuuagggugugccaaaauauucuuuaauauaacuaugccauuacauuuuauuccuuaaucuaaauauuugagcucagaaaccuuaguacauuaucuuuuaugacaagguaaaauaaaaucaccuaaaguuauuauuggguuaucuuccuaauauuaugagaagauuuuuuguauauaauucuuauucuugcccagcagaaguacaaaucaacuuuagaucuuagaauggaugugaaauuaaaauaguaa

SEQ ID NO: 12716 - RNA, 2168 nt, Homo sapiens
aaccaguuuaaggaauguggagauuuauuuacaucaaauucagauaaagagguaacagcggacuagaagaagcaagcagagcaugacuuaaggagucuaucuaugacuguaucuguggaacugcccuuagccacaaugaaagaccagcaaaaccagccuucagcauaacccuccugccugguaggagaugggaaggccagacuucaccccucaagaucgcccucccacgcgcauuuuccaccucgcagcuaagaauucaguccagacuuccgaucauggcgccacgcacgucaccuucuccccucgccgccagcaaaaucccacccacgucggcugaccccgcagcgggguguaagggcgggagggaucccgucuccuauacuggucgcuuguacaaaccagauccaaaaaacgcacuacacaaauccuuggaaacugcgguaccaacgggaucuucucaauuccuugagugcaaaaugaucccacucucuaucccgacacaacucuaacuccauuuuccuuucacgugcccuaaaaagcccucaaggcccccagccuuggugaauccaggcccucucucggggugggcaccgcgcuguacggacagacgcgcgcacgcagcgggacgauuuauagaauuaaaagucuuuuuuuuuuuucuggcuucgcauccuugcaaauacucaauauuccugucaacuaagaaggcuaagggaaugggcgguugaggaaagcaggacgucgauuacagcgaacacaucaaagggguggucuuuccaauuccggcuuuuguuugagucagaggggagccugaggaggccaaggucuccgguucugggaaaggcggguccauccggauucuuugggcugcggagagggagguuccagccccgugaaacaacagagggcaguucugccccucgaggcuuuccuccgagaguacugagacggagacgccucagucgggagaaaucccggaacucggaggagucugcugaacgccgaacaaaaggauguggccgucgucucuuaaacaaauacgcgaaucccaagccaugcacauuuggaaggcauguguaugugugugaaggagaaaggccaccgcugcccaccgcagccccacccagcccucggccauucaccggagagacgcgcugcgguggggccucggagcccucagccagccccgaacgaggggcggggccgggcggggccgugagcgcgcaggcgcagugcgggcuucaucccgccgccggcgccgccgccgccgccgcccgcucugcaccacaggcuagagacagacagggccgggaagagccggagacugaggaggaggcggaggcggcggcggaggcggggcgacuccggugaccgggagcgccgcagacuggcagcugcggcgacuccccccuuugugucuggucugcucggagccacuggaagugccucccggagggacgcagggugucucgccgccucccugcccacccccuuccccggcuaccuucauccgcccucccgccgccccccgcccucgguccgcgacgcccgaguuccgucaggagcccagagcugcgggagaacgaggcggcggcggcggcggcggcggcggcggcggcggcagcagcagcggcuuccucgggggguugugauucgcucacaggagccauugacgggagaagaggaggcuuucuugguggaauuuaccucaggcaagaucgagccgcaggaauaaaaagcgaggaagggaagggagcgccgccgggaggacuagaaggggcagccucucacacccacuccgccugccgucucggggagcccggaccggggccgcgaccgcgaccccuccccucccccgcuccuaccucuccucagccuucgccagggccuccccaacccucucacgguuguucugcgaaggcguggggacugugagcuuguccauggaggcaggcaccuuuuuugauccagucaaggaagaggauuuguuguuuucgaaaucagagugaaggaagcaccgaagcgaaacuuaaggaauccugccuucccggagccgcgggcgaugcgacuagggcugccgggcgccgccgccgcccguccggcuucguccuucccggcagucgggaacuaguucugacccucgccccccgaccccggaucgaaucccc

SEQ ID NO: 12717 - RNA, 3289 nt, Homo sapiens
auaaguguuuaaauuucucuaaaaacuauuuacuuauaaagguaaaaaagaucucuuuaggcuucaguuucacauaucuccuuuaaucuuuuuuuaauaauuucuagugaugggaugauuaagagacuauuaaagcuauuaccucuuuagagucauguucaaaauaauuauuagaucugaaaagggacuuguggguuuuguuguuguuguuuauccuucugcuucuccaauuuguguuguaaauucauguuuaauuuuguguucccucauugcaguuuaucaaaguacauucuguauauuuucugugguuuuuuuccuucaguuuuaauauuaaauuauuggauucuuuuuuucaaaugacuucugucuucauuucauguauaaaauauaaauuucuuauauuuuaauacugguaccaaauucucucacucauucacuuauuuuguaaauccuuagcuuaauuacugauuacuuuugcccauuaggaauugauauuuuuguuccacauaaaggagagaguuaauagaaacuccuaagacaaugcacauuuuuuccucauuuauucaguuaaugaaaaugagcucaagucuaacagcuauuuuauuugauguagaaugauacaaauauuauauauguuuuaauuaaaaauaauagauuauaauucuuuuacuguauaucaaagguuaggacagacagaaggcauuuuuaaaauauggcuccucucuagaaauacucugaccccaguucuuacgaguucaaauuaggacaccauuaggagauauuugaguggcuauccaguagaguacuuugaaguaaucuagucgccuuauaaaacuuaaaggaauuuauuuuugucuuaguagugaccagucuaaucuggauggccaauggcuuugcaucacucauacuucucaugcuuuucuuuauucaucuccaugggaacuaugaaauaacaauccuuagauauggaauccaucugaucuuugcccuuuugcuguugauuuuccuuuuccugcugaccucagucuuauaccuuaaguaagugagaccagguaugcauauuaaggaauuucuguagucaacaaaugaacuuuacuuucuuuaguauauuucuuuuaucucaagaaacaagaauaaauacuuagaagaucaguaguugcaaaacuacuaauugcuuuucauaacucaguuuuuucaccuaauuauaguugauugguuaggaaaacagcagaaaguuaaagucuuaauuuuaaguuguucuugguggacauauuauauauaucuacaaacacuuucaaaagccuuuuauguuuauauugccuuagugcugauagguuuugagugauugaaucacauacucauauuucaccagcugucauuuagcuuccauuuaaauauuuucugcguaagauaaaauuacaguucaaccauccuaauuuauaccuguacauguaggguucuuggacuaauuucugcugugaggugaacaucccugcuuagcauuuacucuucaugucaucugauauaaugauaccuguggguggcauaauuguagguacgggaacaacuuacaacauaauuuuauuuaggcauuggaaaauuuguuaccccuuuaaaaaacguaauuuauuauuauuauucuuauuuugagacagagucuuacucugucgcccaggcuggagugcaguggcgugaucucagcucagugcagccuccaccucccagguucaaacaguucuugugccuuggccucccaaguagcugggauugcaggugugugucaccacaccuggcgaauuuuuguguuuuuuuuaguagagacaggguuuugccguguuggccaggcuggucucgaacuccugaccucaagaaaucugcccuccucagccccgcaaagugcugggauuauaggcgugagccacugugcccagccuaaaagacauauuuuacaauguuuaaaaauaguuuacuagaaauuccagcucugguuuuucuagguguauauuuguuuuauggauuaauucagccauuuaaaaugauuuauguguuuaacaguaugucacccuaaguugcccuugccuucuguucacuuccauuuuaaagcauuuuuuuaaacuaaaaagaaaaauagaaauacaucucuaucuuuuaaauuauuguaccaagaacauggaguaaauuaauagcuuuaguccuaucauuuucugucaucacuucuauucccuuuacccuagauaaucaguauuaagcuuuccaaauugauuuacccuccuagucagauucuuuuaagaucuuccaguacuucugccuuagaaauuucucauauaucaaaaguaguauuuaaagggcugugaucauuuuccuacccuguuacuagaguuucagaacaucauguucuuuguaaauuccuacggugugugauugugcguguauuaaaagaucuuuucaucuuaauuuaagaauggaccuuuuauuccuuaaauauuuuaagaaaacuuucugauauauucaagcaaccauaccuuuacauuaggaauauaaauagcugccauuauaauaaauggcauaccauagggucauguaaaaauauaacagggagcauauuacaacacugcaguuuaauucugguguuuguaggaugugcuaaaguuagagagcugaaugauuuucuuguaaaacaugauaguauaauggggccuccucccuauuauuggccaauauuacuuggugcuuuuaaggaagcacauuucuuuuuuuuuuuuuuuuuuuuuuuuuuugcuuuuugagacaggguucauuuggaaucagaaaagacuuuuccauaaguauguuuuauucaaacauauaauucuuauuaaucucaauuggcugggcacaguggcucacgccuguaaucccagcacuuuaggaggccaaggcaggcagaucuugaggucaggaguucaagaccugccuggccaacaaggugaaacccugucucuccuaaaaauacaaaaaauuagccaggcaugggggcgggcaccuguaaucccacugaggcaggagaauugcaugaacccaggaggcggagguugcagugagccgagauugugccauugcacuccagccugggcaacaagagugaaacuccaucucaaaauaaugauaauucucauuuuacuuucagaggauauuuugaggugcugaagcaauaauuuaucaauauacagauuagguauaauguggucuuagauacauauauuuaaaaaucaacagguaucucuuuuuacuuucauauacacauuuauau

SEQ ID NO: 12718 - RNA, 1823 nt, Homo sapiens
auauuuuauauuuuaaaaauaaagauuuuaaauggauaucaauguuuaauauucaaaacaugcacaauauaauaucaaauuuaaccuuaauacuuuacaugaauaugagucacuuuuggcuuuucuaaguccagccucccauucuuaauugacuugguuucagguacaugacauguaucuaaauauaaaguacuguuauaguagagguagguggaauucuaauauucccugcucuuuagauuuauauuuuauuuaauauaaaguuuauuauuuauacccuuuuuaaugcaaagcuaauauuuaguuauauguaugauuuuuaauaaaaauuacuuuacuuuuuccuaugaauuuaaaacauuugauguuggcauuuuauacaggcagguugccaaauuuaauuauguuacacuaaguuaaacacagcacuuaauuaccucaaauccagauuucucuuaaucuguguguacauaaaaggaauaaguccaaauuaauuuauaguuuaguguugcacuauagguaauauucuuuuguuauuucuaguuuuuauggaauccuuuucuuucaagauucuaaauaauaaaucguuacgucucaauagugguaauagugguaaugguuuauuauuagcuguuucaccaauugaacuacauucuuuuggagacauuccuuucuuuuuugauguugauuugcaaaggagaaaugcuuguuaauauacaaacucuagucaguuaccugugaggaugagaugugucagaggacucagacuuugguauaguuagaaaaauaauauuuuucucacuugauucugugugaaugucucuucugauacuguuuuuuaaucagaaaguuacagagcaacuuucccacaaacaaaccaauaaaacaaaaccccacaaaaaccaagagcaugaagaaaaguuuaaaucccuaauuauauacucuuuugguuuuuagguagaaacuggagcuaucaauauuuucauguaaguauuucaaggaguagcucuuuaaaaaugguuucuaaauuagauuuuaaaaauucauugucaucuaaaugcauguuuagucacaauguaucaguauuguguuuaaaggugcucagcaucacuuuuugaaaacuauguuuacauauuuaaaauguuuaauuauuuugaaauguauaggguauuaaauacaagcuucuaaaauuuucaguaucuauauuggcuuucucuaacagcucuacagcaaaguuugacauguuuuuugugugugucauguauuguaaguuguaauaucuguaggagugaguuggacauucuaaauuagcaguaaaaaauucacaauuacagcucagcuuguuuauucauuauaguuuccacauuuccaacuuccaagugaacuuuauauauacuacagugaauuauagauaaauacagccaugguggaccuuucccucaauagugauuuuuuguacaaacaguuaguauaauuaaaaggaaaagcuuuuauauuuuaugcaagguaaauguuuccuaaaugucacaaaagugauagaaaacauagcuuuugggaucugguccugcauuagaguuucuaauucugagacccaccagcuuguguuucaucuucuuuauauccugucagaauacauacuuaaucauguggguaugagaaagauguuguuuaacuuguaccagguuuaaaaaaagagguuuaaaaaaugucugugcguauauauauauauauauauauauauauauauauauauauagcaacuugauguauaguguccuuguuaccauguauuuuuuucauuaaaaauccugcuuuuuuuuuau

SEQ ID NO: 12719 - RNA, 1166 nt, Homo sapiens
aaaagagaugcuugacucucagcacucccaagaagccuuuacacacauucaaaccaauuccuucuggcccuaaaaauguagaagguggcuggaacucaaaaauaagccuauagcuaagguugcagcuuagaucuaagucaaggaucagcaaaccguagcccauaagccauguccagcccacuaccugccuuuguacagcccaugaacuaaaaauggauuuuccaucuauaaaugguugggggaaaaaaacaaaggaaaaguaauauugcaugacaugaaaaucacacgaacuucacauaucaauauccauaaauaaagguuuauuggaaugcagccaugcuuauuuguuuauauauuguuuauggcugcuuucacacuacaguggcaaaacuuauuaucuauaagagacaguauagucacaaagccuaaaauauuuacuaucuggcccuuaacagaaaaaaauuugcugauuccugaucuaugacauugaaagaguuagagauguuaaauaggaacaugucaaagaaaugaauuucaggcaaaccaacaaaggcuaucaaguagccacauuaagaucuaagucccaaaaucaagacuaagugguuaccccuagaagcaggauauagggggcaggaaaagaaaaaaaaaacugaaguaauauacaaagcagacacucuacacuucggaaguguggagguaauaucugugcugcacacugccacaucccuguaccuagcccacaucuuagugcugggcaggugcccauuaacuaguucuagaaugaaugaaguagaagagaggaaggagaaacauaaagcaaaugaaacaagcauugcauaggguuggggauaaaagaggguccccaacaaccaccugaaguuugucuucccuguguaauaugucacagguucucaaaaguuagcagaaaccuccauuugggaagcuaagugugugcccaagagacugaagaaaugacuaaauaacuaugguaacuaccccgaugcccauucaaggucaccuuuuccaccccuuccucagucaccagaugcaaauauauuuaguccagagaauaaauucagacgagauuagcaaggggaaggaaaucacauauaaagcucaugaaauaaacagcgccacuugucacugcugaucuuugauuaacuggc

SEQ ID NO: 12720 - RNA, 574 nt, Homo sapiens
caugugcgaccgaaaggccgugaucaaaaaugcggacaugucggaggagaugcaacagaacucaguggagugcgcuccucaggcgcuggagaaauacaacauagagaagaacacugcggcucauaucaagaaggaaugugacaagaaguacaaugccaccuggcacugcauccuggggaggaacuucaguaguuacgugacacaugaaaccaaacacuucaucuacuucuaccugggccaaguggccauucuucuguucaaaucugguuaaaagcauggacugugccacacacccagugguccauccaaaaacaaggacugcagccuaaauuccaaauaccagagacugaaauuuucaaccuugcuaagggaacuccucgauguuugaaccuuuguuguguuuuguacagggcauucucuguacuagcuuguugugguuacaaaacaauuagcacaauagccuacaucuguauuuauuuucuauuccauacuuuugccccacguuguuuucucucaaaauccauuccuuuaaaaaauaaaucuguugcagaugugaaaagaaaaaaaaaaaagu

SEQ ID NO: 12721 - RNA, 3577 nt, Homo sapiens
ucaacaucccacggcccucaccuuccucccucccacauuccaggcauggagauaucugguuucagagucagccccaaaucuccugccuauaauuacuuuaacuggggucucuaagguucccacuugagggcuaaaauguaguugggaaagagggccuacuggggaggucucacaggaggcagugcccugggaaaugccaaguccagacucagugccaagcaguaaccaucugcacucggggacagcgaggagcugaccauggccucugaugaccagcagguauuagauggaagugaaugagagagagagagagagagaguauguguguguguguguauguguguguucgaacacauaugauugccaguauggagaaugaaagauuaauaaugcuuucuggagaguuugaugcaaaagugggggaaacggagaaaaggcgcuaaggcuaaauccaucugcauuugcuauauuucauuagcuaaagucaggucagggcagggccaaggccuccaauuggcaaaggacaguguuauggcuuuaaaaagcugaaaccccaaccucuaaguagaucacaauguuuucugagcuuugcaguaauuuucuauggaaacuaaaaccucuaaaacauacaagcuggcccaaaugagaacacaagcaaaagauguggaagacagcaaaaccugagcacugguuugaaccaggcacugacauuugaaaugcuuuaagccuuuucacauuccuucuuuauucccuccaaaaaaaaaagucuugaguuuaauuuaggucuauuuuggcugagauuagcauaccucugacucacaggauuuaauaaauuauaguauuauugaauacauaggacaucccucuaccccagcuuacucuuaucuuuuuaauuuaaaauaguauucugcuaccaagaaggaugcaacugcuaguuuuagauguaaauaguguuauuuacuggacuuugugauauuauuuucuuaacuacacuuuacuauggcccuguugaaaacagacuaucaaguuuuuugucucuguucugucaucucucuuaagccaggcaccuuuagaguguuugcaauuuguucgaagugguugaggaucucaggcccugcucacgugagguggagugcaggggagcuaccgguuucccugcugaccugcugaaugcuaccuuccccucgaguugaauacaccuuaaggaaaaugauaacacgagggacguguaacuuguuuugaagcauuaaaaaccagcagcucuucacuauguuccauauuuuaaccaaacuacuguagacuacuaaacauagccaagccagaacauuccuucuggauuaagccuaggccacuugaggggcagccaggggugauggugucaggugagaauccugugucuugaaggaguggccuuuacaggaagagugcccauguuuucaccugcagcguugccaccagagugugcaauaccuccugcacacaggcucaggguaaacugcuccaaagcuggguuuuguguugcauacaaagucaauaaaauaguugcuaauccugaauggcagccagugaugugaagguacuauuaaagugaacaaaaacuagauugcaacaguuuucuuuccuugcuugaaguauaacacacgcuccauuugauccugccugaaagaagcuaacauuauauuugugacagacagaggcuccaucaagccaagcaacaauuaacagcucaaguguaagauuuauaaaugcccguguacucacccuucaauuguuaccacccagagguuacaggacucuuucccagcauuuaggggaacaggcuuuuagaguauuuagaagaccaggcuauaaucaguaaugugccugggagcaggaaauagcucccaauuuauuuauggccuugggaaaacucaauccggugucuccuuguagcucagaacacuaauagccccccuggaagagaguggcacauugagcuccaaacccaaucaacauacauccacuuggcugcagaucugacugcugggucaugaaggccgugaaaugauguuugcccucaagucacuagauauuuuaagaagcccuauuuuucucccuuuuugcaggaguagagagaugaaagaggacagaccauugaaaacuuuuagaugcaggagaauugagacuuccacaagggagagaaacacagccuccccagaauccauuaugccaucggguuguggcacucucacccuugccauaauaccguuuccuaacaauaucaaaucaguggaugaaauacaagcucagaaacaggaacauuuuccuaaaucauaaccuaauagcaaacaaaaauugaaaaaacaauuauucugaagcucauuauucuuagaucuguagauauauauguguugacucccacaggauggcaccaaguaaagaucuuaagagcauaguagggguucugagaccgacugucacccguggauccugauggggaagaacagaggcuucacuguagcuauaguuuuccaccaagucaaucaaauuaaaacaugacucauuguccccuccaaagauucauaaaauucuugagcuaaagugaucuucugaagaaaagccaccuaacaauguuaggaggcucauaaagcucauuucucuuuucccugguaugcacaaauaucaagccuauaaaaaaguaauuauuuccccaaaccuguaaccacugcauucguuuucuuuggaggaacauuguagcauuucaggagggucgagagaucuaaagaguuuggucugaaugugugucuguacaauucccuuuggcauuaaacucugaaaccuacaaucaauggccuucaaauugguguuaaauugggagaacacccuacugcuuucugagucuacgagcaacagaaagacuggucuuagugcaauuaggcaggagggauuuggacucagaaacagccacagaaguauuucucagcacucccaguuccugccaacuuagcuggaaacgaugccacagcgagaccagaaagaggagucgccuuaagguaucccuacaaagucaccuuucugauaaaaaggagggaaaaaaaaguuagauaucuaaaauaagccuagaaucucacacacagcugugacuucuaagugaaacucuuuucucccucauguccuuaaauagucacagaaucacacacagccugacuuuuaaagacaagcuuggcuacaggaaaugaaccaaccccaaagacucuucuaaccugucuccugacugggcuccuucagaaaguguucuccuguuccaucuguagggcugcuuacuacuggaaccuaaaacaaaaccuguuguuuguaccaucacuuuuucugguguuuccugugcuuuugugauuccaagucuguucauaaguucugaagauaaauuaugugaaaucauauuuuggcauauggggguggaggaugaauucuuuacagacuuuuuaagaugauccauuuguaccacagaaaacauuuuggaaguuguuauauaugaguauauaaauuuuucuuuucauauuuuacauuaaaauaaagcuuuauucagucauuaagacgu

SEQ ID NO: 12722 - RNA, 115741 nt, Homo sapiens
cagaaggggcgggcccugagccggcgcguaaucggauagcucugccgcggcucugacauccacaugcugcucggccugaaaaggcaguggggagccggaggggaggcagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagguaagccacugaaaguuuuucuauuuauugcaacaugguuuccccuuuaaaagugaccgcuaaagcaggaaggccacgcagaacggcacagaagaaggcucccucaguacucaauaauuuaaagagagaucccagccggcccuuccuacaccaccacggcugcuaaaacccaacuuuccucuccugcuaggagugugugugugugugugugugugugugugugaguguguuuugaaacagaauuuggcgguguucauaugucacauauggacugaaucaaagguuuaaaaauacuacaaagccuuugcauuacaguuuuugggaauuuuuuuucccugucuugaagcagaacacaucucccuugaguuucuccaacuagccagugaaauauaaaucauuugcauucccuccacuuagcuacauugagcaauguuaacugaagggcuugggaaagacaagaguuuaguuuugguuuucagaugcuguagauucuuuggagaaugacugguuaugcuucagaaucauaaggcucaggcugguggagcaaguuggcuuguggcugagauaggggcuugggguugggugcugcuggcaaccaagacgguuggucucuucucucuucauccauguguugucugggaaaguaaaucguacguucuuuuagaaauuauuauuagcuaaaacaaauugcaggcccucgaaggucucucacucuugugaagugguuagaaacuuuugaguggaauuuguucucaaccacugccaaaaaggguguguggacaggcugcuguggagauaagcauuucgaggcccagaacagucuggggaccgcauuuguggggagcggcaagggguaugcucuggaaaggggaauccauggggaaugcagugggguuugugcuuccuucucggaccacucucuagagugagccucccuaccccucugagaacagugucuggaaucuaacaacaaaacucuuagcagcugcuacaggugauuggagauggagaaaccaucuauggaggaaaugggugaaagaaaggcgaaaaagccuuccugaagugcccucacccaaggcacuugcaaggcgauggcggcagugguagagcuaacucugcagccuccuuggcauccccagaacaucagcuaguggauccuagccuugcaucugguacugucacccuuccuucuccucacgccccccaccagcacacacaccacuuuaagcuugggcauuuauuugaggggggaagaaaauucaggaaugccuuugccacccagauccgcacguuugcagcucuuucuuugccauaaguggucuucagggcagcugcaaauccugccaaagggaugggugggggucccacuuggggagauuuucugggccuccgccguucccccuugccuuauuucuaaauucccagcuugaagcggaauuaaauuaccacucacagaccuggaugcugcguaaauuauguauguuugugugauucgcugugugugugugcacacgcgcgcgcgccgugaggaugcccacaguauauuauguauucagacacggacuccaguaggccccagcgcgcgagcgcgcacacacuggcacucacacuggcgcgcacacacaugcaacuucagguuccgugugcugugcggagcgggaggggucgugaagacucaggggccaucuccuaccccagauguucgcacaucuguccccgagcgcugcuuggaguguguguacgugugugcgcgacacccgcuuggacccacucccgcucugccaccugccugccgcgcucucugcagaacccccucccaucccaauccccagcagugcugcgucacuuccagagaagcccagaggcgcggaguucggggcaaccucggacccggggugggaucucagggugggauucgaagcugggaccugccagggaccuccagcuccccaaaaugcgaucucaagccgugagcugcucaggcuuucaggcggagcaaagcacuggcacccugggagccggcagcggguggccagggcgaggccaagccacauaccucugacucacccggugugcgccggccgggaagggggccugguucagccgccgccgccggcgacgagaaccaauucugggaaggagcaagauggggcagaaggugcgcgcgggggagcaacugagcaaauaacacggcggucgcggcgcgcggcaccuugggcuggcgcguggcugggaggccgcaugggcgacgcgcaccaggcugccccucuccucacugcgccgccucgccagaccgcagugcagccgcuagccugccucccucccugccccgggcgcccccgccaguccccugcgcuccgcucugcgcggcaggcucgccgcgaccccuagagagacggcuuugaguggcgggaggccgaggccggcuggcuugggaauccaagcgcuggcccaacuaggugagaggaaacuggggugggauuucggagaggagggcggagagaggcgggaaggaaccagcuugagccccaggaaugcgcgcaacuugcacagccucuagaagcgccgcgcgcccagcgcccgccggugcgcaggaacaggugaagagcacgcggcgugcggccauccacgugguggggacgugauagccccucagcucuccuccuagcccucccuccccuuccccgccccccagcgccuucucuaacgccgcaucgauuuguuugggcuacgcagcagaaacagagcccagcgauccauaaacauucuauuaagcaaaaauauucccagcgaaagcaaaaccgaggcugaagccuccgcgaaguuggccgccuccaacuacuccaugcuugugcccuccuccuccuccuccuccuaaggacacccccagggaaaagccugcggcauuucuucaacgcugcccuaugccggaaaguuaggucucggcugcagcgcuggucucuggagaagccucugccugcagccgccggcgaguucccgccuccccuccccagccgccucgcucuuugcuuuuccacgugagaaaaagaaauguucacggccgaugcuucauuuucacugauugauuucuuuuuaauaucaacacaaguuaauggaggcaaggcgcgcucugauugaagggcugcccccgcccuucgacucgggcuggcugugccgggggucuuucccaccgggucgcaggcguccagcggcuggguggcgggcgccgguagcccuaguguuuggaggugggggagggauuuggaauagacuugucgccccucugggaaucaucuggguuggggaaccuucgggaaucagcuuuccagaccaaguuuuaggggaucuugcccauaugcguugcggcuucugcggcuccggcugaauuucuucuaaaagauaggagauccacgcucagguuuauuggcgugugcucccugcucggcuccccucccuccacuuccuguucuuucgguuucagacagagaggagagcccccuggcgcuagccauucccgaucagcgcccacuacgaacguccccuuugcuagaguuaaucaugaucugcggggggacuggguuuugcucagaaaaucauucaaguccugacaauggguuucuucaaaugguggcaacucccaggccuaauguccccaccuccgggacacaucgcuuggggccaaaagaacccagaccccauaaccaucuaccccuccccuccucgucuggagagcuuugaucuaugcuuggguuuuaacgccauugccauggacacgcgcagauucucggucaauucacccuuccgucuggacuggaugaucagauaagagguguaaauuggcugugggagacaggucuggguucagacaaauccugaaagagaagcaaugacggucuaggcgccggauaaggguuugaaguguuucuuuuagccugucuccccaaaaugugagauggccauuggcgagcauaauaauuugcaaguaaacuguaaacuccuagauuuuacgcagacggccugcucugggcucuagggauuggucucaugcccacauuaaauggguacccaguaaacauuuuucccccgugaucagcuccuggagguagggaagcuguggccaguugccagcagagcacacagugcaagacaguggcaagaggagcacuccccaaagggccccgggcaggccccuacucguccaagcggugccugguggaauugugaaugcgccagugcacaucagguuuggaguuuuaugucaucccauagagcccucagacauuaagcuacggagcacucaacuggcaaaaugaaagauuggaaggcugcagugacuggaacccaggcuacccagacaggacuccugcugucuaccaaauggcucugauccccugcuguugaauguaucaaguccacguucugcagcagaaaggccaguuccuaucuuccaggcauagaaaaagcuaggaauccaaaugccaauucauaugcagugaggcacgaauacaaaugacagugagggaggggucuggggucagugaggagagacaccagggaccagaugauucuggggacccugguguuuuucauuucacucaagucuucccuaaagcaaucaggaaaaugaacugacucaggaugaccugaguguaagacaauucugaguugacagaauucaagagccagguaaagagguuuccaaauauauucuccaaagguccaguuuggaaagacuuuaggaacuugagcugagaucuuccuuucuuaaaagauagagcaaaagaagaauaucuuuuuaauuucuugaacugacaagaaaggacuugaaaagugucaucugggcaauggcuuguaguguuauuaacauauuugagguauuuuauuaucugaccaucacuugcaacuggauaaucuuugagauaccuuccuugaguggcagauaaguauauugaucaccagaaguuagucuuuguacuguuccuuccagguaaggacuuggcuguuugcugauuuuuguuuuuuaauuaacccauuucuggaagaugcugcagaaguuuguccuggagagcuacaguauuuuucaaagcuuuaucugccuugaugagaaauggucagaggcuuaaugguuucauugccuaacaggauucaguggaguaggauuccaggacacaguggccuuguaucauggcuggcccuccaggagaaagcaucuucuaaagguuuaggaagcugucaaguuuagauaaggcugagcuccgauccucugggaccuugguuguauuaauaaggagaaauuaauuuuuaaccacugggaacauugccaaauuaugugaccuuuggcagaccagcugugcuauaaaaauaaaucccccauuucugaaaaugcuacuccuauccaguagaacaauaacaauguggcauuuaggauagagaagaguaggauugagaagaaaggagagaaauaggaguuggcaaaaaacaaaaaaacaaaacaaaacaaaaaaaacaaaaaaacccuucgauguugugauacaugguuucagaccugaacuuccuauccaucacccgcccuccccggccccaugccuaggguuuccagaacacaggaaagagggccaggaugacaaggagcugagugccuguguguacagggaguggagaagguguuaagugcuuccagcccacucacaccccagccucaaacacaucucucauuguucacacagacagaguacuggcacaggcagagaaaaggggguuuucaaacaggcaaaauauuugucuuucccuaaaugcuaccaaguagguuugccacugagaaguuuuguggggaucaucccuggccuucccagcuucugaaacaugggaacuagacugccuggguuuagaaucuagcucagccacuugcuggcucugugaucccaguauccugugugaucagauacuuagucuaugugccucgguuuccuugucuguaaauguguuugguaacaauaccuacuucauaggguuguugggcuaugucagauuauguagaauacuguuuggcacauaugaagcccauucugaagucacugaaucuuuaaaacuguuucagugggguuaguggaaucucgugaucguagaaagcacacuauaaccauugugguaaguugauuuuuaugagauuuaaaaaauaauucuuauucucaguucuuccaccaccaaaccucuguguuuuguaagcaccauauuaucucucgccaugcucuucuucagagaauauucucugcugaguucuuaucuuagauuuaugucucccuugcauuuuuucccuccuucuuccucuguuuucaguauucuuaccuccuauuuucuuuuuaaucucucauuuccuuuccuuuuccuccccuuccauccuucaacacugagagugugcucagcagggaacaccguguuuaaggcgcucucccgaauguguaauaacuucuacucuggcacuaaggcccuucagcagcugaacucaaaaaagucaucauaaagacaaaauagcuuuuacccagcaagggucuuaauaaucccauuucccucugggucuucauaaaggagucauuaucuaauccagaaaaaaaggaggggcugggaauaacaaaagagaagcucucgguagcacagagugcacgaggcugccggccagcugagugcacguggccgugguacccugcucccgccuccacaaauccugcgauaaccaguaaccaguucuggcgagucuuucagcagagaagauaaugggaauugcaaauuacuagaccgaaugcuaauaauaauuguuuggauacaggagaaaaaauaaaacagauguuccccaaaggcauucuaggggcuacagaaaggaaaaugaggaggggguugaguaaagagagguuugcugaaaccaagcacaagaaaauccaauaccaacaaauggcuuagugaugaaguaauagucagcaucuuccuggugguacagauaaccaauauuuaaaguugccuuuggaaguguggggguuggagugaaggggacaaaaccccugagauaaauuaauuuuacuaguauuaaaaauaaaauggccgagcaugguggcucaugccuguaaucccagcacuuugggaggaggaggugggcagaucaccugaggucaggaguucgagaccagccuggccaacauagcaagaccccaucccugcuaaaaauacacacacacacacacacacacacacacacacacacacacacacacacacaauagcuggguaugguggugggcgccuauaaucccagcuacuugggaggcuaaggcaggaaaaucgcuuaaacuugggaggcggagguugcagugggccgagauugugccacugcacucuagccugggugacagagugagacucugucucaaaaaauaaaauaaaauaaaauaaaaugugaaugugcuuugaaauuuaucauuauuaucugcuuuaggguguucuaggagacauaguucgcacuaacucuaccuugaccuacuugugacuagguauuauuaucccagacaaguuauucaaacucucaauucaccacuaagaaacauuugcacuuaauaacagcuggggguggggagggaagcgcaguagcuguggccgcagaauaauuucugauagaacucucagagucuguccuaucuagugauaccuuugauguuccuuuggucacuucuuaauugguuaauucaccaaaucuugaugagucugacuuuugggaaagguucugguuugauccuguaagacuugccaaagauggaucagcaaggagucaugaccucaaguugcugguggcucaguagacuggaugaggcccuccagaacucucacacaucucagaagaugcuaaagagcuucagccucucagaugcacagaggagaaagaccacucccaguaugggagaggagaaagggcagaggcagccuggagugagagaguaggugggauuuagagcagggaagggcauaccaggggaaggggaaggugugaguagagaaauggaugcuggguugguuuggggaacacucagaagcugcaguuuagaauguauggugggaaauaauugcaaacaagauuauaaauaauagcuugggcucaauucaaggcccaaauugcuaggcaaagagguuuggguuucacuugcuaaccaauggggagccauuaauguuucaacauaagcuucaguuaaucaaaauaaaugaagacaauauuauauuacuuuuuuuucuccuuugguuuuuggagagaccucaaaauuauucuucuguuuccuuccccaaaugucuccuaaaauggucaggaauuguaaucccagaucucucaucaauggcaucaaaauugcauuugcaaugagggcuggaaaagagaggacauaaauauaaacuaaugacauuauaucggcugcccuauuggaauugcauuuguuuaugauauaagaugacaaauaauaagguuaacacagguggcaugauucgaggucaggagagguaaucgcaucaaacuuacauuuuaccgauuaaaugaggcuucauuuuuagaaucuagauugaggggagagauguucaaaaggccccauuuccagacccaauuuccaguucucuccuaagugaauucauuggagguguuuuaagagagggaauuugcuucauucuuuauucauuuccaaacucauaugcuggcuuccucuccugcucucugcuucccucucuccuucccuccuagauggcccuuuuauucagauuuugaacuuuaucauuucaaaaguucagaaggauuuccauuugcugugccuucaggagugcaucauucacugccaccagucuccauaaauugaguagauugcaucccuucccaguugccuuaggaaguggucaaacagccacauuccugggcugauggauuggcucauuucuucccagcuuaagccaagauacagauuuuaugagacugucuugugacaggcugaaguugcuuugaauaaaacaaaauccagccucagcucacagaaauaauucuuaaaacgcagcuuaucccggguuggugagcaaaauuugguuaaaacccugagccaacgacuuagaugaucugggugagggauuugaagaaacuccuuuugguuuuucuuuucaugcaucacuguuguugacaugcucacacacagaacuguguauccauaauauuuauaaauaugcagccacagacucaguuacaaaaagaaacucguguuaguagaccugaugugauuaaaggagacauuugaacucuccguaaugcaagacagacauguuuucugaagaauccuggaguuugguuucaggcuuaccaagcagauagaacagggguagcaccuugaguaaaugucuuauugucuaggaggguagagaaucuuuugaauucuuggcucaaucuguggguuauaagaucuauuccccaccucacuacaugggcuuuggauuuuagcacuggaacugaccuuuagaaucaccccucucauucuauagaugagaaaacaaaggcucagaguugucuacuagcuuacccaaggucacacagcuugcuaguggugagacuagacuugauuacuaggcuuuuaaauccugcuccaaugcuauuucuaauaaacuuccugguggaguaaguggcaaggugacaaccuccuuucuuuuuaaguagaagaaagaguuucuucuuugccuugcuaccaauaauuaaaugaaaacaaugcuguggaaauagggacaaagugggauuaugcuguagauaagaaauaaauuauaaaguagauaaaguauauuauuuucagaggaaaugagaccgauugcuuuucuccacuaagugcccucagguauacauaggaaauagaugucuccuagucaucugcucuuucucuuuuccauagcauuuuaaaguaacagggaauggagaugccccauuuagaggguuucaaaccauguuccaggaagccccaguggacuugcagagaagcccuucugagcugagggcaggaacuaggaggccuggacacuacaaugcuucuggcuaccucccucccagcauccaagaagagcucccuuuuauguucuuuguacaugggaggucuagguagaguuuuguucaagaaaaaaaaaaaguacuucaaaaaaagcaaauaaauuugaaagcuacacaccuaauucaguccauucuuugaauuacaguuugugaagcugagccccagaaaggucaaauugagugaguuaagaguugggugccaucucccaucuuucugcuaaugucgaucccucccuuuccugguaacccagucccaucaccccagacucaccuuuuacaacaacugggcccucuaaucccacauucagccaauggccaaguuucccugguuucgccaaggacuuuuuccuucaguucaacuaaagcgagggaucugauuggucuuuuaccaagcugucgugaaguaagcuauaguaaucagauuaucugcuacagucaggcuucaguauuuagcaaauauuauugucaaguucagguuauccaguguuccuuuaaaacaaugccaacuacauuuuucuagaaggcagaccagauuuuuaaaagaucuucuuuucccauucuuaauacuucuuaaaaauuaaauauucgcaaggaaagugauuggguucuguaggaaggugaguuccuaagugaagggguacaacaucccuuugccuuuucagggcuauguuaccccuaggcagaggcagaugguacuuagacuaccagcaaaacaacaauacuuaagaaggagaaaaagagcaagacagaaagaguuuaaaacaaucugauauuuuacauuucaaauaaaaacaccuaaguaguacuuauaagaggaaaaucagaacuuggugacuucagaacuuaguguucucuuuauuuccaauuacaucuggagcugucacuuuauuccuuucagccuugggccuuucucagaccugaccuggcucaucccucagccuucccucccagguauaggagaaaaugcucuaacaguccaagccuggauuuugcuaucucucuucgggugaugaauuugccccaggugaaagguauucacaaaauaguugcagaaugaagucuuuugucaacucacccagcgggcucaguagcucaaacagggucaauuuccccucuguacauggagauuggccuuaaggguuuugcccuugaguucaacucuccuuuggcuuagcuugacuccucugaaacagaacagcaaccauguauaaaguucauuguggaacacaauaaagaccuacaaaguaauggaugguauagcucuucagaagaaauuuuagcuaauuucuauugggacauguuuguauuuaggaaaugauguguccccaacccuagaaaggaaagaucaguuaucaagaggagaaguagaaugauuaaguguguuuucuuuacaauuuuuacugauauguuucaagaauucuguucucuccaagaaaaauaaaaacagaaauucuaguauuuaucuuuguggauauauguuugugcaaaugaugugugauauuuuaugagaaggugugaacguauguauaggacuaaagugugaauuacugauauguauauguacuugaaguauguucaauaucuauguuuguguguguuucugggugugaaugcaagccaaacaagaaugugaauuuauaaauuuguaaguauugaaaagguuaccaacacacaacugaagcagauguucuaaugaguucucugauacuucaauaacugcccugauuuucuccagguaaagaaaggauagaaaaaaagcaauggaugacuccuuuuucuuuugguuuaacagcagacaguacagacuaucagcuaugggauauauauauaguuuaauuuuuuuguguggugguggugaagaaaugaucacuucugcuguagaugagaaauuaaaccuuccugcgaagaaguuuccugucuuuauugcugaucugugugccuggucuaauuacuaaaaguuuaaaccugggguguggggaauugagggagaaaaguuccccuuucaagaguaauuggagagaaguagaggaagggauggggaaaggagggagagaguguggguagggagaguggagaguauguggaaaccauaacaguuacuaaacaggagcucagcucagguuuccucugacgaauuccaaggcaaaaaagugugguuuggggugaguugguggcagggcugcaguuuucugcaaaauaucuggcagaggagcuggacccgguagaaaauucccccuucugcuaguugaguaagagcagcuggugaucuauguccucacaccucugccuucucagaggaccacuccacccuauuucaugugcauaagccaggaccaacgggccucaauuuggcuggcuagaugacauuagguucccagcaugggugaguggugugggcaccuggaaagccuauggguauuggcugcagaggagcugggccucauggcuggccucauguggucugggugggagggaugagcucauugucuucaugggcuggggugggugcagggucauuagguaagaagaugaugugcuguguaccagccugaggaaacggcugcuuuuguuuuccacccaguaggaaauggaccugaauucauuccauucugggcaguucaauacggcacaguuugagcucguggaggcuugaugccgaaaaggcuacuuguguggauuugugucccaaccacccgugugcagcgugcccaucuuuuaugcauuuaaagccugucaggccgguagucuaaagcagaggucugggagauaguaaugccaacagacauggggaauaguaaagugcaccuguagaguuaaaaaaugcaugaccuguucccucaaagagugaacacaggagaaagacccauccuggagggcggcugcugagucguaauacauaauucacgggcccaugcugcuccaugcagauggcgauauuaaaucgugauugaugcuaagagacacacacaucucaggaaggucuccgagaggcuucugaauauuuccaugucucaugugccuucccagcuucuguucuacugugguauuuaagcaaaacucccuauuucccaagaaucccugcuggggauugcagaacuuuacucccgaauagaugagauuccucaaaugucaucacccaccuuuggagccuuugaagguggcucccuucccucccaggccacaugaagcugucugccuccagccaggcacugcagguacagggagccagcccuuccugcaaacggccaguuauggcuggacaaagcagcagcacacucuggugguggugaccaggcaggagggacagugggcagacagcgcagaagaaacagauguucauucaacacaaagcaccuuugucgaaauuccaaggcuagagccaguagauucucuaauacagauuuuuccauucgguguauaaugaaauaauaaaucaaauuugugguauauauggaauuaaauguuugggggguuugcauuuuuuuucuuaaaaaaaaauuuaaaaaggcugcaaucacccuccagggccuguucuggcccaaagcugaaagugcuuccucugcaccacauguaauuguuaccaggcucgcuugugggucggcaccacaaaaccaccauugucaguucccagagcccugacugcuggcugccugggcugggcugggagacaccgaauaaaaugaaggauuuaugagauaaagauagagauaggagguugaaugaggagaggaagaugggccaaggaggggaggcaggaaaggcagggaggcauguugaguuugcaguccucuuguuuuuuuaaucacagaccauguaauugagaauauuuauggccauguucuggaauacuuucaucuguguguguguguguguguguguguguguguguaguuggguggguagggggagggaugagccggaauaaucucuuccaccgaaugaguaaguagguuagucuucuggacugccauaaaaggucuguaaaauaguuuuaaucagacacugguacagaagagaaggagggaguguggggggaagaaaguuguaacauauuugaaguucuuugggucguugauuucucuuucagacccaccgugcggaggucguuugaauuccaaagaugcuggcuauaucaccucucccgguuacccccaggacuaccccucccaccagaacugcgaguggauuguuuacgcccccgaacccaaccagaagauuguccucaacuucaacccucacuuugaaaucgagaagcacgacugcaaguaagcaccguccugucccacuguguaucccauccaugagaugcacacgcccugcccccaccccugcucuugucacuucuaucaccccucaccccaagaccugcugcuaaccagugguggauccuggccccagaggaaaaccucaaggggcauucccuuuccagggaaauaaagguguggcugaucccacaguaugguggaaagagccuucuugagugaaaaguagagaauauuaaccuaccuccaaaggccgguaguggaggagaauuuccaugugguggcaggggcuggacuacaaaacucuacucuugacuuuggguuaccuugcacuuggagaucuccccauuuccacagcugcuacauguauaaaccccacccacuuccuuaauaagauaguagcuguauccccaaguggagacuucccucgcauccagccacgcaggaucagccuguuaccuuauauagcgguaacugguuuucuuauagaaaaaaaaaaggguaaaaaaaaaaaaaaucuaaguaguucuaagauucacauugguucuugauagcugugcuacacaaguagagucucaaagucagugucauggauuuauuuaacaaacacucuucuaauugcauuacaaauauuaauccauuuacuuugcacagugggcccugggaaguuagugccauuaugaucuccauuuugcaaaagagagaaaaccgaagcacagagagguuaggucagucacccaaggugacucagcuggucuuacaacauugguucugccacccuggaaauguguggcuuaggaacucccaaguggacauuuagacacuugggaguacuuuagaaaugccauguuacuaccgaggucccuaaaaguuaagguugggaagcaggcagcaugucuagaaugcagaugugcuuuaagcugucuacugagcuccaucuuaaagucuuuucucauuggaaauaaagugagaguuuuugugcagaaaagaaugugccaacagucauauucugccccaaaugagcgccuacggaaugcuguuacucugauaaguauucagugcucccaugugauucauaaauugucuaagcauuccuugcuauuaagcaaggaauugcaaauacugaaaaauuaauaagggggccagcuggcaggacagguaccaaggagaaggcaaaacuccuacaggccaggucugggccagcacuuccucauggaggaaacaaggccccucuuuaacuagugcuagacugugaggcucagugaauugaugucauuauuaucccccuagggcuaauuugcaccuacauaaugguuuucuccuaacaagagguagccuuuguugaaaaccaaaggguuucccggaugaaugccucaugugacgaagagucauaagaugaaguuucuaaucccagauccacucuugacucaacggaugacauagggaaacucaucaguuccucuuugucuaaguuacaugaguacccuggauacauuugcucagcaucccaaggcuucugauucccugacagugaacuuuaucaaagauuucuguuagaagagcuucuuuauaagguguuuugggcucugauuccucuggcuggacugcagaagguuggcacaaauggaagcauaauguacagagagagccugggucuaagcucagagaaauuugacuaagcaccuuucucuacuaagggccaaauucuguuaugcuuaugacagcaaaucucccaaggaaauugccaagaggucauccuauguuguauucauaguggcagagggagaaagcauggcuuuuggaaggaaaaacuuaggagcuaguaagcauggcuuaaaacauguugggaaggacgaaaggccagaaaggcccugcuuuggguugcaggguaccccuuccauggacaggacucagucccagagauggggagaacugaagguugccagagacucugacaaggggaagaagaaggcauugccccuugcuggagguggaguaggggaagccagcaauuuacaggguuaucuucuggcuuaucauccucgcuaaaucacuuccuguuuuucuccccauuccaugaccucaugugucugguuugaaccuaaaaagugaaggaggucagaaaaaaaucuuucuggggucuguuucucccagugccaaacugucagagaggcucuguugggauuaagccucauccacuuaaccuugucauuaauucucuguuccuccccccauuucucccccacuccccauuucucucucuuucucucucucauuaauuuuuguauuuagaaagacucaucugguuuucucagccucucacucuucaagguauuuuugacauuuccccuggccauuugcauuugccauaaaugggcuuccccuccccacugccuuguuuuacuuucuugugaaaggaacaauuaaucuaauugaaguccuggaaguucugucuuguuccggcucucccucucucuuccauacugcauuuucguuccaagggagcuccuggguuuggaaagcacucacucuccaaggaaauuagccugcuuucuccuuuuauuuugggugcaugcuucaaauuggauuuggcucugcaggcccauaagguggauacuucccaaaagaaaacugccugggcuggucuuccgaucacagagcacagcagcaaugccccagcaaaaaggggaacugagcaagaaagucaggagaagcagccaacucagcuguggagacagagcaguggucagcacacccaaccucguguuugcccggguucuuccuacgugcaggguuaacugcaaagauugccccaaagccuggaaacagggcccugauaugaaagaauuuauccugggcuguggccccugggcccuuggcucccuguauaccuugaacucuacaucccaaagguugagacgguugcugaguaaaccccagauagaccuuuuccccuaaccguugcuuauuaacuuuguuccauugaagcuugcugucugcuuggaaaauuucacucacaagccgcagcuuugccugacucagugcaauccaaggccaccaucucuggugaacuucccuugacuccucccuccagccacuugcagaaaugcaaauccugggcacccacaggcuguuugggggccuguauagaagcugugggcagaaaccagaggccacugugguacugcuggacuccugcagccaaaggacaaaagggcgagacuacgggccgucugggcaaacagagagaagccacuuuauucccuguggaguggaggaugcuaggauguugcugcuccggcagacagaggccuuucgcuugagucaucagccaacagacugaauguuaugguuuuagaaacccauacacaaaguugagugguuuuuuccauuucuaaaauuuaaaauguauguauuuuuaaaacacccaccugcauguaauacacagcuuguucaggaguucucaaacagccccagcacccaccccaucccagaggcucaaccaaauaaaaccaaaaccaggaggcuggguccuuuuaagcacugguaauuucuaccuguaauuccagcccuuugggaggccgaggcaggcaggucaccugaggucaggaguucgagaccagccuggucaacauggugaaaccccgucucuacuaaaaauacaaaaaaaauuagccaagcuugguggugcgugccuguaaucucagcuacucuggaggcugaggcaggagaaucacuugaaccugggaggcagaggcugcagugagcugagauugugccacugcacuccggccugggugaaagagugagacucugucucaaaaaaaaaaaaaaaagaauugguaauuucuagauggguaccuugaugggucucagaaagagcaaaacccacuagcaagaaaugaaagaacauuucuuaggcuaaaauccucaaggaagucuacauaaaugauuguaugugcuauguucagcccagcaauaucucauauaccacguaucauugaagaaugacauuccauuuaggugaaguguccagauacugaaauauccaccuuuaaaguucuuaaaagagaacuuuaaagaguuccaagaguucuuuuuuaaaggauuucugauaaagaacauucuaaaucaugugcugcacuucccugucuuuuuaaaaccuacauugagaggagucaacuuuuucucaaugauucaggcuuuuaauucuaagcuucacuuuugugacagcagccaguauugccauaauuggaacaggcagauuaagauuugaauuuuuauugaccuuuuaaacuucccaggccucaguuuccucaucugcaaagcugucauaauaauaaauaucuugcaagauugcucugccuuuuuauguagaugcccaauaaguuagcaacuguguuagcaucauuggacuuugucaggggacaguuugggacuauuuucuaucaauccuccugcuuucacacauccuguuacgaguaugccugucuccuguagccuucccauucugacuuguuuuugcuuuuuuaugggguuaucaauuuugcuucaggagcccuugcugucucuugggaaguuugaguucugggaccuaagcuuugcucaagccagugcaaucccaaggccagcauuuccaguuggcuucagccagccaagcuugcagcagaguuaggacuggggagugauccccaagugacaaagcguaagagcaacagaggauggaguucucaacaucaguguagcugcucacaaucuuuuuuucugaacucccccacaccguuauauucugcauauuuaagguuuuggauauuugccucuaaguguccuagauaaacaaggugcucuuguguuuauuuacagccagaggggcccucuauaucuuagaagauaugucuguuucucccaaaguaagagaugauaucuuagaaagguagcaguuucccaguugauaaccugaucauaguaaacagagagaucagaccagaccuuagucaucuggccccuccccauucagccagcaguguuucccugugcucaguaaacacccucgauucccugcaaacaaccaagcauagucuugcaucugcaugagcccccugaguucccagggcuccagcccuccuuucccucccuccacaguguccagcugcaagcucccaucuuccuccccugaguuuccuugcuuccugcaguucccuuuuaucacccuuuccucugaacucccagagcacuugauguugccugagucccuugcuuuuuguucauauguggucaucuugaguucucagcaaguaaauucuacaagggcacaaagcauguacuucauaucuaaacucccauggcgccuagucuaggagggugcuaggcaggugugugcaggugauuucgugauauuuuuuacauuggaaaugccaggcaauaggucagcaugagcugaaucuguguuggaaggcagacagaucuguguucccuauuugucccucugggaauaugacauaaucuuaggggguaggacacaggccaagaaugucacuaacugauuugggacaugagucucucaccaacaaaaugguaauagaccauucauucauucaucaggaaauagcuauuaaacaccuacuaugugcuaagcacguugguauuauugggaauacagugaugaauaaaucauauucuuuucccuaaagucacuguuacucuuuccauuuuacagaugaagaaacuugggcucaaagaaguuaagcaacuggcccaagguucuacucccauaaguggcagagaaggguuuugaagccagauacccuaguuuucaaucucugcuuuacucuugugcugucugccuccccggcaucaugcauuuggcaggggacaugauauggaccuguuacgugggcccacagcauccagguccagccuaagcugggaagaucaaggaaggcucccuggaggaggugacgccuauacgaauucuaaagaauuuggccaggcagcagggaguguguuuggcuggugucauaggcagacagcagcaugcccaaagacaagaaggagggaggguuugaugccuucaggaaccaaaauaauugaacaugccugaacccaauuucuuaaccagugagcauuguaaggguagacuaaaaggggcuguccuugugacuugcugacacaaacccuuuucccggugaagaggugccugagcaauacuauuuaauuguauuuccuggccagacaacuuccaccaucuccuuaggagacaggguggucaggaagcaggaaagacuaagaugauggggacucucugcuguccccaccuucccuguccauuguagggucucugcagccucauacccuauguccagcgaccucccccaccccgccgccaguggaaugccugaaagugggguuuggccugggaaaguccagguaacacuucagauuaagcuccucuugucaauuuccugcuacacaagacuuucugaauccaagucucuuuccuaugaauagagggcgggaggccagauugcccaguuggagguguggcuucagcuggucuccguugaagucugaaaagccaacaaagcauagugagaauucugugugguucaagagggugccuugugcuuguugaggagaggccguuggcuugaucacucacgacacuauuacugacguuauuauuuacugccugcccaaccacagaaauauucugauuccccuaaggagccagugagcaguaauaauuuucuguauugcaacaauccuccuaaugacagaaacagauccaccuccagguacgugguggacgaaugggagcagcuggcugcuggccccacacuuaccaaccuugaccacaggguccacccagcaacuccaccucacccauggaucagggggaaaaacaacucacagacuguucuccucuuaccaagguuaaaacgcagcuggaauuacuuugggcaguuuguuuuuaaaaaugaguguugcaauuguaacugucucaaugcaagcuucgcuguagaugcccuucuuaacaauaugcuuuaucuucugacugagaaaaucacuugagauguuaucaugcacaaucccacuuguucugccucuccacccuggcaccuucuccgaacccagagaucccagagggccagcaucucaccccauguaacuccauguaauucucccaucuaauuacaccggcugagagucugucuuaagaaauucagugggagcuccagguguggaggggauaaagaagagauggaaauauaccaagugaaaacaucagauuuuucuaaaaagggauuuguguauuuuccuggagucaugaguccuauagaaaaaaauuuauauucuuuuuguuuuguccuuuuuacuggcaagggauuuaagccuuuggauuaagagaaacucaaaagauaauuuaauuccauucuuauacuucugccuggauaaauaauuccagaaaaaaaaaaaaaagauaucagcugcccuugucuuuccuuccagaaaagagcuucuguaaucguccuucauuaugggacaucgugccucacaacucaucucaguugauugcagaguagaugguuguauuuaauuuacauaaucaaaauuuuuuuccuagaaggagaaucccugaaaaauguuagcugggucaaaauaaaauuuucuaaaaagaagaaggaaaaggaaaaggagaaagaaaugugaguugggcuuagguuugggagggcagcagaaaagcaugacuuuuuuuaugccucuuuucgagcuuuguagccaagcaucuuggcagucucuaauauuuuucuacuuuuucccacuggggacucaacuguauguuugugggucacguggaggaacucucaaaauuagacaacaauagcaaacauuuauugaacucuugccagacaucagguccuacccuaaguuuucuauguuuaaccgccacagcugguacugguacuacuauuaucccauuuaacagauguagauacugaggcccugagagaucacacagauaguaaucguggggcuggguuugaagccaggcagcccaaagcugccuuuguauaccugugucaaucugcuuggagcugucaucugcugucccagugcuuagguauuuggggccucucugauuucuuuagauauccuugacaagccuuuucuuuuccuuuucucuuuuuauuccuuuucuuugccucuuccugccaugcagucaccuccggaugccagcggggcagucaaggagagagaucucuuucugugucuuuaaauacaagccagaggccucucaguccaucgucucucucugccucccugucaccuaccuccuacucccccaauccccccacagccccgcucaccauccucuucaaauucccugccauccucaccaccaccuucacucuccaucuggaguccaaagaugugagggccaguaauagagugucagcggaaguaauugauuccucacaccgagagaauucgccugccuuuagugucaauggagcugaaccagagucuuggagggugagcgagacauguaaacaguccguggccgagcugucaggacgaagccagacacaccggagagugaacgaggggggaaaugguggaacaaauaauuguuuuauuggaaaggaaaggaauaaauaauauuucagcccaggaacuggcaguuugaaagagaugguugagagcuuggagcagaaggauucgugaugcagguuuuaauggaagagauuuucuuugucucaaaguaggagguuucguccccacccgaccccccucucccauuaucaucauuauuaucauuaaaauaauuacuguaacaauuacaguugaugagaccucagguuuauacagcaccuuucaucuaaaaguucaaagcgauuuaucuaugugucaucuuuugagagugguaggaggguaagaaacuauuauuuuggggggucaucugcugggaaacugagguccaagcagauacaagauuuaguccaagccucagggcaggcugcuggguuaaauggugggguacugaguuaucuucuugggggccuuuucugcuguacucuucacugccugggccuuuauacacacguggcucuugaagcucauccccggcacugaugccuccucccacacugccagggccuccacuggucgcuacaauauuguggccaaccagccagaagcucugugcgcaaaacaaacagccugcuucuggcugugagaugaauaaagauccuucaaggucugacucacacagcucccauccugcuuagagacuuccuguaaucugguucccuuucuuguagaagcucauguccuuucuaaacaucuuucuucauggucuuaugaggcucuagccaggagcacccaacauuccuaaaugcuugcuucuuccacccccaacaaaccccaaccuguucucucagaauggaaagggcauuucugggauggggagagaaggugaaugcuuuaacaugccucacauggcccgggcugccugugcagcaugaugcuucagaaugcagcugucgaaagcauagucacaaacggaagcgguuccagcugacuggccccugagugcuagauucagaaucuccgcccuggcguggcagcagcccuuuccugcuuggacauuagugcaggcccaucauuuccacaccaugguguuuuuugcacaguagugacaaguuugccccuggagccaggagaagcuccaagcucuguaaucugaagcuccaaguaaaugaacucuaaaagggaggcccaucacaccugccaccuacucccaaacuguccccuacuuggauuucugcauggcacguuuuucagaugaguuuugcaucuuccaaguuuuguuagggaggcuggaugccagcaaagaggaauagaaaaaugauauggagccuaaaucccuggaaaaacaaaaaggacuuuucuguugcugugguggauucccuggugcccaguacacuuccguucccagcaggcucccguuuuuuggacagacggggaaguuaugauuugcccucacaauuggauccccugggagccagaauuagugugaacaccuauuccggagggaacuguucacccugccgaguaaaggggcacugccagcacaccaggggccccagacgcugugcucugauugcccuucagugaccacccaugcaggcagccccaccgggcacaaaggcaugauuccuguucccuuuugucaaaugaggccaacugaggcacacaagcaugauugauccaggccagcguaggaaaauuuaguaaguccuggcccugcugggauucaccuuuacaccugcuagugcugcugcugccgcugagaaaaacagaaauggaaagaaauuguggacuacucuuccuuugcacucugguaucauuccagaaugcuaccaaggggcccuuuaaguugacugcagagggugaggauuuuauagacacagagcagaccaacgaaagacccaacacucaugcugaaagcagccugcccccaaagccuuaaacuucacauuggcaccgguugccuagaaaaccauuccuuacauaagcaaacauguuucauccaaguggccuccagugugugugcugguccagaagcagagcagacccgugaccacacggccucaggaaugcgccuugcuggccagccaggucagcgagggaaaugguauucacccaaaggaccagugcagaaguuggggaggcuuuguugcgugcccuuaauucucugaaaguucaccuucagagagacuuaucagaugcguugucuggaguggccuccuuccucacgucaggaggcauucuuggcagccugcuccaugaggaacaaugagauuggcggggcccucaccaucaucgcagggccuuugcggaaaaagagccagcaauuauaaauagauguuauuugucguuuccauuuucuugccuucaagguuuuuuggaauaauuccuucaguuuguuuuggguuauucucuccguguacuuccuuugguggguggucagacuuccuccuuucugaagagccauggugacccugguugugaggggauuguggauaagaagcucaaaauaucagcgauuuguggugggaagaaaugaaggaagaaaauacaacugcaaacagccacuauuaaaaaggcgcuugguacugaugcagauacccaaacaaauacagaguuugguaacuguuugagcccuuggcguuaaauagcaaacaagaauaacagcagcaguaacaacaaauggcuauucauggagcauguacugugugccauacacugugcugacccauugauaugcauuaacucaccagccucuugggagcuugagcaccuugcuaucuaagacagcagauggaggacgggugguuuugaacauagccugggcucagaaacacaaguuugaaauaaaaucucgaaaacucaagugucugaaacacuguugauggauuugugcagggggaugauuuuuuagaaacccagccccaagaagcaggguauugagacugccucuaacugugcuuuucguuucaucuucuccugucuggcucccaaggugucauguguguguaacucuucucuucuccacauccaccauccuguuuuguuuuaugcugguaauaauaaaaauagccaggggcucucaggugcuuccuuaaggcaucuggcacugugcugggccugcauguaccuucgcaauccugccaccacccgcaaagguggagacuguuauuauguccauuuuguagaugaugaaacugaaacucagagagguuaaauaccuugucuguaaucacaccaugagcaagugccagaaaguaacugggucuguccacaaagcccacaugcuacacuucccagguuacacaacacccucuuagguauguuuccguuaacaguaauuuaacguuucuuuugucacagaccuuuucccuagaaaaaugugccuacucacaaacacaaaauuucggcaaacaaagauagagcuuccccaacccacuuacacuuguguguaggcccuaggagaaauccccgcauuuaagaauaugugcucuagaugauaacuuaagagcuuauaaauauaugggaugcugcuuucucacuccaugggccauauguucacauauggauauauaugugcuuauaaaaauacuccacuuacaaaaauuaauauguuaucccaucugaacucuuacaagcuagauuucugcugggugagucuugaaaucauggauuccaaauccgcucacuuuuccuguuggugauuugucuauuaauuuugguaaguccuucagccuuguuuaaacagaacaacucaaaagagcaagauucuguuaagucucuuacauaucuuacacccauuuuguggaaaccuaacugaggcccuaaggauucuuuacaccugguaccugcuaaugcuauugugcuauggcaauccgguauuuucauugcccucagaucuuccucccacaaggagacaaagggaggaagggaaggucucugugcccuggaguuugacuacuuggguucaaugccugucucugaccuuuccuccucauguaaccuugggcaggucacuuaacugcucugagccucgaugucugcaucugcaaauggaugguaauuguaacagggccugguuuggaugaaaugaggauuaaaugaaauaauaucugaaucaauggccuggcccauaguaaaugcucaauaaaaugugaacaguuugcagauauaccagcuuuuuaguaaaugggugguacagaugcaaggcagaaauucaaggaaaugaaauuuacuuuaaaaagucugaccugacagugagcugacuucuccauaaaggcuaggugacuguacugagccuaaggagcagguggccuggcuucaggccugaaccgaccagagaccucagcauugugcagaucugccuugcagccuuuuuagacaucgugcagcuucuuuguugggaaguuguaugugacagugcuguuuuuuuuccuccuaauuuccucacagguuuuaauguaaggauuaauaagacaguguuuguagaugucuuugagccuccuggaagaaaggcacuccaggaggugauaaauucucuggccuggauaaucuacucaugaaauauggaacuuugaaagugugagaaaaaucucaaaucacuuugacagcauuuuaauuauaguugauuuguuugccgcuaauagugaaaaugcugucagcaugauuugagauguuucuuccacucaaaauguuauauuucauguuuuugagucacaaggcaacauuuugguuuucagauacaaccagaauagcucaguaaauguguuggggcacaaagacagagaguauaaaauggaucaaacuccacggaaagcaucaucguagcacgcauucuucucaacauggaacaccagccugaagucccuuauucauuuacauuuauuuacucaacaaaaagugaaugagaccuccuacaugccaggcaccagggaagugucguaaauucagcagugaagaggcaagguccuugccuucauggugcuuauugucuggugcaggagacagaucauaaacaaauagguauauugacaagaccuuuccagauuauaaucauagcuaugaaagaaguaagaugauggugagauagagaauaagggcaugccaucugaaauaggguggugacagcaggcuucucuguggagguaacauuuguccuuaagccugaaggaugagcaacaaccagcccuggaaagcaccaaugaggaguacugcaggcagaggaaagagcgcuugcaaaggcccugggguuggaaagagcucaccauauacaaaaugucuucaacaucuuaugaucuuaugaugagcagugugaaaggaggccuugcuugguuggcaaagguuaugaugucaggacuugggcagagauguucugauacguagacccaaaagaaggggcagaguauucuuccuccgaagaccuaaguacucuaucuucgauacagaaauccccuuccaagugguucuguguggcaucccuaaagcuggauucugacaagggccagacauuucggugcccugagagaaggaccuaagcuuggugaaucuuccagcacaggcuccguugacuaacccagccuuuggugcccugcugggaagugucaagcguggagacaguuauggaaacuagaaagcccuuuuucauguuugccuagugaugagaggaagagaugagauuguugcuuuuucauaucucucccguggacucuuaaaauuaacuucacugucaaaauuucccauggcccaaauguagguuuggggagagaaauguaagacuuugaaguugagaaagaaaguagagaaagcauucucuagacaaaugcucaccaugcagacuucagaaucugugaggagacaaauaaaaaggcacucggggaaccguuuuagagagaaaauaaagaacugggaguagagauggcuacuucagcucaggaaaaaaauaaauaaaacaauacaagguaguguuaaagcuuugaaaggaauuuuucguuuaggagagauuauggauaaugaaaugcaaacacucuaguuaauaugucuguuagcugguuuauguugccuucuggaaaacgagugauacguucuaagaggagcagcuuuucaaguuauccuacuugacuaucguuggggugagcucugagucuguaccccggauuccuuuaccaaacacuggauauuagacacuagaugcaaagccguauuuauuccaaagccagaaacuuccuaagccucugccuaacucuucacaaaugaaccugacaacacugaaauuucuaaggagauuuacuccagcuguagcaaaucccucauaauaaaaaauuuccccaaaugagucagucacacaggagguaaaugagacauucuguaugaagucagcaugucauuuggagugugcccuuuauauaaaaggcccagccagaagaccaugugguuaaguggggcuuguccacagggcagaaccagaagacuggaaguuggggggauuucagcugccgaacuguaacucugugucacuuccccucaagcaaaccuuauagaaaaaucuaguuuuucuaagaaguucaaguaagguuuguugauuauuugcuucacaaaaggauucagcagagggguccuuuaacuaacaagcucagagaaaaaauuuauaguaugauugaauuauaugaagcuuuuucaaaaaugcaucccuucucuauauguguguuagauacauaaggauguauuuguugcaggcagcauuacaagaagggauuugggguggucuguauccguugaguaaauugaggcaagcuuguaacaguggcauuuguugggcagcccugcuucauugcugauucuguuaauccccuaaaugacuccaugggugauuaggcaaccagauaaaacccucucacuucugaugaacaagccagugggauggcagggccucucuuuguccuuccuagagaaauuggcaacacaaagacuggaacuaucuggugaagcuuuaaaaaaaaaguuuaaaaaauuauuuauugaaugugggucauguccuuggcacuguuccagaugucccgaccuacugugucucauuuauuccucacuccaguucugugacauggaugaugauggugaugaugaugaacuuccuucuacaucugcuaaaucaugacagcuggauucuuuuacaaagaagagagaaaaaauuaccaauuauccuaccacccaugucugucgccauuguucauauuuuaguagucuuucagacuuccucuguauguuuaugugaggaaauguauguauaccuuuuaaaacauacuuuuaaaaaaucuccuuuuuaaaaaguuaacaguauagcgugaacauuuuuccauaaaaacaaaaaauucuagaccugcagacuauugauuguagcaggagaguauuccauuuuauaaauaucccagauggauucacccucccucuacgguugggcuuugaaaccauuuauaagcaaaauauccucccacuuuuuauauuuuuucaaaauauaugcacaaagaugcauaugcaucuuugcacaauugucugauuauuuucuuaggaaaaauuccuagcaguaggauugcuggauuaaaggcuauguacauauuaacuucugucacauuucaccaaaaugccuuucagaauguuugaacagauuuccauucccgcugauacuacaccucugcucauuuguuccauuucugaaaacagggucgcuucugcucuguggcucagccuccuugccugugaaaugggugugaaaauacaacaaaucacaguucacauuuacuuagcacucacugagugccagacuauggacuaacacuuuagauagauuagauuuugucauuuaagucccacaucaacccuaggagaagacuguaauaucccuacuuuacucuuuuucuccccauuucugaggcucagaaagguucaguaacuugccugaggucacccagcuaaaaaguggccaagcuggggugcaagcccagcucugucugcuucugggauugggacucuugcgcucugggccaugcauuucuuaguccagaugaguugucugauuaaugaacauggguagcagagccucucaaccuuugugcacauugccagggcaucaccauugcucacaggaaugugucuguccagcagugcuugccuuagugugaaaauagcacggagggguuuucuggaagguuugggaguuuccccugagaacaaaugaagcgucuuuuuacuuuuguuuuggaaaugaggaagcauguuuucaaagucagcaccaucucccacacugaaaccacagaccuaaacagauuccccaaccucacggucuucucaaucugugaccaucucuccauuucucccuggggguugaaacugccauuuugacuucuccagacucuaaggagcuucagcgguucuuuuuggacugugggaguccagcccuguggggucuaagaaugaauuaauccuggcccacuccuuagacuuccuuuacaggccuauuauuugaaaguggcuaaguaacauagcuccugggggcugaagugaggccucaggccuccccagcucacaccagccacuccuuccggcagccggcaaccccagauccuuguaugugacaggauccuuuggcaggcacaucccacagaagggugcauucccagcccucuccuuacccgcaaggaagagauuucuuaaguguugcuuuaacagguugaugcaaaauaaauaaacagaaagggagggagagggagauggaugguuuucaguaaauaauggugcagcggccagcaguuggaagggagcuggugggaggaaguuucccaccuaagcaguugugacaggaguauuaacugggagcccaaaagcagcacaaacgcagcacagugaggacugccagagcacauaccggggcuggaaaaugugugucugucaagauaaaauggugcauuauguuugcaccuucccaugaacggagccaaggguaucuuugaggugccugcuucccagcccuggccaguuugacucugcuucaaaugagcacaggccuccacuucaggagggcagccugcccugccucucacugaggcuaauaguugugugcacguagacagugggccccuggagacucaccccugcuuuuggagaaagguuuuuaucgccuuaucuaacaugaggcugauuccuuuuaagaacacauguugacuagacacugcugaugggaaccucgcagagucaucuuagggaggcgguggcccacggguggggagucuuugucacuaacaauuaaagaagggauggcccaggggaaaauugaaacagggggcuggagggagaugggaaaauaaacaaaugucucugaaacaucccccgugugccuggcacagugccuagccccuuacauauauauuuuuuuucauucuaucuucuccccagccuuguggaguggauauuuuuauccucaucuuacagaugaagaaauugaugcucaaagggguucagcagcuugcaaugucacagagcuaagaaggagagacuaagauucugagagagcauaauggaaauaaaaauggugcuauugaaggaagaaaaaaauguguuuugugauauuugauagaacgaugcuccugcucuuacgugggcaagagauaaggccuuccagccauguguuuauucacucuguggcuuucacaaagcacaacgaccugcaguaucucuguuugccagucuguacaagcagacauaagugcccuucgcuuauccaucugaaacaccuuaacuucugcaaaugaauagagagacauaagugggagcgacacagugguccuucucauguccuucgagugaucuuuucuugucugugccauccccacccagguaugacuuuaucgagauucgggauggggacagugaauccgcagaccuccugggcaaacacugugggaacaucgccccgcccaccaucaucuccucgggcuccaugcucuacaucagguucaccuccgacuacgcccggcagggggcaggcuucucucugcgcuacgagaucuucaagacaggucaguguggucacacguaggggccgggagaugggcgucuuagagaagaaggagggacagcacccagugggcugaggcacuggguaagggugacagugucauccagcuugagcauggugagagguucaaggugaacccacaaacaucaugagaagaagagccagcucagauuauccaccagcuuaagggggcgggcugugggcggggggguggggguggggucaaaacagccauuguuugugguauuagacaaacagaaaaacacuucuugaaagaauuggauuuuuguauguuuuuuaaaaucaaaauaaucuucaugggaaaaagcaaaacucugaugacuuucucacgauuacuucauggucuaaugaugucuuuauuuggaacuacauggggcugaggacauaaucuuuucauuguuuggagucucuaaagaucuugccaugaccucccaaauggggucacaccauagcuuuuaaauuaaaauaagguuccuagaaauuccccuuggcaguccauguuaccaccucuguccauugaaccccuacucucuaaaugccaaugaacuugacucccugaaaagcaaucaaaaaauagcagaaaaagagucagagggcacugcacuugcuuuaaguugacugcuugauuuccaucaggucccccuuagauuacuuuagggccugagaauaugggccagugcucauuuccaaaacuaaauacagcagacuuuuauucacaagaccccgcuucaucagcuacacucaagcucucccagugguguguccucuucugugauguguggagcuuguuaucucgaggcuaagggaagcauguccuccaguccuccccacccaccacccacucccuuccucagaggcuccccuuccaucuaugugugugucuccccucuccccccagcagcccaaguuuuacaacucguggauggagucugguucgaggggagguugucagccuugucaucaagaggcccaagaccggcgccuguugaguucagugugaggggaacuauucauauauauuuucuuuuucacuaaacagcucuugaaaggaagugguagcugcugaaagcacuuuuuauauccacucugucuaaauauuugucggauuugucugcccgagaacaagaacguggaaucaaaugaagggguggggcaaggggacugugucaugcaagaguggcagcccaggcugcugcagggcacaggucccaagaagguuucucugccuuggguuuucaugcuccugacuaugaugaggucacaggggcugacaaucuguguguccaguggcucaagcuguugugaggccccugaauagcuugauccauauuccccugagucuugugcaaaauucagaucaaugccaccagcaccaguggagcauccucugcugccgagcaguggggagaauaaaagagaaagaaauaaaaggggaugcuugcucucuucggguuggagaggcaggugugcaaacccuuugcacguaacagauucgcaggugauguuauuggaugaguauguauguaaauugaaaggaaaacuaugauaugaggcagaaugaauaagugcaaaguaaagguacaauugacauguggugguuaugaaaaugggggagcagucaaguggcuuagcaaucgaggggcuccagagaaucuauucaauagcaaggucccuagugcuaaugcugccacucggcugcacugugcuggccaugaaaggaaaacagcuccaagcaagaucuuccaggaagcuggccaagggaagucagaacaagggugagcagggccaugaaaacucagccuuggucucacaccacccaacuuaguauuucacaaggcaucaugcuacauucuccagaaagccacaggaaaagucaauguucacucuauccaucaugcaaauuugaaaggaggauauuaaaagauaaaacauguaagaggguaucauaauucaauaucgcugucuugaggacaugcugaagcaggauuucaaaugaagcaacaagucugugaacugccuagaaacaauggugccagccaacggagcuagguggcuucagcuuggagaaaugggguggccugcuuuaaggauugggguugccuagugaagagauuguaagagaaagcccugccaacaacagccacacuccuggcaauguaagagagcagaugagagcccauagacuucucagggccacucguaccugccgucauacccaccugcugcuggaagagcaacuguccgcaugacagucagucuuauauaugccgggcgcaguggcucacaccuguaaucccagcacuuugggagguuguggcaggcggaucaccugaggucaggaguuugacaccagccuggccaacauggcgaaaccuggucucuacugaaaauacaaaacuuagccgggcaugguggcacgugccuguaaucccagcuacuugggaggcugaggcaggagaaucacuugaacccagaaggaggagguggcagugagccgagaucaugccauugcacuccagccuggacgacaagagcgaaauuccaucucaaaaaaaaaaaaaagucaaccuuguauaaagugcagaaaugugcaagggagcaaaauucaaaacagagaaguuuagaaaaaugagcauucaugcaggugccuuguccuauacccacauuuccauuguuggagucaggagagaaaauauacaaaguuuacgucauccacagaacaugaaagaaauggguggacaugcugaagaaauccaaacaaacacagcuauguuugcuagucggauucauagagaggaagaagcgggggaaacuguaaacacagauacgcaaauagccauacagagggcucuagaagccuucgaugguacauuacccuggugaggcucugcuguaggacccacagugugagugcagaccagggcauguggcuggcguggaagguucaugucugcccuaagugaagugguguauaaaagauucuauauguuaccagacugucuacauuuaaaaggguaagccagaacaacuuacauacuuaaaagaucucaaaucaagauaccaugagcagaacagaaacaaaaaaaaaaaaaaggaauuuuuaaacguaaaaugucacauugaaaacaaaaucaguggaaaauguguguguguguguguuugguuuuuuccagaagcuccuuuaaccauaaguucaagauuagguuuucuuuccuguuugccugugacacuucagaaacugacauuuuuggggucauucacagagguagagaaaacucggagugccuacugccuccacuuccugaauucaggaacugaauucaccuucugcggggaaggcaaacucagcuuuggguaaauccacuguguuuuaaaugucuugauaccuauagauucuucuacuugcagaguuauuguaaaauucacagcggaaaaacagaguggacauuuuucauagcagagucuuuuccuaugaaaucauucgcugcaacccaaaucccccagcuucuguagacaaucuuagccuugagugggcuugaguauuuguugacuugaguucuucguuuaaccuuuaaaccuucuaacacaucucagaaaaggaucuuggauaaggcagaugucugcaagagccagccagcuucugccuccuuuucugagaucucuuccuggcaucugcuauucagcugcuuuugugaugcugcaaacagugagaugguacgauuagagaugaaugcaugauguuaacagacagguuuuauuuuucugcauaaaaauagauaaaacuggacaaaaguuuuuccaccgccuucaaaauaagccaaaggauauacccauuuauagccauauaucagaaaugcuuuuuucuuucuuuuuuuuuuuuuuuuuuuuugccuuaaguaccuaagguugaaguuucuuuucagucaaaugcaggagcucaggacccugggaacuauggauacuuucaaauuucacauucuccaagccucucuuagacucacuagauguccaucguggaagcacuugugcccuaccaaugacaggaaccaaagaaagauuccgccagaaaauuccccacucccagggggguggacauuccccuugccuucuaagggaaugacaauagagcaagcucuaagagggcaugucaggaugcucuuucuagcucucaagcaagaagugaauagagaguuaauuuccucacaaccaugugugaggcucagcugaguggcccgcaugaagaaugcugcacagcagccauaaacucuaaccuuuucaaaauuccucuuggcccccugaagacccgccagcuggcuuggcuuugcugaauugccucaucccgggccauugaggaggcccucaggaguccgaagcccaaucauaaacaaagcugggggaggcagccccagcucaucccuccaggacuagcugcccauugaaaacucggccugaccugcugcugccaugcauaugaaugauggggugcagagccucugagauucgcugcuuagagccuccacagaacccaugcaaagguuagcccuugcccucguguguuccuagucccuacccugccaaagcacagcacaagguggaaaguaggaagugauggauggauagguaggagauacuggaauuuucugucuggugcugaagaaaguugcaacuccuccauccgcauuuauuugcauggcacuucuuccaaaucagacauuugccucuuuccagaaugcugucaucaauaaagagacucaaugagaggcccccuacaggagcugcggauaaaggcaucgcugcaggcucagaucaguguauugacaucaccuaguuauauuucagugugagccccagaggacacuuccugacaguaaacacccaguuuaucgaguauuucugguugguuguguuuuuuaugcuuagagugucuauuauccuccucaaaaauccugcuuccuuuucuucuuuuaaaaucugaacauaacgagugaaaucaauucuaauuguccagcacuuucauucauugcgugaaugugcaugagcucgugcuucguggguccaugggucuggguugcagugcucccgggacccaucuguggugcugcccuggcaaaugguggcugguuaaagcacaaggacccuuuuaauaugacuccaccuagaggcauuaagagauaggguggcuguaauccucuuaugagcuccuguuccugcuccugcugccauccaagcucgcaccaggaugcgaaugugugccgcauuuaaucaggaugccuccaugcgucccaagaaagcagacgcaagagcucaggagagaaacaaggccauccacaccacaaaggagccagaagccuuccaaaugucaaugcacugcugcauuuuuccaaacuuguugccggagcggccuuuaacauccccaacggccugcugugauccaccagcuaaaaacaucgauuguuaauuguccgaccacuacagagcagcucguuuuaauauagucaugacaugaaugagacccaagcuccccuuugccccuccccugaggcaccuuggaucuuggagggagaagggggcacuucguuggcugugguacaauaggggcuaguguugaggucagcaacaaauaagggguaacauuguuuucccugcuggcaaucagcaaggcuuccuuaaggauugaaauaacuuacauuucuggagugagcagcugaguaauugagaaagaagacucuguuccucuuuucaagagaaucccucucucucucucucucucucucucauacacacacacacacacacacacacacacacacacacacacuucucuguaccuccaccccacuccccaauuccucaauugcugcucucacucuaauaauuauguagagcaagccagcugugccucccuaauuuaugagggcuugaaacgugcaugugaagaguauguugcuucaagggccacuccaguagcaacaaaaaccucaagagcagggggauuuggggccaaacauuuaaauaacccaugugacagaggccacaaagaaaggcaucuucuucuuagugcuacaguucucuuuuacauacaggcucugaagauugcucaaaaaacuucacaagccccaacgggaccaucgaaucuccuggguuuccugagaaguauccacacaacuuggacugcaccuuuaccauccuggccaaacccaagauggagaucauccugcaguuccugaucuuugaccuggagcaugacccuuugcaggugggagagggggacugcaaguacgauuggcuggacaucugggauggcauuccacauggugagugaugucaugaggcauuccucaguagcuuggccuuugccuguuaauugcuuuagugaugauaaagaggaagaacaaagacuucaaagcuccuaugaguucuuauaugacccauggugacuuucucuucuuccccuucacuaaggauagcuugagagaaauuacaggaaggcugucuacuuucuuggaaauauuucuuuagaaaaggauaggagacuaaauagauacuuggaaaggaugagaaaacuuaaaguguucauuucuacuccaaauugucaggauagaagguggcucaguggcuaaccccugugacaaaacagaaggacuccagagccagacuggccgggcuuaacucccggcucugcuacuccccagcugugcaaccuuagacaaaucccuuacccuaucugugccuuaucuguguuaaguuagcugcuaucaucaucauuauuacuauaauuuuaaaauugucauuaauauagucauaaauauugaaaagguacaucacccaaggcuaacagccaccaguacuucgcaggugaagaccaacauggaucuugggucuaauuaguauuggagaggaacaaaucuuucacuuuuguagucauuguaaguuuuuucuaauauaaaggagacuugaugacuaagcaaaaagagcaauuucauuuccuggguaaaucacaagacuuagucagaaaacuuggguuguaggcccagcucugcuauuuccuagcaguaagaauaaagaaaucacaugcgcucuccaaacuucaguuucuuccucuguagaacagacauuguaaugauaccuuuccagcucaucuuccaggccacugagaacagaaugaagccagugaaaguggccuguaccuuuuuaaugaaaaagugaaagugcuuuuugaugugcaggaaaaauauuagccauuguucuugaaacauaucuuugguuuuuauggcaagauguacaaagugugcuccacugaaugaaaugcaaugaggggaagggaaaacggagugaaaaccaaguuugacauuuugauuuccacugacuucucuuugucuugaauguccaguuggcccccugauuggcaaguacugugggaccaaaacacccucugaacuucguucaucgacggggauccucucccugaccuuucacacggacauggcgguggccaaggauggcuucucugcgcguuacuaccugguccaccaagagccacuagagagugaguuggccgauugggaaccucuguccuguccuuccgucagggcugugaggguguacaggugaaggggggcugagcucuuaugagggaggagaugggaacucuacggaauuuaugguggcaucugaguuuagaggugcccacauccucuugccaggaagagguugaugagaaaagaacacauuucaaucugggugcuucuuucuuuaaaaaauauauauauguguguaacaagaauuaguuauuuucagggaaagucaugguaccaucucauaccucaguuuccucaucuaugaaugaaagagaggcuaguuaggaugaucuauacagggccccuccugugcuaacauuuuuuuagucuguggccauuuuuuucccucucaaaaucucaggggcaauugucacaaaagugaaccauuuuaaaccucucuuucucuggauuuuuugacauuaaccaucucugggccuggguaauguuuuccugacuagauugguacaacugcuuagacuuggacuucacccuuccaccaaagauaguuuguggagcuucuaguaugugccaggcaccaagcaaggaauuaaaaacuaucacucugaucacagcugcugugggaccugcagucccucagcacugagcaacaucuucaaaucagcugcucuuggacauguguuucaaauaugcugccauuucuacuuaaaaacccaaacgauaacuuuuuuuuuuuuuuuuuuuuuuuuuugagacagagucucucucuguugcccaggcuggagugcaguggcucaaucucacucuucccagugcaaccuccaccucccggguuuaagcaauucucgugucucagccucccgaguagcuggaacuacaggcaugcgccaccaugcccagcuaauuuuuguauuuuuagcagaggugggguuucaccauguuggcuagacuggucucgaacuccugcccucaagugaucugccugccuuggccuccccaaaugcugggauuauaggugugagccaccauguccagccccacauaacuuuaaagacugaagaagcacuuuuaagaaagauucaagcuguggaaauccuacccugauugcagacaacucaccauauauauaacuacagacacggcagccuggccugcaggaagguugcuggguuuugcauuuguuuuuucaucaaagagcuucugaagauugagugacaaagaaacaguauggcaaauugcaccaggucccgugaauggucagugcagucacagaguaaagaauagguugauaccugauaaggauugcuggccgaucuuagacacaugcacacacacauaucgaucaguguugauggcauucauagaaggacagcaaugcaacugacagcacagggccagaguaagugacuucugggucuauuuguccagacagguggugcgggggaauagagagugacaugcaugugcucauggagagauuucccaaagacaaguauuuaugcuuuguaaugucugucuucugugccagaacucacaagacaguugagugaaaaaagaaagaagcaaaagugccuccuggguguuuauuaauaaagcaggcuucccacgauguaugagcucacccaaaucgccacgagucuaucucacauuuaccuguauugcaguaauggugcaucuggcaucuguagccugcagcaauaacaguucuugugcuuuagauuguauuuuuaaucuguaugaugauucucuuauuuauccauagccugauuucuuuuaggucccauuuaguuucucucagacccagagggguugucaagcuccaugacuugauguaguuguuuuuaaaaugugagcauauaauuagggucuuuuaaaugaggaagugccugcaaggacuugucccuagaagggaggcagcauuugggggaucccgagguaugagguuggaaggccuaacugcauuugaccgucugcuuuccccagacuuucagugcaauguuccucugggcauggagucuggccggauugcuaaugaacagaucagugccucaucuaccuacucugaugggagguggaccccucaacaaagccggcuccauggugaugacaauggcuggacccccaacuuggauuccaacaaggaguaucuccagguacuugugcagauaccagaggaugugagaguguguauguauugcugggguaggaggguagcuccucaaauacaguaggcagaggacacaaagaaaauaaacacagcauaccugagaacuccauucauucauucauccaaacagauguguaugccaggcacuggguuacaugcuggcauacacugaucagagggagccugccccugcccuuguggggauuacugggccuggggagaaguuguuuggccaggaugcuguuugcccuaucacuauagauauccaaggaacauuauauaagcuguuuggaucuuccucauucuuggcacagggaggcaucagggacauggggggcauucuccuaaggggagguuuguugaggugcuagcugcacaugacagcuucucaugaucuuugcuauuggagagagcccugccaggaagguuuugcacagagcuaucagaagaacacauaggaaaaugucacuaccaggaacagaacucaaggugccccagaugcucggcagcaucucuucagaccauuguuugcuuuauucugaauaaaccuugcagcucauguugaguaaucuucccgcacugcacacugcuccaauucucauccccugggaagaaguaaacagggggaaagcaagcuacuaguuccacaccagagcagugacugcuuuuaugacacacguaagacagccuugugacccacugacaagccuguccuagcucugaggcgacacagugaccucugcucuaagaaggauauugcaaagcagacaacaggaaagggagaaacaccacuuagaaacuccagggaguccacagagguucuaacaguaagcccuggggccauuugucauugucucuucucucugccucuccaaaaauccaucuccucgcagccugcaaaacuuccagaaaguucuguauaacuggcauccccuaucuuugaccuuaaucauauacuuucgccuauugcuauccaccuguuucucauacguguagacagcacuauguacuacuuauucaaauguuuaguaaugcugagcacauuguaggucaccaauaagugcuuacugaauugaauuuagccagugugugcuagcuacauuuuggucauauggagacugccauuaagaaacaccauggccaucaaaggaaugacauccagcaauuuccaaauggguuuggcauugugggaggggaaguaccuuaaaauguuggccauccuccucauagagcaaaaggucaggacucggugcauaagccuaauugcuugggcagacucuacaugcccuuugaccccuuagugaccugagcaacuaaauacacaauggagcgagaggguguggggaggggaugccucuaugagugugacuuuuggaacuagggcauuauaagugaguuggauugaacuggacaggaguagaguggaguagauucaaccuuguuucuuuaaagcagcaucugcuuccacaguccaaggcaggccaucauuuacuaagaagggauuauagcucuagauguucaaugauugagaaaaaucgaguauugucccuucauauuugcaaaagagagaaaaaagaaaaauaaccuaacuuuucaaggugucugauuuaguguaagauaaugugaguuuaaucguccaauggaauugcaaacugauacuaauuacaaguaugucucagugaaucacagauacagguuggaagcaaagucuaaugauuguguccuuuggaaaaaaacaagacacugcccuguguugggaaugguggucucuuacuccagcccucuauuccccagguggaccugcgcuuuuuaaccaugcucacggccaucgcaacacagggagcgauuuccagggaaacacagaauggcuacuaugucaaauccuacaagcuggaagucagcacuaauggagaggacuggaugguguaccggcauggcaaaaaccacaagguaaauccaugauccuaccuuaaaggcacauuggaccagggcaggagggaugggaucaggggagcuuuaagccgaccuccuacaggagagagggccuuguguagucaggcucagauaauugauggaggcaagggucgugcuggccuugaaaaucuucucucuuaggcuaaagcgauuggaaaacaccguuucucugacagccaguugcuguugcaucuugcgcagcagagagagagagcuugcagaguguucucugacuucaaaugaaggagaaaauauguccccaguccacuucuccccacccaggauucacugaacauuuauggccugagucccuuccacaugcuggguuaacaaucacaaaaccacaugauacuauaguucaggaguuaccgagcucuggaaaugaaagggcacaaauccugagagggaaucacaauguccuggagaagaaaaaggacaauaaauaaugaggagaaauucaguuuguuggggaugggcucugaacuggcaaucaugcuuagcggcgaggcauugaauucucucugcuggugccucccgcaucugcggcucccggagguguggucugugugggugauguggggcuuuuguuguauacauauggaugaaugucuggcacuccacuuucuuaagacaugacauucugggucugcagcuggcacaggcgaugugcuggcucuauguguauauacacagcacacucagcccaugggggcuuauugcaaacagccaggggcuuguguggguaggauugggguaucugugaugggaacacagggcacgaugcccccugcagagcaggagcuggugcagaggucuggaaggagagugugaugucugggggauuccuaggggcugccuguccuucccuaaaaaggagguagggagggaggaagagggucucuccuguagcauuacaguuccaccaagcccuggucugucagagugugaauuaucaaaauggggcacauguggccaagccuagggaggccaaagaucuuuuccaaagggaaucuccucagccccugucacugccccgaggcagcuugcucugacuggugcagcuggaaaccucagacccagaaaauucugaacugugauguuggcagucucacuugggaaacgggaaaaggaguagauuuuuaaaaaaucaaaaucaccauaguaacgggguaccacucaucugaaaaccauggcuucuggauauuaccagguaucucacacacaugcacacaauugcccgauuuccacgauaaggaaagugagguacuuagcaauugaaagaugugccaggccaggucugguuucccacugacuugguuucagaaagacuuaccaagcauccguugggaaugcccagccugaauuggcacugggugccaggagcuugggggcugagaccugguuccaccccacccuuuucaauuauaaaccgguagaucucggaagcucagcuagcagacgagggccagaagccaggcaggggugguccccggggagaggaguggggcucaccugauugucucccuguccaggcgcaaugacuaagcagcacaggcccagagggauacuguagcauaagcuguuuuaaaagcaugcagauggaccaggaugcuauuuaaaacaucauuuguaggaaaucugcuuuuggaaauaccuuagcacugcacauuuucauagaaugcuguccucccuggcuuuaucccugguauucauucuucaggaaagauauuccugaaauugaauuuagcuuucugguuuucagaauuauuuuucucaacuuuuucauaauggauauauucucucucuuuugccuccucuuuccccacuuggcuagauuuaguuccccagcagccaagggguaacuugagaguuuuuuuguuuuuguuuuuguuuuuguuuuacugaauuagucgugcccaaauaaauggaguuggggcagaggaaaagcccauucucuuccccauuagaaauucauccuuuguguacuuagaaggaggcaggaaaauggagagccugccaauuaggcaucgccccacucuccaagcuccuucaccccacugcgggugugguggacgcccaggggcuuuccuugucuccccugcaaggauggucucagcugccccuucauuagcagaucuuucguucagauaucuguauuuaaugugcagauucccccucauucacggugcgucagcgcagcucucugggcuguugggguugaaguaguugagugaaccgugccaaauagauuugucaagucugccgcaguuugauuugaugccauggggggagguggggguuggggagggacuugggggcaguggaggaagaggcuucguccaugccgagugccaccacugaguuucucuuuguagcugcuggauggugggcacugugccaagcuaacuggugcuaaguggugggcuugaaagugaaauucagacaacaggaguuagcagaaaagcaaagcagagaugaaggcaaccgccugcucugcucugcucugcucagagcagagggaagguuugcaaaugccuucccggugugcagggaaggaagagggaauagugacauuugggacagaaaugugggaacucgauuucaacucccuggucacugucaacagcaaugcagcauaccaaagaccagggaauuggggaagucagagaaaaacaaguuuaaugagugcucaagguggcgggggagggcuguccuaugucuuugcaaaacacuguuuacaauguggacccagacggggcugaggcaaggccuaggccucugaaagaaugccuuccuuuuuacugccagugggugagaaagacuaaggaacucuuuuccagccuccccuagccaggcagcagccuguucuuggucucuucccauccaacaggucaucaugaggucgccuaugagaaaguggucagucacacuguugcuggggcauugcaagccuccuccuggcaaacgcagccugguuacacaggccacaugcacagcacaucccaaaucuuuauccaauuccacaugccauaaauauggaaccuaugauucucauacagggugggcccgccuuauguauauuuauggcauaaccacaaggcagagagcucaucugccugauggaauccauauccaacccacgugcuccuuuagauuauacaaauugcuuugcauacauuucuucagaaaccacaagcagaaauuacugcuuuugguuuccccagcuauauuaauaacacccuagaugcagacauggcauuguuaauacaacaguagaagguucauguauguuuacauaauuauaggcacaauuauguacauacauaccaagaagggcgcauggagagcaaugggaagagcucagaggcacaaggucuuggucuaguuccugcccuccugagaugcugauuccaugauucugcacuggggauaggcugugccucgggaauggaaccacagcuggugacaggacacgggggagagagacuacugcccuuauuugucuaggcaaaagcccuuaucuucaguucccucucauucgguaaacguggggaucucccuuguugacacagcucuaguuagucacaguguuucugggcuauucugaugcauuuggaagaaauuugggcuaaaagagaaagucuguggggugccaaaugcacgcuauuggccagaucgaggauggaugggugaagauagggaugagguaagacuuggguccaagaauuuucagaauuaccccaccaggaguggaaggaaugcacugaguucaucacauuaauguaaggaugaccuccaagggacucagaaaauccucaggcaccagcuuauucacuagaguauuucacagaguuucacaacuguggaauugaagcucuuagagauuaagugccuugcugcagggacuaggaaacuggagccugcauggacggcgccuggucaccagacuuggauguccagacuggcgcucuccacaauccgcccuaggccuuacucuucaucuugagggaaauuggcuuccuacauguucaguccaaggacugagagguacacauuuuccuggaaagccuccucuucagugaaguucugcaugcaggaugagccuguacauggcuuaacccacuaggcucauuauuguggagcugggcuucaccacagaaucaugaggauggagaguugaaaggaguugccauuuguuugauuuggccacaucccuucaaaacaaauaaacacuccacuucaaaaauccucuaucccauauuuauuuucuaaauuaaaacaaaucauuuuuaaaucagagacuugggaggagagaaagaguggugucagaaaaccaaacccucaaaucaguuggcuaacagcuagaggcacgugaugucuauuuucagaucuucuuaaacagggcaccgugugaucuuggaaacaucucuuaguggcugcacgccucagcguuuccacccaguccaaauggaauggcgcugcggcugcuaucggcaaagcaccuugagaucuguagauggaaggcucuccgcggauauaauuaauggaguagacccacaaagcucuucuugagcagaagcaaguuaucaauuuaaaaaguaagaaggccccaugggauauuuaugggccucuuuuaaaaucauaggccuggaauggaccaugauaagucauccagaccuuucccugcaucugauggggccugcauugagcugccucagauaaaugucauccaucccagccucacuguucucuuagggaugcaauuaugcuucuacuugaucauuuaaguuuucaggaaaaaccuuuuuuuuaaaaaaaccuccuggcagaugaugggcuuccccuuauuccuuuugugguaguaauuuuguuuguugaauaugagaugaggacaauaccucacacuguaaugggcaccagccuucagaagucauguugcgugugcucugaagggggcugauaccccuuccaaguucaagucccucaguuuaucugacccucucaauuauaauggagaaggauccagugcccuagguaauuaaguuugucccuuauccauuugccaugggaugagcucagaccuuuagccucuccacuuaggaagcucaggggaaaauuucauuauacagaagcuugaaccuuuucucuaucaggcucccgcggccagcgucacccagcucccgugggugcugaacugucuccaguagcugaggcgcgccucccuggcgcugauagccuugauguuaaacuccaaggccccggcugugcacagaggccagugacaaggagcacacagaggggauguggaagggcgcugugauucugcuugggcuguggaaucauguuccuugccccaaccccaacuaauguagaugagcacuggagugaagcccucaccugguagauuguccugcucucugaugucaccuugucccugcuccgguuugcagagccuccaccugaagaggcaggcagguggcagaggucucuggaaccucacucccuguucccucaaucucuccccaccugggaguuaaaggcaccuccuuaagaaaacccaaacaucuguguuaggagguuuccagggguggagggcccaccccacccagcuagaauguccuagaauguccgaguuucuccuucccucuuccuaggacauugacuguuccccccaagcccgcucauugcucugauccugugcuccucccccgccugcucuucuccagccccaccccugagcugcccuccuccccgcuccucccugaugcguuccugucucaaauccugaaacccuaauccuguuaguaugcuguguuccaggccucagcgucucgauggggguaacauaaucccgcaguaaaucuagcgggccccgcaggcccacacagauggggaugcgcacauccccgccccccagaacgcagccgccccugugccucugucuccuccuucauguaggaaagcugccugaugacaaaaacagcccgaaaguaaaggaggaugagagcagaggucaucagaguccuaaaugugcauuugguuguuagacagcuucuuugccuaccggcaucccuaccuucucuuaaucucucucuguguuuauauauauauauauauacauauaucuauguaaaguauacacgugcacacacacacacacacaugccucuaacucuauaucuggcuaaguucccacauccacuagaaugaaacaagcuuuaaaacaaguuuuuaaauugucuuuaaaggggaguuuuaaaggagaaagaucaggaccaugauucacaaacaacaaaaaaagcccauugccuucauaucauuucccaccgcccccccccaccccgcaucgcaacaguucccucccccuacuugacuguuuugugcaacaaauuaauuaaacaggauggcauucauugauuagcaauuuauuuuuacguguagacccaauggcugguuucagagcagaugcaagggaagggggugggagagggaggacacacagaucugcagucagggugagcggaugagucagcacauuuguuccugacacuaguuuuaaaaacaugcuucuggcuucccccagccucuguccugcauuccugccacuuuucucuucugccugcuuuguuuucccccuucuugagugucugugccaaguacauugaaagggagaacuuuggaggcaaugaaacauuuauuaguggagagaaauauuuauuuuaaaaaagaagaggaacaucucgugcacaaugucuaccccagggcuccagcacugcgcugucuuggaaauauuucccugcuuucuuugcagucccuggagcuggcugacuucagauauuuacagcaaaauagaaguaaacaguaguucacaccauagguaaugaagagaugggagugugcaagcugagugcugaagcgcuacucacaugagagguggugcacgugaagagagacuguuuuuguaccccaaagggcccgccucauuugggaagggugaaacagccagccgugucucuccuccaaggagcucaaagacuuggacagaaucuucaucuuaggccccagaggcaggcaugaugacagguagcaucuacacuguccugggcacauggguauugauagcaaagaugaaugguauauaagaaaaggcuuuaggcugggcagaaaaauuccucugccuagaggccuagaagguaggaaggcugcaaagcucacuguccucagcuaugucagucacugcauauucuucaaagacaacuuaaggaggggucagcaaagaagaggugacugugacuagaaauggggugggaagcagagaaaauguucugagauggccucagaaaccaucaguaaugcguucuggcuggaugcuucuuauuagauuuuauauauauauauaauuauauauauaauguauauuauagaauauauucuauauaauauauagaaugaauauauucuauaauauauauuacauugaauuauauuguccaugccuuguggacucacaggaauggucaaaaugcacugauuuucuuugccugggaguguagauaacaaccaaacugggaugcuggauagcagcugauuuaauuggcaggucccccacuccccuagaggugcaaaucagaaaauccaggaaaugcugaugguuuucagguucugggcuacugaaaacaaaucagaggucucaagaaucaauugaaaaaugcuggauuauauucagaauucagagaggcacccaauagauuauccagaccacuuugugcccugaaucgcuuuuuaaacuugguuugcagagaugcacuugaagaaaucuuuauguucaacuuagcucuuuuuaaauacgcacacacauauauuuuuaauaauuacaacauaaucaacacuagcaucagaaagcuagggucaccuugaacauacuugugauuuuccuuuggguaguaaacaaccauacuaagaucuuucuuuuaaaacaaauaaaaagugggccaggcaugguggcucacaccuguaaucccagcacuuugagaggucaaggcagguguaucacuugaggucaggaguucaagaccagccuggccaacguggugaaacccugucucuacuaaaaauauaaaaauuagccaggcuugguggcgcauaccuguaaucccagcuacuagggaggcugaggcaggagaauugcuugaaaccgggaggcagagguugcagugagccaagauugugccacugcacuccagccugggugacagagcaaaaccccaucucaaaaauaaauaaauuaaauuaaauaaauaaaaaauauauguccucugugacauccagcuucuaaagcagauguuaacauuccuaucugaguauaacauacaaggcaacccaccgauuuuucucagauaccucacugcaaaguugucaucugaaaauuguuggccugaaggugggacuugggaguagucguggcuuuuggaacuuaaacucucccaccugugcaaagacccacuuguuacuugugaccuggcuuacacgcuaacauuuguccugggugcuaugcaagccuuggagggagggccaguaaacuuaagugucuaucugcaagccuauuaucgacuuuauuuuccugaaggagaaaccaagguaucuaagguuuauugauuugccuauaaugauucagugaguugucagggaauagggaauaaaaccaauuuccuggcgucauuucccaugcacacaaccccuuaccuugcaaugccuagacuggaagccaagaauccaucucagugaauuugaucagaaaacauaugaagggugauucuaaaaccacagaagcauugagaaagucauaaagauguauaauauaugauagcauuuacuagcuauaaauaggggagaugcagggagaaaaauagagaccuuguaaaaccauugggucaggauaaauagaaacugcuuaauauuucauuaaaaauggauuuucauaaauugcacuuugauaucuuugggcaaaagacaauauguaaggacuaaggcguuguuauucauuacucuuuguuauuaauaauuugaacugguauugaaccaacacaucaacaagguauagucgcccugugaauggggcacuccccauguguucugggcacuauucaaaguguauaaaaaguccacagccaccgucugcaaaagcacuuaggcuguaagggacaacggguaacuaaagugcccuguugcaaaauggacacuguuagagcaguucaaaccacaaaaagucaugcgaagaaagguuuagaagcaggggaccagagagaacccuacaaaucaacucauacaauccccucauuuaacagaggaggaaauuggggcccgagggagguagagauauuugcccacacuuaugagcuaauuagccgcagagcacagcuccuggcuucugauucaguaguguuuuguguguguguguuguuuuucccacuauaccacacucagagugagagguguguuaaaaaaucuaauaagaugguguuccuucaccauccaaagaacagaaggcagaugugaacacaaagucaagagcagacaagaaaacaguucaggaacuaggcuuggaaacgugaaggguaauuugaagcuaaguugaaaagauccuucauuugauucaagggugggagaagagugggcaaaaugaaagggcagacugaaguucaauugaagcagucagguagauggccuaggggacacaaacugugugcuugccucccuuccugaguggugcuacuguaagcagagauuaggggguucacccagagccuguggccacauguauccaugggaagacugacccccucccucagcucauacaugcgagugcgugcagcccaugcccaugugagccacacucaugcacacaccgccaucccaaagacaguccaaauacacaaucauuuacucauugaggaaagaaaaggucucuuagcguugccugccaaggcugagaaaugcaggggucggauaagauaaaauuggauauuaacaacacauaagacaugcuguguuucuaaacgguaccagcgugguguguaugcuguggauuagcggcaguguuaaaguucagauccacucaacuuuccaauuaugcauucacgugacaaguaaagcuuuuuucacccaaugugaacuccuuagcgucuccugauggcgaccacacacacaguccccaucaccaucuucagagagcaagccaguggaggccccccugcugcugcucacaacacccauccgaaauaagcaaagugcugcauuugcuucuuccuuuccaaaacaaaacaaagcaaagcaaaacaaaacaaaacagaaagccucugccucaugcugaauucucagagaacugaugaaucucuuuucuuuggauccaguuccccaucccuuuccugagagcuguggagcccuuuuucaguacgaaggaaguagggucagucaccacuccccuugggccuucuccagggugucuggcccuaaccuucuuuccuucccuuugcuuggcuuuucuccuucccucgcuaacuuggucuucucacuccuucucauccacaaucgcuauacaggaagcagcaaaaucaaaccugggagagaggcaugacuaacaaguucuuucccggugcucccugcugucaaccuuaggacccgggugggaggacuucccaggggaggagagggagcagcaggcugggugcgcagggggcacccccagauuugguggacuucgcaccagaucaaugguuuaaacugaauaugguggaccagcgaaaaucugcuucccuguuugucuucagccagccacuucccuucauuuacuugcaaaagguauggugucuucagugguguguuauuaaauggcucuaacuuuuaaccuuagcaagcaggaaauagggcuguuaaaugauggaguucacaguucauggggaagaaaggacuguguugucaauuggcuguagacuucugugcugcucuuugccauuacucaaagccauucuaaggugggauuauaaacucacacuggaaacacaucacuggacagugacucuaccuccauucagcccaugccuggagacuuuaagggccccaugacucccagccaccagcauaaacacugcaaauguguuagaagaaacuacaagcuuaaaaccuaaaaacuuggcaaggauguuggauccagacaggcaucucugagccucaguuuccuuauccaaugaaguggagauaagaauaucuaccuucugggguacuauagauauaauuguuuauacucaaagauauuuuguugcaucuggcugaaaagucuucaaauauaccaguuuccccaguucucuugucccagcccuguuggugcccccaaacacuuggcauggucugaauaucaggagccgaaacaucuaguucuccuaagcaggagaagucgcugaugguugcagaguuggcuguaaguagauuuacagagucccuugguuguuacagcuaugacagaaaugauuuagaagugaugguugguuaguugguuuuucccucuacccuuauucaggaaaaccaagggaaacucacauauacuuugcucuaguuacuuuuuuuuuuuuuuuuuuuugagcagagagcacaaaaaagcauaagguccauauggcaguuauugaucugggccaucuggaaagccaggacuugcucccaccauguaggaucagaagcuguuccaaaaagccuucccucccauaagagauguauuggucagauggggacagggauggauuucauuacagggcaggacuacagugagaggaagcuggagcaggacucugaaggacugucugcaacccugacccugccacaaagaucagagagaaccaagaaaguguugauugacacagggccauuguagguagagggugccccucaucaucuuguccgcucaugggugggauggcaucaaguaacuaacaaaaacaaccgugaagcacuuugcaauuagaaaaugcucugcaaauauuccuaggugccugcaacaugaggaagagggagugucaaguucaagcuagugagugaggucugguagcccuaaaagaugauauuuuuacuucauuuuaaacagauauucuacuuuucucuuucuuccuuagcuucucaaguguuuuccuucuucugccugcucucagccuggaggcaaaauuuuccuucccucuaaaaguuucugggaagaccacugauaauuuucaaguagaacagugugagaaauuaauuuuuuuuacaguguuucuuuaaaaagcccaaaacaacauacccacugauuauuuuuaagcuugagggaaagaaaauuugacagaacuuucccauccccuucaaagacugcucaaguggcugaacuacaaacagggguuucaauaacaugguuuugcaucuuacgcuacagguauuucaagccaacaacgaugcaacugaggugguucugaacaagcuccacgcuccacugcugacaagguuuguuagaauccgcccucagaccuggcacucagguaucgcccuccggcuggagcucuucggcugccgggucacaggugaggugggggcuccaaugagguuggggugcugauugagcccuaggcucugcucccuuucaacucucugcaaacagcaugacugcaccacaugaccuucccagaaagacuggcucaaggacucaaguccuaccagaguuugucuuuucauucauucauucaguauacauuuauuaagcaucuacgauuucuauuaauagcuaacauuuauggaaugcuaacuagguacagaugccauucuaagcaccuaagauguaacauauuuuauuauccucauaaggacuccauggguauuauucuccucacuuuacagaugaggaaaccaagacuuaaagagcuaggucacucaccaguaagugguagagccaugguuugaaucuaggcaguuccaguccaaagcccuugcuuucaaauaacacucucugcugccucaaccgggggccaagagcugugcauggugcuguggacacaaaggugggcacaacagacuguucugugugggcauauggacaaguugggcagacauacugauaaacucauaaauaaauauaaaaucaaaacuaugaucaaugucuggacauagaggcuuaugguccuuggaaguacaucguaggggauuugacccagccuaggagcucaaggaagacuucuuugaggaggugaugauugaggugagguuagaaggcaaauaacagacauuaccuggugaagaagggagggaaggugcaccaggcaauggucacagcuuucucaauggcacgguggcaagagggaccaaaagaggaagugaggagcauggacacagcuugugggcugaaacccaaggcauguagauuggagaagaccagagugggaguugggacauuauaggaggcaaugcagggggugcagaugggagaugaugauggcuggauuagccccagaaauuuauggacagaccaauccccuuuaucuugugggcucagcccagggcaggcaaguugccucuuugaccuggaagugucuucaguguacauccauccacgugccuuuccccuaaucauuccagcucugacagggagugcuccaaggucugacccuguuugagguuucuaguuaaaacaccuuguguuuguacagucucugcaucuccacaugccuuucuuguuuaucaucuugccuacacuuucuaacaacccugugagguaaggugggccagggacugauaaggaaaccaagacucaaagaggcuaaauagcuugcccaaagucauucaacuaggaggugacagagccaggaucugaacccacguuuucucaauucaaauucucugcucuuaccacauuuacacaaagacccauuuucuucuaaugggaucaguuuaugcuaauccugucuaggggacuauuuucugucccuucccuguugcuguuccaggauaaucagcaaagauuuagguagaggucauucucuggaagauugaaaggagagaaccagugauuuugaagaaggggaacaacguggaggaucuuuuuuauccauagcucaguuugcaaguaugaaaugcacauugacuauagacccugccuugccugacaucauuuauucaugcauucuccacucaaucauuuguuccacacaucugaugugccaggcacacacugggaaugggacauagagacaggaacaaaauagauggggucucugacaucguagaacuuucaggcuacugagcaagauagauaauaaacaaaugcaaguacuggauaaacuagaaugugcacaugaaggaaaagaacagggugcucugagggaaaccaauuuagugaggauugaaaauuugggaacagcuuuucuguggauaugacacuugagcuuggggguaagaaaauguuagucugggggugacugaagggaaaagcauuugggguaaugggaacagcaugugggaaggauccaaggcaguaaagagcaguuauuugggaaguaaagaccugauacugaugccaggaagguuuccuucuacuuggcaaaacaauuacuaggaaauaauucaauguuuagcucaguuccccuguucucagugucccugauagggucaguggggacuagugucaucgacagggaugugcagacacacauucugagaguccuugguuagagcuguaagcacaaauaguuaauggccauuggauacuuaaauaugccaggcaccauccugugagcucuuaguaacuaacagaauccuugcaacagcccucaagagguaggcaccucuauuagcuccccuuuagaucuaaggaaacugaggcaaagagcaauuaaauaauuugcccaaggcccucugacuaguaaguggcagagugaacaugaacacaggcagucuagcucugaguccaggcucuuaaccacagugcuguacacauucaccaugcaaagaaauuagugcugacuuaguauuugacaguugggcucuuuugcagcucccuucuuauagcggguggucccugguuagcaggugucagccaugaccucuuguaucuuccucuccucucugcagaugcucccugcuccaacaugcuggggaugcucucaggccucauugcagacucccagaucuccgccucuuccacccaggaauaccucuggagccccagugcagcccgccugguuagcagccgcucgggcugguucccucgaaucccucaggcccagcccggugaggaguggcuucagguagaucugggaacacccaagacagugaaaggugucaucauccagggagcccgcggaggagacaguaucacugcuguggaagccagagcauuugugcgcaaguucaaagucuccuacagccuaaacggcaaggacugggaauacauucaggaccccaggacccagcagccaaagguaggcuguucuuggaggccucuguaacguuacccucaacagggaggcuaagugugguacagggaguugagacugaugaugucccaucuaaacagucgucauccaacuccugaaauccaauaaaacaaauaucguuugagagauuacuuugugccaggcacugugcuaaauaccuuauuucugacucuuuuguuuguuuguuuguuuguuuuugagauggagucucugucacccaggcuggagugcaguggccuguucucggcucacugcaaccuccgccuccaggguucaagcgauucuccagccucagccuccugaguggcugggauuacaggugcccgccaccacaccuagcuaauuuuuguauuucugguagagaugggguuucaccguauuggucaggcuggucucgaacuccugaccucaagugauccacuugccuuggccucucaaagugcugggauuauaggcaugaaccaccgcgcccggccuggacucuuuuuuaaucguuacaacaucugugcaaaguagaucuuuuugucacucccauuuuagagaugauaaacugacacuugauaucaugcccagggucacacaguucaccugugauagagccgauucagaaaccggaagucugacuccaaaguccagaugccuaaccccuacugaacacugccuuuuuauaaaguucaacacucuuuauacacucuuucagauaaaguuuccuugaaauuggccagacaucuaaaggggaugugguuuuuggaggccaagcuauagaaacuagaggaugacuuccaaaaauaacgauguuuuucugaaugucgcugcauuccuuuguauucuccuaguuuugacugcuuagaucuuuccggccucucagacugaggcaagggagaagcaagagaaacucaccccgagccagaagcucaggccaguacagcuuacuccccugccaccagagugaaggucagccuucaacacagacacaaggagccccagaaggggaggagacgucauaccucugucccuccccagaucagucuccuggcaggccaggcucucugauucuuaucucuaguuaccccuuguuuuucucaaaagaacaggucccuaaaaaaggagggaguuugcaugucucggggccaccuuugcuaagcaaaugucuccauucugaauacagaggcaagaguuggguuggagguuuugcgaugcugagguaaacucccagcucucaacuccagaggcuuagaaaggcucagggcuugguaacuggaaccuugcaucgauggagcagaaguuggaccgcaggcuuccccauggagagcugagccugguuuuucuugggaaagaaguugaucuuugccauugugggagacagcccuauccgagacagugcuucugguucagaauuguggacgcagggcauccugaaaacuggagcgguccugcugaauuucugggggcuaaucagcugcaggcccuggccacccacuccuguccuucccccggaugagugucuccaaguguacucuaggcugguccuccaaagcagcccccugcuccccgcaucaucaguuuuauguacuggggcuccaugugagguuucuuuugacaggagugcuuucccuaaacaaagguuugggaaacagucuaagacuaucgaugugugaccagaagacagugucauuggccuaggggucauuuucccguaagguucucagugagcuaggaacuaucagucagcuuggguuaccucaauggaggcuuucacacauuagaaaaagaaguguuccuuucccuguagaccaggaauucagaacggucaaagaucgcccaaacugccuuccccccucucuagccaaagucagcugaaaacgcaguuggagccaaauucuuccccagauacuccauuuuagucaccagguaaaagacacaaccuggaaauugccaccuuuguuuacuuccuauuuuccauaauucuggguccauaaccaccuuccaaaugaauaaaauccuuggucugaaaaugaagcucgcguggaucagaaugucccagugaccaggaaucaacuaggaagcugccuuccuagcaggacgugcggggcagggaggagaaggggaaggaaagggaagaaggugauagggacugggucccacaccagaagggcugaguggccucucucccugcagcuguucgaagggaacaugcacuaugacaccccugacauccgaagguuugaccccauuccggcacaguaugugcggguauacccggagagguggucgccggcggggauugggaugcggcuggaggugcugggcugugacuggacagguaagaugacauuuccuccucuuugcaucucacccacaugguccucugacccuggcaucccacgaggcccugggagggcuguggagggggcagccaucccaggagcuggaaaugcugcagaccccugccauguucuccugccucagaccacggguacugcagccucuggacuugggacaguuucucaagggauguacuuugucuuuuuuaagggaucauuucaguucuccaacccgagucucucaaaaacaaaucauaaccacacaccacccacccaaauucaauuagacccuggcucuucaggccagagggcuguggcuguugauuuagggaagaaaaaaaccccucaugauaauaaaguaaucgguuuaugucugaaucuggccuccagaugucaguggcuaagagacuucauuuucauuucggagccacaucuguaaaaggcauuuauuugcucaggagggacccuguugcagggagcugaugggggcaggacuccuucucauuguccugcucauuccugccagguggcccaggccuuggggaacaccucucaucauuccaaaugagggugaggcccacggagggugcccagccuuccugguuuccgagggagggcccugcccuucugagucaggcccuaccuuccuuuccuugggucgccagcccuccucccucagcagagcuggcaccagaucuuacccagagcucacucacugccugccaaaaggaguuugugggagccacuggggcucagggacugagccugaugccagcaggagcagccaccagccugagcuauccugcccuccuccgccagagccccagguauccccauuuuccugucugugccguaccugucacgggcucagccggcaggauggcaugagggauuaauaagggcaugucggagaagugcuuuuggcucccagggagaaaaaugcugccuguaugcuggcuacagcagcgcagaggagcccuguugaggcacacgggcugggaauugggcccaaauuagccuccucacuuuugaauugaaggcagccccagcgaacacaucuucauaggaagacacuuaacuccccauuaccuggggaugaggccaaaguucccugcagccugcuaaacgugugucacccguccucucacaggugcagaaaaccuccccccgauacaagcuggcuucauuuaugugcccuggaaucaggggcucagcgcuguaggggauccaggagcuuguaagccaguggcuuucacacacuucugcccaugauacacaauuuaaaauaauuuuccuucacaacccgcuucacuuauaagcacucacacacagugguguauacgggguacaguguauggguaagugcuuggacucuggagacagauugccaaguucaaguccugccccugccauuggcuggcugcauaaccucagaaaaguuagucucucagcgccuugguuaucuuagcugaaaaauggagaggacaauagucugucuaccccauagggucauugugaggauuaaaugaaugaauggaugugaaauacuuagacuacugccugcacccagcaaaccuguuaugauaaauaacuguaacugaaacaaaagguucccaaagcaauggucaucuuaaccauggaagugcacuccaaaauauuauagucgguauguuuuaaaagcuggucaugaccuauucgacggauuccacaacccaaugaugagagugaugcgugguuugggaaauaucacagaccugggccaauuccucuuucauagacaaggaaacagccccagaagguagaagucacuugccagaggucacucagcuggaugaaguccaccucauucuuccccccaucccuugcccuucagugccaugcccucccagucuggccagugggacaguugcuaaugaccucuuuccuucauugcuccccaaucccaacaugccccaaauuacacuggugauggucagugacagguuucuuauuucaaagcccugccuggccauuccuuggaagaucagaguugaggagcguuccccucugcccagccuccuuuccuuugaagucucugacaucugguuucaauuucagggguagcguugcuguuugaugggcaguuaccuuggagcacccaguacaaacauaguacaaacaguauaaacaccgaggccucggugcccgccguuccuccacuuucauuuacacgcccugcccuccggugccucauuggccccuggguuuaacauucuuuacaccaaucagcugacccauuuugcuaccuaacauuuccagaaacuguucuccauaggucacguggcuauguuugcuuuucgaauuuccaucuguuucucacacucaucuucgguucacuucuucaucccuaucccaaaggauaacaggaaaaauaaugggcugggcugagcugcugcagcuaaauacuuugacagggcugcuucaccuguuaguugguuuguguuucaaauaauuauguuuugccuuacugccccauaguuugcuuuacaaucgaguuucuaugacacagugacaaacuugaacuuacaaauuaggacacuucgagguuauuugcuauuuacugugagcaaaaggcagacacagcaaagggaaguaugaaagguuaugugcguaguauuuaauagcagaaaggugggaagccgaccgugaaaaagcuauucagcguauuuagcaauuuccuccagcuccuggcuuuauuaaaugguauccugaagggugccugacaaaggcgccuaaucacauacaguagugcaaaggagcauguauagaaaugagagggacaaggcacuggcauccuguuggaggacagcucugggaugaagacaccaccccaaaacacauggacuugagcaccaguuuccagaaccccuuucaccccacccagggccugacucauagcuccauucacucccucaauaguugcugaaugaaugacgggcaugagcaaauaagcaaaugaauaggugaaugaaucaccuagagcugaggucaaaacccccugccugcagccagguuuggccuagccaggguucauugugugcuacuuaguauaacauuuuuaauaaguugccaacauguagagucuggagauuuuacuuagggauuuuugcuuucuuguugggggaaggaaagggggaaagauuuggaagaccuggccuggccacacugggccaccuccccuccaggccccagucugcuggagccagucauggaggccaccuuuaaaccaggcauguaagaucccagcuuucaccaccuccucucucuccaaccuuccccugcccucacaaccacgucugcuuuccucacuuacaguagguguuuggauccaggaaacacuugaacuugccacacccugaccuaaagacauagccccaaaucacuuucaccauguagggucugagccucuuuaaauccauauucccguccauccaguuuugugcaaacaugagccagagugugcuuugguccuuccuuggagucagcgucgccuguagcccccuccauuauugucucguggccuuuugugcuaaacucggggccucugcuguggaguaaagaauguggguuugugucccuaccucugucacugcugguucugcaacccaggaccauucucauucuacuauggugaugccccugacuucguugacagcacacagacaugacuucagaguuccgugcacaugugugcaucuucuuucccuucucuagagauguuuggcaucuuccuccugcuggguugcaacacaggcugcuacagcauucucuuaucuuccuuugcccuuacacagacuccaagcccacgguagagacgcugggacccacugugaagagcgaagagacaaccacccccuaccccaccgaagaggaggccacagaguguggggagaacugcagcuuugaggaugguaagcacaaauugccuccagauggcaugggugcggacuagucagagugggagcuggccuguggcuggacagggaccuaguggucccccagaucagagauccaggggaucucaaagaagugguaagagaggugggggcacuuagggguuuggggcaguggcuguuuacaaccaauguagaagcauuuggauaguguaacaaccaguacagcccuacuggugugaacccacuagacaucaggugagacaaggaugacuccaaagagaacuccucuuuugaggagucucauuuguugagcccucacuaucuugcuugucugcuaaaggagaaccauucuuauccuuagaauucacagcucugauaguuuuuccuguuaagcuguguguguaugcuacagcgaagugaagauacggcagucaucugggugauggagcgcgauaguuggguuaauccagcaguuaccugugacuuaauuguguuucccugugucuuucaccgccaccaauuugagaaaguauaacagugaugauucuauaagauagugcacuguauccucuauaacuggagugcagaucagagacaaaggcggaaauguaaaaaggcaucuucaaccguucccucaaaacucaggggcuccgcauuucuggaugggucccaucacaugggaaauucuuuucauuuaucuucggaguauauccaaguuagauaaaaacaauaauuggcagaauccaaaagucagucacauuuuaaaucauacugcuaaagucaccaaguaugaggacauuuauaagaaaccacaaauuuuggaacaccuggcauuuuggcuagaauguuaagcuugacagccucaacuuacaguaaauuacugaucauuauuaaauguucauuaaacaaaaugagggaagauuggcaaagagacuagagaagugauggagacauaaagauauagguagauggcaaaaucuguggaaccugcaagcacagccguuugacaguuagaggaacuacacugauggaguggaugacuccagaaaauggcuacaaagaagaaugggaggaaagccaagaauaaaugcugaaguuaugugacugaaaaagcaauaauuuaaugcauaugcuuuggggauugugcuuucauauuauugugugggugggggacacuguuggucgggguuaguugaauacagaauucugacauuuuaaugaacuuguuuuuguuuuauggagagaagaaggagacuuggagaaucuuccaagacauguuucagauaguuugagagccaaaaguggaaugcauagggaguuaacauacgauauuggauuuacagaguuagcuuguugggggaccuggaguggggguucuagcuaaaugacaaucaaaggaaaaauuaaggguucugcugcaaaauuucagaaguuuauuuuuaauaugauuuucccguuucuagugguuuguuucauuugagguuucuuugaugguuccucccuuuucuuuuugcaaaaguuuuuuuuguagaauuugguuccugagauacaguauacauguaaacauuacagaggauuuaugcuauauugaauuacuucguauuuuugaagagaaaaauagaaauucagaaauugucaggagaaggggugguaaaggcuaagggcugacuuuuccaagccacagguugaugcuucuguaauagauuccaugugucucuucuaaacucaagcugacuuuggccaagggugggcaaacauuaaauauccuguccuggaaagggaaggcauuuacagggccugguggcaaucuuccuccucccucugacgccagcagugcccugccccccaugaggugagcccuccucaccccuagggugaguaauuuguuucuaccaguccguggcucccuuuagacuuccuaaccugcauucuaagccuuccccagggaaauuccucucuaagaacccugggaagggaagugagaagggcagagaccccacuuucucccugcuaccaacauuagccaacauuuuuccacugucuccgcaggcacugccggcaaacaaccaaaucuggguucccauuuccucuuuccccacguccacaccacccccacuuagucacauauuuggcauuagcucauacuggauuuuuggagcuggguggaaccucagaagaaacucucuugguucugucuucaggcucaggcaggugaaccaucaaagcagacaggacaccacugugucauuaguuccuggauucccauagggaaagcauucucuaccucccggggucgcagccuccagggauucagcaugaugggaaauuauuuuuccuccuggccagcacugagcugagaagcuggcuggucuggucccuucgauuugcucuuaccaugccaaauuucccaccgggcauaccuccccauggagaugcuggacugucccagucuucagaaauagagacggaucacaaagaggugaaguguagcaaacaagccuuccuuguuucugaggucacuuucuccucacugggcagaaccucccagggauuucagucucucuggaugcuaaugggcugccccaucuccucugagagccagguuggcaggagaugagauaauacuuuuuuugggagccagccuuccaccagggcacuggggagacauucuucucuggcauuuagggaacagcaauuuucacauuugucugcucuccgagguggacagaagaggcugauuagagccugaagccauuugguagccucauucauaauugcuuacuaugggaaccacuggcagacuuggcuuucaugccugggaaggaugagaccaaagccugacccgaaagccagcgaucgccaagaugaguuaaaugaauaagcaaaggaagccacuucuuucucugcucuccacucaggccuugccagccauuuaaauaguaccacuguggcuguucucugaacccauuucauuugccuuccuuuggguuauuguuuuccccuuuuagacaaagauuugcagcucccuucgggauucaauugcaacuucgauuuccucgaggagcccugugguuggauguaugaccaugccaaguggcuccggaccaccugggccagcagcuccagcccaaacgaccggacguuuccagguaagccagcugugagugaagauaugaaagaguuaaggccagcuuguuccacauacuucaaccccagauucccuuacaagcuucauaacuucccaccgcacagcaauccucuauucuuugcccacaaaccaccacagucuuugcucaagacgucaccucaaagaauagccaguuggugguucccagccucucuugugauuacagcacagccuggaagcugggagggagaagcggaagccaagauagaagaaagaggagaaagaaaaaagggacaauugggaggcccuaggagauggggcacgagucaguguccucuuguucccauagccagcacccacugcuauuaucacagagccccuugucaacuucgagcuggguacuguuccuaaaauggcucauugggagaugacuggccuugaguuugauuuauacgucucugagggugccacugcuucuacaccaagucaauuugagggaccaaaaugcugccacacccauggguaucuagcagagcugccuggcacuuggccucuagaagaguauugcuguaaguccuggauacauuguuaagcccaccauuuuaguuucagaaagccagauuucagaagcuucuccuggcacugcugacaagaagggguugccucuaucccuucuaaacagguagcaagaguugucugcuaucucugcuguuacgugcuuucacagcaguaugaugguaaauguuuaacaauaggcuuuuuagggauuaaaaaauaaacugcuuuuuaacguuugucacuuucagugguguaaauacccuuaccauagcugagcuuaagcuaccaacacaacaucaauggagauggaguugagaagucaguaagagagcauuauauaguuuuuuuuuccauugugcaaauacaguagacagaaaugacuccagaaguauagcuacugauaaaauguauuaagauaacuagcaaguguugaguuuugaggauuuguuaccuuuguuuuuuaauacaauuuauugaauuauagcuuuauauaauuuaauuuuuacuaaugaauacauuuaacaacuggcuugcaaaacacuugacaagcagcucucacaagcugguacaccuuggaucuagcacagcacugagugacuuugaauucuccuguacuucuggccuggaccugagaccuccauaagcacuggagaggagaggggugaauuccggaaauuuaguagaucaguuugccaggguacaauaggaaaaggcuagaaaauaaaagagggaaagggaccuucccuucugcaggcuuccuuagaacugcuucucaccccaagcacuggcgugucccuucuucccggugggggcagugggacagaugcuaggagaacacuuggagcuggccuccugacacaguccacacuugcuucccuggagggucacagugccugauccggagaaaaacauuuucauauuucaaguguuuaucucuucagcauuugagugcucagagagauuaauaucugaagaucaccacagccucaggcaaaagaagagaacacuuaccccaguccagccuuaaucacccucccuucucuguucacugcaauaauguuuaauuaauauaaugagccuccugcacguugggaaaaaauacuuauuuuuauaacccagccuggauuuuucauuucauuuccacuccuuugagacugcauccaauuaauucaugguuguucccaacccccauguuuuaucugaauguaaagaagguuuguggggucuguguagguguggguauucuaguguuaaugugugugugcaugaguguguuugugguuucugugcaugggugugugugugugucugugugguauguaccucagcagaggcgcuuggaauaaaaggauauagccgggguccucugcaggcuggggagguuggcuggcucuuauucagugucuguccucagguucauucuaaugauucuggccuccucccuugacucuucuaagcauauuuucucugggagugucugagggcagcccuacccaggccacaaggccaccaauuacugagucacagcuccaggggagcuuaagugaccucccuuugacccuggccuggaccucuguuucuucacccguucaccaccgccuccuccucguccaguccuggccuucacccgaaagccccuaugguugaccuuugcuacugguugggaauucuagucuuuguccuccuuccaguugauucauuauacccugugguuugggagggcuuuucagagcaagcucacaaagugggcagaauuccaaccuuuggcugaauggauggggacagagagaaaauuacggccauaaggaacugcuaaaucuaauguuguuccucccuuaagauauugaaagggaaaguaauuauuuuccuauuccagaggaaucccgaaguuugggaaaguggcacuuauaaccugccuccaggaaacaaaaucauaauauuguucucagagcccuucccucuauccucugaugacuuuaugaaccguucucuguauuucccauuuuccuucucccuacagagcuugauauugggcuuuaagcaggagaggagagaaagcccuuucuguucagggugguccuuacuucuucuccauagggaaaaaaaaaaaaggagggggaggcccugaggggauuggggagaagggaagcagcuggcuugguugggggcagagcaacugcuaauggguucagagcggcuggcgcccacagagucagccugaaagccuguugugugccacacuuugccauccacagaggggaccgucccacucuucacgagcgugugccauaugcuucauccccugaugagauaggcaaacagaaguaaugaaauuuaagaaaggaggugucucugucaagugugaggggcgucagggugaagagaaagguggaugggagaggagcuagccguguugaaguacccaacacgggcccuauguggaaacugcuuacauuccucggauauuuucugauuucauuauuuucucauauuuucuuucuuuuuuuuuccuuuccuuuuccuuuuaaguaagcaauuaguucuguucuuuuuggccagugguugccuaaggcugaaaagcacccacugguuucauuccacuguuuuuguuuuucaagauagucuuucaagccagucagaauuucuguuuuuagcucuuugcuuguggcuuagcugccuggaguguguucacaccagccucuggggacccuguuccaaauucagugaccccugcuagcugcggaggaacacucaguguucucuaagaggccacuuuggcuuuccucuguagugacaaugacauaggaagcacccccuuacuaggagauggcauguuuccuacauucucaggugcuuugaacauagacagaguuuugagaaugaucaaagcccagccuuuaagaaccgagacaaaaacucauagggcgggcagguaucuaaagcugcagcauugaauauuguagccaugagccauguguggcaauuuuauuuuaauuaauuaaaaugauuacagccaaaacuucgguucugcugucccaccagccacauuccaagggcacaguagcuacacuguauuggucagugcauagacagggcacgucacuguauacacggcaucaucacagaauguauuggacaacacugcuccagugcuuuggacacucacaugagagcaaccaccaggggcccuugaugauucuuuaguucccugguuuugguaugaaccaagaagcaaguaauggagggaugugucuucugugggaucccuugauggaguguucaguggcugguaucuuuauagcugucucauucucccucacuagauaacuacaguaaaguaagcaaguaacauggcauuagaugguguaggaacuauugcgauuaaucaaaaagagcauuguaaguaaauauuaauacuaaguaaggucaauaaucaucaucauugugauuguugugucauuuuuauugucaggaaugagacaaagaagaugagguaaaggguacuaggccaggucagcuucagaauccuccaguguguguucccccuaaaucugugcucuuuuauucguggguuggccuugugaaaucugauuacaguauuacuucaaugacuuucaaucaugaaagugauagaaagaaaacaagcgaagcugauauugaacagagcuuugacugccuggucaaagccuaugggauugagggaacagaaccuuuacucuaggcucaaaaacaagcucaaaugggaguaagucgagaaucuuaauguuauaaaauacccaaauuuuacaaacaguggcuggcuauuccuucaaauguaagaaguaagauuguuaacaccucacuggggcuauuuugaugcagacugagccauugaaugaauuccguuagagugggagaccuuagccaugauucacgguggaggcgcacacaagaagauuaagugaaguguggauggguauggugaguggaugguugcagagaaaucagaggaaauaacugaugagugaauuuacucauaaugggcuugauuuuagacagugagcaaguggugacugaauugaaaagcaacucugaguucaaaagaucaggugggaccgauggcagcaaacaauccauugaauugcuguuagauugaacugucuucagaaagagguugcuguggcuuggcuggggcacagacacugcaaauccagagacagaacuuccugggcucuggaccaugauagauaauuaaagaucaggagcagcuuggcuaaaagaaagccaauagucaaggaauaauuucaacuggaaaagaaaaggauagaggcccuucuuuaaggaagguagaaaaacaucccaggcuuugcagaaaaaaauaacagcaggaagaagcuuucuuuacccuuuuuuuuuuuuuccugcaaaucaugauugguugagucccccagcaguguguggauugauaacgaaggggcagaaugacaagacagccucaauggcaaaaccuucaugaaagccggcagagugaaaaaacagcucuggguagauuccugcaagggcuaggacugaaaccuucauguccacaaaauggucuauuguaaaccuugagaacaucuugcuaaguuuauccaaagucaguguuucccuuaacugguugcuaauuugaggaccuuagcagagauaggcagaccuuggaaggccagcugagggcugacucauguuuuaagcauggacuaugcaaagagacuacaucuccuacagcacuaaauauucuuucagauggucguucuaguaggagggcaagaugcuagccaggagaugugcguguuggacagaugguguguuuggcuuugugauagccaggaggaucaagcuggugauuuauuucaggguuuggugagguguagacacaacugauuccauugcuguugggccagucgcagucacguguucacaugacacuuaagcagcugaagccagaugcggccguaaaucgccaggugaaauaucaagagaccuuuccagagacagcagcagguuaaaaugcugaauggcccuguccucuguacuuccucuucacccuuuugaacuccuguuguucauucccaggcgauuguuuucccuguaucauuggcaacaacagauguuuugggucaaggacccagcgaaaugccucccaaguaugucagguccaggaggagaggaauuguaucucugggacauuauuucuucaaucucuuucagcaauggaacauauuuccuuuccauugucuuuuucuuggaagcuguccauugccggcaucauagccaucagcuacaagaacaggcagggcugguucuuagcuggucaguugucacguucaggcgaccucuugacaauccaaagggcuuuaccucaagguucaaguaaauaaaaaaguagccccccgcccccaccauaccagcucuuuugacgguccaaguaaucaguagccacuguauaccuagaacaucuucugugucugacaguggugggccauaaaucgggagauuccagaagaacaaacuucaguugcagcacguguuugaucucaauaucuaugugugggugccaugacuuaaaagagcugaagcauuuauaauagcuuggaagaagggucaguggaaaaccaacacugcccuagaaaguagacauuugaaccaugcccuaggaaguagacauuugaaggggcaaggguuccuagggaagcaaagacuacgagucuuaauucuucacaagugaaaaugucucuaaguuggaaaacagaaauuggcuaugcuccaucagggguagaaggaggaaaugucucuaaaugacagcaggaaaacuuuaaacugaauuuaagaaguuucugaugguuaggguuguaaccuagaaaacacacuacagacguggccuauggaaacuccuucucuggagaauuuaaagcaaaggguggacagcuguucuuggaugcuuuuggcacgguuccuccgggaggcaggacuggccugcccuaagaucacuugaggucccacucuuguuccaggaucauguaauauuuuauuucaucuacugugaagcaacacaaaagaccuguggugauggaaaacuuggggccggcugguuucuggagaaagagcagauaaggggaaccagucuuuguccagagaacaucuuuacugcccucaugccaaacauacuucuuuuugagucuuggauuggccuuccuggguuauugguggucuuucuauccuuuuuguuuccuaguaaaauaaaggcaagcauaggagggaguguguagagugauauuaauaguaacaacuuuuccugagcucuuaauguguccuuguuacugugcaaagcacuuuacauggcucauuccauuuacucuucccccaacucuaugcaguaagacugucuuuguauccauuuuacagauggaaagacugaggcuuuaaaagcuuagugaguuaggcugggaguccaauccagaugagaagcuaugcuguggcagguuuacugaguccaaugaggauucaaauccuacgucacuccaauucucugagccucaguuucuuuuuggugaaaauggagaagaugguauuuauuuugcagagcuagauuucacagggaaggugacaucaggggaggcagguaaagccucccgugugaucgcgcacaggcagcagguguucaauguguucauuccuuucccccugcucuucuucucccuuccuugggcuuuuccuggucugagucauuccuucaugaugucccugguucuaaucaggccucugucagugacaggcgcuuugcagcucagcaucucucugacugaugucuacugcuaauuccuuaaauuuacauaucaucuuucuucccuggagcucauagcacuuaacagacaaguggggcacaaaugauuuaacgaagugaaauccagaggccugcucgucuggagauucugcagacuaguggauuagcucagaugucagcacugaauuaugauccuucagcugcuugugcuaagcaugucacuagcauuaacucccuggucuugcaauguuccccuaaaucaugcauagagauugucauuuuaucgugagagggagaugggagagaaggagaaaggagagaagaggggaaggggcuaccugguggggugggucacuggaaggggcagacugugaaaccuuuggccuggcugugccuggaguuucaguaacaggaaggguaaguagaacagacccagauacaauccauucagcccaguucuucacacuuccacacacauuucacuuaccaaauucuaaccaugaugccaugauuucccugccgcuuaagaauguaaauucacacaagugacaguaucucugccaaacaauuuucaggcagcaagugggucuuauuugugaaacugugaaggaagaaggcugaauaauaaaucucuaaaaucugguuuccuuuauauaugagguggcaacaguaagggcuuggaaauuaccggaagcgugggagcauuuaaaggguucucacuggugucucgguacacugggugcuuccacaagccaccuugucauuacuggugcaccucaccuuugaaaguggcuguuggcuugggaggguagagggaauugugaagggauuauaucuaagggauuaugagaagcuagcugauucuccuguccucauuuccaauguauagccucauaucauucuuuaaccguguauuuaucauucuccauucauccauucauucauagaaacaaaauuuucuugaggaguggcauauauauagcacuaucuagggguagagagaagaagcaauguuaaaccuuauuauuuguaagaccagcauuuacaauauaacuggggugauaaaaaagacaugaaaaaaccaguuaaauuauaaugccaggcagugagugauuaccugcugaaauccauggaaaauggccugccugaaguccuuuuaaaaacauaaaaucagcaguacagucaguaaaugcuagaguuguugagaaaagaagcggauuaauguugcaugugccagaauaguuaggagaagaacuagccaaagggacgggguagauggagugguucagggaguggagaauuacagcuaagaggagaaaaagcagcaacgggcccaguggggaagccaguuugccucaaacagagugugauugauugcaaggacuuggggcaagcuaccugcagagcagcugaaauaaagaacuuauugcaugaagguggaaaaccugcagucaggggucucggcucugccauugaaguugccucucuaccuuggacaaaucacuuuaaccuuucugagcaguuucuucaucaugugcaaaguaagguuaguaaguccuaucucacaaggauauagaaaggaugacaugaaauauugcauguaaaugugcuuguaaccuguaaagcauuaugcaagaaugagcuuuaauuauuaucauuaacagcaguaauaguaagaucugauaggggaagcauagguuuagaagaucuuugagggucugauuuggcaucaguguauccucccucagcagacaccauuauuaauucucuucuguagacagcugccuuuuaguuaucugugcugauuuuggccuugcagaggucacaccuuguaggguauguagacagauguggcuuuggaugguugaagaggcacaaacuggaaucccauauacgcauacuaaacuggucucauuugacuucagggaagcauagcuucugaagcacuaaucccagagagccuaaacaggaaggagcuuaggggagcagggagguaggugaggcagcuggggagucaagaaggaaagagcuguuucugggccacugaugggagguccagcacaggcucagcucucaccuagaaaguugaggucagcaggauuaacaacagcaaagcagugguccagggaguauugcauugauucuaggcucuagaauccuagcccaucuacccugacaaguccaggauauucacagucccuguggaguaagaaagcucugugcaucugucccagguuaacaugaccucacacuaacaugauccuaaggcaucugacgugcccacauuccaugcugcauaugugguagaaaaguggcccugccaucuugcagaaguauucagccuaagacgccccuauguuucagggccaaaaagagguacugagauuuccucaccaaaugccaccuuguucucuguacaaguggccagaaugguccuguacaaguuggauuugaaggugcaggucacaccuguguucugcaaggcacguagucugccaacagcaacaagaacucggucuuccacaugagugucugaugaauuugaaacuaaucagccaaaaaggccauucuccaaacauuuggauugguaaacccuuaauuucccagaacacauauauucucugcuaaacacacagccuuuguuaaugauaaugacagcaccuuuaucacuggagccauaugugccuggcugucucagaaaggccaaguucaagccucccugaaucaucccuuucagcucccacccucuguucuguuugaaggugacacugggcuucugagucacagucacuagagcccaagcaucaucuaggagcacugauggagacagaagguuuuaaaugucagccauuuggacagugcccagccaagauggccagggcuggaagcaucaaccaccuggucauagucacccuccaaucuagcagccccccacccccuauaaucuguccccuuguaauucaguucaucagauugcacuggcccuuugggugaguuaaugaugaauaagaugugggucuggccucucagaaucuagagggagaagaagggcacgcacacaaccagccaagacauaaggcagcugugccgggugcuccaugugaaagagauggaaaggaaaugauaccgagaaauaggcaggagggaccgauuugacuuagagacucuuaagaaaacacagcauuugaaucaaggcucugaaggagccuuaagaaagggucacagagccuggagaacaaggacaugaauaaaccaaagacaccgaaacucagucccaacuuucccuuggagaggccacagcagcacacuggugucuuucccgaguguuuauggagaaccucuguuuggguuuguuucugccagaugacaggaauuucuugcggcugcagagugacagccagagagagggccaguaugcccggcucaucagccccccuguccaccugccccgaagcccggugugcauggaguuccaguaccaggccacgggcggccgcgggguggcgcugcagguggugcgggaagccagccaggagagcaaguugcugugggucauccgugaggaccagggcggcgaguggaagcacgggcggaucauccugcccagcuacgacauggaguaccagguggggugagcaaaaagggaaucuugugauccguauuucaauauuucaagggccgagcccauucaucguuagggaacgugguuaagcgcuacuguuuucauuguguuucucacguugccauggcaacugaaugacacucuuauuuguuauucagaauaugccuaucucuacacccagacuugguucuuuguuccuccuguugccuuuuauauugcugaaaucuucuccaacaaauguuucuccucuccauuuuauuuuagauugcuaucagguaggcugacaaagggacacagaagccagagaaauaaacacaaacaaacccuccacacacaaggaaagaggccuguggagccccuucagaucuggggaggaaauaggauaaucucccagaccugucccaggcagcaagaacacaggaaggggagcgggggcuguuggcgcucaguggccggcagacaugagaggcuccagagugagugcucucucucucucaccagcucccggaauggaguucuguuaucucugccccacagagcaggagacugaggcacagauggguauguucagccgugguugcaacuuggguaggaguagacacacuguggaagaggugacugagaaccagccaaagcauuaaccuucuccuccccagacgaggagcagcaacagauggcuggugcagcagccaacugcucacccagcuugccagaggacaugugcuaguuugcagagaggaaccuggggagggcgagcaugagaaaugacugaagaccacagagccgaggggcuucuguguacagccugcagucccugucccuugagguugcaaggcauccugagaccuuccccacccccaucuggguucccacuuacucaccugaguguguuguauuguaacuaccuguuugcauuugugucucagccauuagaugggugagcuucucugggcagagaucuugucuuacuagguuuuguuacuauccuuauguccagggcauaguaggugcucaguaaauggcuggugaaaaaacaaauucuuuuccuccuaguuguaauaaugaagcccuaaggcaacuuauaauaaggagcacaaaucaaaaccuaugugcuguauuucucacauuacccccaccuacuugugucuucugaguuuucaaauaccuggauugggcauuugaaagauuuaugagacaggaaccucgaaaauagugagggaaguuucaaccccccuuucaauagucucugauuauggcccuuuuaaucaauacauucuaguuacuggacaacaauauccacccccuuguuauauuuucuuauccccuuaaauaugcguuugauuugaacaaacucauuuugaauuaagauuucaagagcuguagccauguggucaacagauguguaccaggugcaauaacacacacacacacacacauacacacacacgcuuuaagcugcagcuaacagaaacuuggaaauccuugcaccguuuggacuaggagacucaguuaaccauggcucuuauucuuccggcuucuagauuguguucgagggagugauagggaaaggacguuccggagagauugccauugaugacauucggauaagcacugaugucccacuggagaacugcauggguaugugaauaucugucucuucaugguucuuucaaauaagaccccaagggcugggauaagcaagaggaggcaggacaccauuuuccaaugcagucguuacccaguggguggggcagccacagucucugcaagguaagguguggguguaguugugucuuaggcuggguucagggugggaaggggugugagguaaggggacggcuuauaucccuguucccaaucagaaauagacaugcacuaaguacauagagguucagggugccaagacccccucagcaaaccccagcuuuuagcaaagaaaaugcuagaggacgagagcaacugccagucaaaauuauaugcuggaaagguuugauggauuuaauggaagccuucacuggugagcaaaaauaguacauauguuauguaagagugauaacacaauuaccugaguaguuauuuuacaugaaugaauugcagagcaaacuguggcauuugaaguaagauuucagauuuuucuuuaaaacgaauaccucuaaugcccaagaucccaaaguuguuguaggauuaaacauugcaggccaggugacuggcacgagaaggauaucauaaccaucaucuuggucaaaagcaccugaacagccaguccaccugagaggcacgcauuuucuucagggucuccugcugcagaugaggucacccuggcugugucccaucagagccauggacauuucccaaaccaagaaaggaacccugagaaggcaugaggguugcuuucagucagcagaguggcugcaguaacucaccaacugccuuucuuggcacacgaccccuggugugugugugcuugaugaugucagaagcaccugggaccaccccagucccuccgggcaacucucaggccccaggcaucuaaaaguaauccaggcucugagaaaguaaucagcaguaaguaacugauuacaauacuuuagggacccauuucuugaugaaggacuuuuuguuccaaagcaacuuugagaauccccccuccuccgccaucaccaccccaugaugaugauguguuagagccagccuagaacauguggaagauggggggcccucuccauggagugguacaaaaaaaccgagugcagucauguuuaucaucauauucauccaauuauucacucuauguucacccaauuguuucuugccuuuaacuaaguccaauuuuuuguuuguuuuuuucagaacccaucucggcuuuugcaggugagaauuuuaaagguaaaaaaaaauuuuuuuuuugcaugcuuuuuccuucccccaugugaugugaauuugauggggggaaucaaccuccaaauuugucaaaucucgcaagagaaaagagacgccacaccuuccugccgcuagauggcacuagcaacaccuguagaugcgggaaggggauugagagccucacugucucuuguuuaauuaaaguuuagaaaccuauuaauagagacaaauagguuacagauaaaccuuucagccuugcauuguccaacggggagcaaugaggcugaaaaugcagggguggugagaaaggagagacugugggaagacugaaccaaaaaaaaaaaaaaaucaguauaaauuaaaagugaaaugagguggcaaugauuuauuuuagccugaagaugguuucuuuccaguuccaggguaccaaggcagcgguuucaguuaaccacagagccgaggggcuucuguguacagccugcagucaguaccugcagucaccauaccucagugagguacgguggcaggcugcuuguaagagaaggaaguuaggaaagagacacagaagugguggccucaggagaaagaguugccacauuuaggacccgguguccagucaagggaauaaggaggugcauucgaugacuggagcuagagcacuuuaaaugcaggacugaaaaucagaaaggacguguucucccccgagaaagcagagagagcagagcaaagugagaagaauuggggaugcuugccucauccagguuauaaaaaaaaaaaaaggccuccagccuugggugauggcaauguuguuugugcuguuacaaugcagcagauuuuacauuuugcccucuuugcaaaccuauuagcggacacugcugaaguucccacaccgguuucuaaugccaaacauuuaggagccacucuaaaugcgucacugcaguuggccugaguguaaaagcacacacaaaaacacccucaccaaaugauggggguucuucaugaccuguuugaugccagcaauugugaggauugcugugcccucuuuguacuggcugggcuuaccccuacaaguggcagcauugcagagauaagggcagccauuuuuauaucugccgucuagacucguuaucuucacucucauuaaucuguccagcucugggcuagaaagagaugaauuccugguuugccaccuagauaugcucccugacuccaaaucaucucacccaauuugccacucaucagcucuaagacagccagugaggaacaaagcugcagacgacaggggaaugacagaccgacauagaauauauugccuuucuuacccuuccucgugucccugaaccccaugcccacucccuguaccacaguucuaaaaguauuaagaguauucaugugcauacacuggugcucucugggggugagguuuauguuaauguaaauccaaaguauuggaggaaagcugagagccaaacugaacgacuuuggauuacagucgaauucgaguucuaaccuucaggacccaagguaaugcuuauguuggugaagugaaagcuguggauguuguuucgccugacucucuuuggguuguggagacucacagcucccagaaaggcuggguaaagacgugccagcagcugcugcagacacuguucugugugcacaccgugucgggccaugacugacaaguacaguggcuaagugcuaagugcuucacuuccguaagagaauaagcagaccagggcacguacacucuccuugaaacugugcuuaccaugaggcuucacaggccagucaugcucucuuguaaaaaauauauacauaaaaucucaucugagcagcagugcucauuuagccaaaauaaacacagggcuuaguaacuugaagguaagaauuuccagggugcuccuggugggccgcuuugaggcuaagcaaaggcagugcacaaguugcauggauuaggccauggcuuucguccuggaggauggcaagcaucuuugggaagaagaaaccaaggcuuggggagcagagacuuggccaauggacacaguaaagagcagaaucugaauugggaauggagaauuucauucaccuuggcacguuuuacauggagaucugaguugguaaccagaugaaccuagugccaugggucucuucuuucuggcugagaccuguuugaccacagcaugcaacucugccuugagcaaacuuuucuguuugagagaggagaggacuguguguuccaucuaaccuagugacucauauacuauuccucuuauggucaggacagcaggaguccucucuugauccgggcauaaaaucagccuuuucacucaaaaaauggaaacagagaaaucagggggcaggcaagguauggaaaguugauguugaaacacugccaaccauaggcauuuacauuguuauacauuuuucaaauuagaguguuuuucuuuucccuuauaaauuaaucaugcaacaaagguaaucucauucuuugggagcaaucacuguacagguaaaucuuuagugaaauacaauaaaaguggccuuuggaccuggaguuauuagauggucgcaaucuuuuauauuuggaaguaucuuucauuuuccgccucuuacugauuucuugccaugcaauauuauuuuaaauuuaaaucauccuguguuuucugcuguguguguguauauacauacauacacacacacacacacacacacacacacacacacagacacauugugugccaggaugugagucaguaaugaagaaaagccuggaagaaaaagagaucuguguugagaagggagaaagagaagaaagaaugaauaaacuguguugucaugugauuuuuuaaaaagacccuuuuuugugguuguuaugagucacauuuuaaacaauguagccugggugugcauucuuuucuuuucuuuuuuaaagcaguggcuauaaacauggugccgucauguaucuuuuucuaggauuugagcuuuaacaaaugaaaaaccguguguauaaaggggggaaaaagaaccgaaaagugguguaauuaaggugauggauuauuuccucuuacccaauacuuucuuuuuucaauaaaggaaacaagaacaauaaagaagccaguaaaaauauaugaagcccauaaucagaguucugggguuuguugaccaggugguuauuuuuagcagcucaccuuggaggcaagaguuuuuguucguguuagaggcugugguuucugagcagagcacgggcagagagacgaucuggugcccuaccuguuagagacucacggaaaucccagcugggugcaccuguggaaggugguugucagagggaaggauucagaaugacuguccuacgcuaguggaugcuaaaaggaacaucaaugucucccguuucagcugggaaugugggguuuaugacucagaccauuccuaagguccaggggccccauuucucgggucucccuaggugccuuucugcaguucuccacaguucucauccagacaaaaccaggagaaagugcacauccacagcugucucuugggcauagaggggagcaguauuaagagaggcccauuuuggggguaaugcuggcuggcauuugacucuauuccuuaggcuuuaaguucuguuucuuuggugccaacuggccaaucucugcauuuugcacccccuucucuccuuucccauucccacccucacccucuauugccugccucccaaggcuuuguccaccaggguaaggucccccaucccagggccuggccucacauucccuuucucccuggacucccuuccucccacgccuccuucuccuagaagcacuucugagaugcagagaggguuaaauggugcuuuugcacauaaccgucugaugaaaggcagagaaguguuccuaaccccugccgggguuccagauaggcagcuguagugugugaauccuccuccuugcccccacccccuuaugucuccagcugccagauuaaggcuagguguugcugagcaagaaagcauggagaucagaugugugaagcggguaacugcuuggcggccauccuuccccaggggacacagagguguucuuugugagguucgcuggagcaugccaccucuccugcuacagaggccugacacguccccucuccaucaguuuaccacucauguaaacaacugccgaggccagcuuaucuauggguggaagaaaauguuuuucaccaacuuuucucuccaagaacacagggacaagacucaguuuacagaaaguagcauaagugccaccaaagagugugaagcguccgagacuucagccagucagagaucugaauucggaggcauuuaaaaaugccucuagaugugggagcaauccacaugguuucugccaacuuacugaaaacaucccggcgccucccgccacaccaugcucauaaggcagauggaaagagucguuucucagggaugccuuugugcuugugcgucuuuuuuccaaacacaucagagggcgugaccacauucuucuacuaucuucuguaaacuucucuagaggagccaaccuuuuucguuuguuuaaucucacaaauuaaauaaaccuuuaugugaaauguuccuccaccagcacuucauuuuuaaccuguacagaaaggacugugcagacaggccaguccuaaaacaauucugacaugcaaugagccuuuuuugaaagagaaagagagaaggcuuacccuuggugucuuucaaaacacuucuucuggaaaccugggugacucccccagguccagaugauauuucauaaagcagcuauaguauaugcuuucucauuucagagauucagugagaaacugacuugacugagacacgccaauccucagacagguucagacagaaauaggaggcagaaaggaagaggacuguuuccucuucccucccuacuugguuagagcaaggaaucugcaaacuuguucuguaaaggccagauaguaaauaucuuggguuuuacaggacauacagucucuguugcaaguauucagcucugccauuguggcauaaaagcauccauaagcaauauguaaacaaaugagggugucuguguuccaacaaaaauugauuuacacaaacaggcagugggcuggauuuggccaauaggccacagugagcugaccccuggguuagagcacaggcugggauuuuguccaccugguucuagccgugacucugacacuugcuagcaguguacaguuccucaggggacccugggccaucucuuggguuucacugaaugcuucucugcccuucuccacaauuauccuccaagugaaaccaggagaaaaucacuuguccucucaaguacucaggucucccuuuggagggucaugaggaauaaacaaaauugauucaugugaagcccguagaccaaugguuaauacacaggaaauguccacucaggguggccguuguuacagacacguuucccaauugcauagugacccuauuugcagauaggaaugaccggaacacuaccucauguguaacuguuuuucuuauuuucucccaugccugguuucucaaacuuuauuguuucucaaaauucaaauucuuuguguuugcauugcuuuucuccagggggcucagaauuuuuacagaugggagccugugcaaccuugcaaaugcacuuggaguucaguuauugacuauuuaaguaucuguuucugauuaucucacacaaugggaaaacuuuguagagaaucuggggugggaauuaaugaaaaauaguucaggaauugaaaguguuuuccaggugaaaaaagacaugugaguaagcgguagaaauuagaucaaucaaagggaaaauucaggucaacagaucaaccaacuccaggcaagguugaauucucaccuacacuuucacccaccuagcccaggcuccuuuuuugucaagcaauggcucgaucacccccagauggcugaaggggcaagugaagcuaaaauugcacaacucagcaauucgggcaucuggugcaggugacaucugccuaaagugggcaccuuuuucuaauuucccauagaggugccacaugagcuagcaaaaucucuagcacuuucugaaaauaacucuccagggaaguaccaguaggucaucaacauuuuccagggagucugaacauugguccaaauauauuccccuaugccauccguccauuuauccauccaccuaucuauucauccauccaucuggcauucauuggauugcugauguugucugggaaggugcuuuggguauggauuuaaccccuauugauuuaucgucuuccuuuucucuaguuggcaaaccacagccucauuagcauacagcucuccaaggcuggaacagggccagauucuaaaccagcacacuccaccugccuuuggaguugagucuuuuuagcuagugaauguucugagaaacuucuagcccccagcugcaagucaaccaagaguugcuuguaggggaucaggaaggguuugcuagucauauccucucuuuucuaacauuaacguuauuucuaaccucuugacauuaaaacaugaauucacauaguacuauuucucauuucuccaaacaaaugcccaaagaaaauguuuaaggagccaguauaaugucccccaaguagcuuuugucacugaaguuuucuacauguugauaauuucaggggagagaaggauaaguagagaaggagaagagggucuuacuuaaaguggaguuugucuuucaaguagagcaggauucugagagacuaugucugugucucugauucuaaauauguaauccauguacuaggauuucaccuuccuccagcagguccccuugauucucuccauugugcccuaacauugucucuuaucguaagaaacacuguaagagaaacaugaaggcuucauccuucuccagccugagcacuuuaagccauagguuguguauuuuguguuggaaaccagcauuuuggcugaaggaaagcagacuuuugaacaaagaugauguagugauggagggaauguggguaguugugaccauguucugcuugacaaaaauuucugcucccaccucuguggucuggucagguacuucuuuagagggaaagcuaaucccugaggauuuaucaccucccuuuucuugaugggugagcugcagccucauuaggggauggcccucacuguggagccacaugaaaaucagagacaaaccccaggacacccuuuggggagagaagggaugucucugaggaacucugggggcaucccuuaacacuuugauguuuccugugcauuuuuguaagcucauaucgaaaauccagcagcaggaugguugccaggcagcagauccucuuggugaccugaauaaugaauugacaccaguugacugugacuugcaagcuggccacuucaaggagccauuuccagcaccuugcuuucucuuccucucuuucuaugcauaauuuccaccauggccacaaauaugagagagagagaggccuuucucagcuaugguaaugaaacuaguaaaagacagaauuaguuuggggacaaagacaaagagggcaggcaauaaggugggagaagaggaagauguauaaagggacauucaggggauccugggauucuggggucauuucuaccccagggguuguggauguggcugucaaggugugugcagagcaacacauccuugucaaagcucugccaauguugugggacuucuggucacccaagaggugccaaugaaccugcacccuagcggaaggggauucauacagcaggagaaagcagugauuaagagcuaagaaguugagcaggcuuugaaauauuuuccaagaaaaauguucucauuuuucuaucacuucugagaagacauuagaaggucugacccaccucccaccuauuccccagaucaaagagaggaguucugauguucaggcugcaggaauuagagaacacagacucagaaauaggagucuuagccucaguucaguguuugauucaccaagcauuuauugagugccuucuuuguauaaacccuuagguauggaugagagcaaguuccucaugaugagagugaguuccucugcuuaaggagcucugaaucuuaggguggguaguguaaggaggcaugaaaauagaaaugagccccguuugcaucuugagcagagggggaccacccucugcucacaggguaggaccacuaaugcaugaaggagcccgcagcacuucccacccauggcuccccugcuggggcaccccaugaguagagaggaugcaucuuuccggcuuaaugcaaacagcuagggaggcauuuuucauaggagaagcauauaucauuuuucagaaguaaagaucaugucugguuuuggcaagcucaaaagcuccuagucccuuucugggccagauucucaucugauguaaaucuuugggagaaucaaguuguaacacugcuuugcaucaagugggacuccagccagucuuuccccagaguuacccugggcuuaaaucuacuacaucaucuccauagcaaccggcagcggccagugaacgugguugccuucuaaauacucugccagcuucucuucccugcucugucuuuucugucauuaagaaugauuucccucccucucucucucacucacucacucucgcucucacauacccucugucauuuugugcccacauuuuuuuuguugcaacuucccuuccaaucugcuuuuaaaaauccuccauccaauuaaaaaaugaggaugcauuagucaugacuuaacaguggugauugaccugucuaggcaagaccaggcuaauuucaaugggcacagaagccuuggcaagccaaaguggaauuuaccuucaagucuagccagcuuaauuaauacauuguugcugagaaugcuggccagccagaccaaauaugguguuuccaccacucaggaaaucugccucacugaaucccggaagucaugucagcaucauuuacuuguauguauuuguguauguguaugugugugugugagagagagagggagauggagggagaaagaauuagaacacuuccauauauuauaaagugauugugguugaacagaaagagaagagauguguaauucuaccauucuugguugaaucccauacuuacuauuuaacuagcuguauaaccacuuaacuuaaccucucuccaccucuguuuccucaucuguaaaaugggucugacaauagcuaccucccaaggggguaaguaggaaauaaugcaaucguugagaagugcuuggcaggugcuaaggacugaguaccaccuuagucccccagacccuucccuguaugucccaaagcauguguguguuucuuucuuuuuuuaaauuagucuuuugauuagucugcaugcucucagccuagcaacacucuucugugucucuccaccagggggcacccuccugccagggaccgagcccacaguggacacggugcccaugcagcccaucccagccuacugguauuacguaauggccgccgggggcgccgugcuggugcuggucuccgucgcgcuggcccuggugcuccacuaccaccgguuccgcuaugcggccaagaagaccgaucacuccaucaccuacaaaaccucccacuacaccaacggggccccucuggcgguggagcccacccuaaccauuaagcuagagcaagaccguggcucgcacugcugagggccgaagcaagaacagcacccaaaacaaacgagaaagacugcaaacauguugccucgauuuugcacuuuuuucuccucgccuaguuucugugugaacucucagacaucucuuucccggauccccaacccugagcacucuuaucaaucccaaccauccuccuuggguucauuuugguuucugguuuuucuuuuuccuuuuuguugauuccaaaccaacaaacccaacucuaaugcugcaucuuggacuauccgaagagauccacccccaagcacuccacaacucaaggcucagcugguuuuguuccagagacugguucgcuuguuuuuuccccuugccuuaucccauaccuccucucagugggcagucugccaggagacgugaggggaagccuggaucuguguguauguacauaguagacaugugugugugugaauagcucucugugugugggugugugagagagcggcugguucauuguguguguguuugggcgaggggugaguguucagagagggccccuuuaacucuuauguuacuucuccugggguacauuuuacaagaaaauaauauacuguacaaguuuuguuuacuuggagaagagauugaagcuuuuuguugccuuaucuagcucuggcuggguuucuguuggcugucauugucaucuccagguaccuaaagaaauagaggccacaugggaugcaguguggcuucucccaucccuauccccaacccaccugacccaagagaagguuccccuagcacacucaaacaagacccccuugucuucuggugucuuugaaaugucaagauaacagccacugggugucugcggaaccaccucuccagcccuaaagcaaaucugucucauguugccuuauaaaagagaagcucauaaugaauguuuagccuuuaucaguuacauccaaucuuggaauaagucauagagaauaacaagucugggacugacguaggaaaaacaguagucuguuuaaguugagaggaggaggagguggacgagagaagggaggagagggaagaacugaaaugucuccucacccagggugguuauugggcccaacuugggaugggguugaguacgaagguuaaaaaacauauacuuugguauuauauuggucauuguaauagcaguuguaaaauauggggggaaaagggaucauuugcuuuccuuucaugguguuaaugugugccugaaucuauagccgcuaaaauguaaggcuguccaccugacuuauuuaaauauuaucagagaauagaaaguaaucacuuuuuaaguguaccuaugugcugccccuuaaaacauucauggcaucuggcaaauagacccuuguaggcuggccuggcauauucagauguugccgcaucaucacagagaaggucaaaugaagauguaaccauugcugcucaugugucuucucuaagcaacaaggggagcgggauguaagagagaaguugcuaaugauacuguacaaaggauggauuaaauaaugaagucaauuucauugauagaaaaugcaaauuuuaagauucucaguguaugaggucucagccucgggagcauuuauuuuuuacuuuccugcuaaaaauccacuggggagguauaaaauucacuccaaagaaguuugccugggccaaaagccuccagguuccuucugagaacaaaauacuaaugauuuuuuuuuuuuuuuuggcugcuugggagagacuuucagcauucuuucacgauauccagauaugucccuucagcacacacacucaacuuucucaucugguucguuucauccucccgaaagaacggugcucucccacucuuacucuauuucaaagagcuacucugucucaaccacagcagcccugccaagaaaaggcaagaugaaaggcuagagcaugugcuaccuugagauuucaagaaguguccuaccucagcugaagauggagaaacggggaguggagaggggaucagcccaggguaccaugugaugacuaauaugccacucauuaagggcuuuuaccucggcuguccacauccagucaugcauuuggggccaggcaugccugcgaaaugauugacauuccuguaggugccccauagagguguggcauugagaaauuaugucuggaaaauacagccaguguagugaccagcugaguuaccauauacccugaugauuccccuucuguaacagaaggugacaacaacuuugugaacuuucuauaucuuuaucugaugccccaaguggcaucaucuuuauguacaugccuuaguugagaauaugagacugcucuaaucuuugugaaugccuucacacuucagcugaggaugucaccuucucugucacuccccauccugcaaccucugccuuugcucugucuaccccagcaauuuucauaguguuauccagguacugugcuaaaaggucagcucuucuguaaaaugccaugcuucgcagcuucaaaaagcaaaauucuguauuucauggagggagggaagggucauucucuucuaagaaaaauagacuggacaggcgaaugcaugcaugcauguguuuagaguugcuucucagaagacaaagagaugauagcaacuauuaaaauaugaaugaaugaaugagugaaugaguugaaggccuagcucgggcugauaaagcuuuugccuuaguagagguuuuaugucaacaccuucaggagggaagcccuuauuucuggguugaacuccccuuccaugauauuaugcuagcaauugccaucacuuaguuccuggcgaaggcagaaaaagaaaacaaaaaaucagcauugucauugacaaaacuggaugcugaagauaaaguaaaauugucuuuucccuugucccacauuuuugggauuaaagccagaauugaauaggaaauacaguacuauuucugaaguugauagccgaucuuuaagaagacccugucuuuaaaaugaaacuagcaggcaaacaccuaaauaaucgaaaauuaccaaagaacaacaacgaaacaagaaaaccuaaagauuuuuacuuccuauucuuauuccuuuccuuauuacugugacaccccuugcauugcucaguugccugugugucaaaauaacuuguggacguuggaaauuauuugaaaauguauuguguggaauguaauaaaaugaugauauuuuuauacaaacaugugagguuuuuuuucccuuugccugugagaacaaaguugaaauguaggcuuugagcaaacugaugcuuccaaaguuuacacaucaccuucugagcuacagggcauuucugugggagguagguggguuuucuccuugaggcugaaugccaacuuuuccuucuuuuuauuuuuauuacugcuuguuaggauuuuuauccaauuugugcagcugagacaacuuuuaugauuggugugggauuuugcaaaaguugcuaagugcuaaauugcuaaaugagauuccacgaaauuucucuugaugacaaaucccuggagauuagauucuacuuucaaagggcuccgggagagugguaccagcuaagcugaauccuguacccagcucugcagagacagaucacuuccuuugaagaagcagcagugacaucuuaccccucaccuacccaauuauuacuuccacagggaugugaaucucccauuuacgagcgcuuucccagacaaaacgggaacuuguagcauguucagggcugaaagauauucuagacuucauuuuugaacagguaaugaagauaauuagaugaugacuguggacauagaacuaucagaguggaacauuuuaugaaaggaacacuauaaaacuuugaggagaggcacuuggggaaacuuacucagaaggccaggucuuucuugaugaguauuuuucuuugguccuccucuuuagauggugacccaguuauauaaaauauuucuaucagaagggaacuggguugggccaggugggggaaaaucuaggaaaggcagccucccagcaguucaugguuucuagauaguggucaagaagaggucacauuaauccuauuugcagauaggauuucccaccaaccccauucaugggauuuaucagaggccuucugacaaccugggagcccuccucagggguccgagaaccauccuuaaagguccugagaaaauguacauguucagaagauccuauuucugucagaguccugcuuuucauccuauccaaaccuagauccaggaaggagugcuuuuuacagcuguaaaaccuguccaagugcugcuaaaaggagacaggcuuccgguuuuuagaucuuacaggaaguucuguuaguacagaugguucaguauagaugucacuaucugucccuugcaggagaauaaaguagaaugucagugaucagagcauuuuuuguuuccccagugacaagcucaauuaccccuuuugucuaaauaacauuuggcuuuccuuaaagccauuuguucccauuaguaaagaaugaaauaaaaauaucucaaaaguguugauuucaaacaaagacccaggcucagucaacauuuccuugagcugaccugggaccaaacuugccggacugaacuaaauuagccaucacuuaugcuuuguuggcauuacuguuuuuggaaccauguuugggaauuuucccaccuugguucuagucccaagacuuauuuuaaggguacuuacucccccuaaaagggcaaggacuguuaggacuccaaucuuagaugucaaacagggcacuguuaccaccaaacacuccucaguguggcauuucuuauguagcccaagcauaaauguucagaaauuuuguuuccauggaucauaaauaccagaugucaaggccuaggccggucuguuucugcuccuaccugguucuuugugaugguuucaguguguguucucucuucacccacugccccccuagcucagauaaccgaaacccagccaagcugagguggcacaguguuuauuuuccuugccccucuucacggccucugcaguuguucugcacaaacguguggccuuucuguaaucucugaugaaaagagcuacauccugaaguuuugacuugccugcauugugggcuacacaucugagccaaacugcagaucuguaggugaaggcuuguuuuuucucuuuaauugugcagaucacuggggcucucacagcuguaauuugccuuucauacacuuuagugacagcccaaagaaaacacaaaacaaauccaaccagagaaaaagggagggggcgaggggaacaccagcugaugaucuuacaaucagcagggaaaagaauugccucauacaaauaaauuaguagcuaggaauaguguaggauuuaauuaauccugacacagaucaggugcaccacaguauguauagaggucagauacaaucagaaacccacacccuuaggggucuucaggccacaagccugggccagaguauguuugcccugacugcuuggagguguucuguuuggacccaaaccuaaacacugaagagcgacaagauuugggaaaucgccaagagcaaaaccuuauuuagcaugguauggaacaguggagaaucuaggugcuucagcacaaccaagccgaagccauucuuuccccaaucccaguggauaacagaccuagaaucaucuccucucuacuggguaaaacaguuguucuuggccuuuucugccacugaccccugagagccccaaaaagcuaaagucccgugggcauuggaccaagaaauaggaaagaccauuugaacagucaacaacagagguacuugagggaggacugaguguuaugugggaaaaccucuuuucucggaguuucauugcuugagaguguauugauacugaugauacagggaggcugcuggagggagacuuuauaguaacuggcuggguuucuuuaacucacaaguuaaacaugcucaaaaagugcaauaauacagaaaaagccaaagucgauuucauuguugaccaaucccagucaccuccccagagguaacugugagggaugguuugaggaguauguuuccaggccuuguuuuauaccuuuacaaacauguauguucauguugaguuaugugguuugguuaagcugggguuuaguuugguuucauuugguuuuguguaaaugguagcacaguguuugcuuacuauauuggaugacuugcuucuuuucauuugacaucuugaggguaauucaguacauacuaaugcaucuaccccauccuuuauaucugcagcauagcauuccauauuguguugauaugccagaguguauuaacugcuccccuguugaugaguguucagacugugucuaguuuuuuuuuuuuuuacuauuauaaacaauacugcaaugaacauccuugaaauugcuucuuugggcacauguuuuacaaaggauagaauuucugggucaaacacaucccuguuuucauuuuaguaggugcuauaaaaggcugagguuugccguuuaaaauuaaccugucccugcuugagagcauagcagaaacuaguggacguccuggcuguagagccccugccacaucugcccaacccaugugaucucuaugccuaucucucuuucucuacaguggguguguugcuugcaagagaagaccuugggcacuuuuagcugaagauaauuuuaaacucagggaguguuucuucagaacguucuuuuuuuuaacugccaacuuacggggaauauggaccuggcucuaagugucagcuccccagagcugugguggcugugucacuggaguuaauucugucccuggguucaucaggcagaguccuguucuccaugauuaaugaguuccacuugcuuucuucaaagaaugccugugcugugccaugcuguuauuuauuuauguuuucuacuaaaaaauuuauguaaaaaacaucccuuaaggucaguaugcaguauugugcugcagacuaaacuaucccagcagccagagguaaaccuacacaccaagaaaaagucucaaauuugagaggccuuggaccacaggcccccacacuggccccaagaggggcagaccuugugggcuuccuucugaggaaguucagggcugcaauacccaaaggaaaggcacuaggcagugaggugguuuucuagugggauguuuauaggcauaggcaaagcuacuagcccccacaggggccaguagcaaggaauggcggguggaggagaagcccagagaccugucaguccaaacaccauuucuagcaaaagcacugcccucauuucuguggugugcugagagaaaagugucauaacaaaguggcuuugacuuugaacauaauggaguguguguggcuauauagguccagugugugcuuucccugaccugccaaaaauccaggaccauugccuccugggcaugagguaugaguauuuaacucaggaaagaaagcagcaugaguugagaucuggaugaacuagagugcaucucucucugacacacacacacacacacacagugccuuguuuugucuucucuguguaauugcgcaaaauuaaauccuuuaaauaucacgaacauuccccaaaacaaaggcucugcuccagaauuggaaugauaguauaccaugccacggcuuucagcaauaccaguuucuuucuccagcagcaggacucauuaacaggaugccuggacuggacuucccugcaacuuauuaaagagcagccagcuccaguaacgaugggugugcagaaagccuugagcuagaggcagccuugaccaaagucucauucuccaaagccugcuaguuauugaagcuucauuuaagcacaaagaaacuuuuugucucuuuguguuuucuugcugccacccagggccugcgagaacaggcaugaggauuucaggggcuggugugggccuccccauggcuucucuagggcagccccacagcuggcauugagagugagaugguaguuauuacaaccuagauggggccaacaugggugugugaaaggagccccagagaugccucauucgccuuggccaacuguggccuaagaggaugagccccauauuaguguuuacagggguccugggcccacaaacccaucacugcuuucuggcucugcaccuccugauguggcuagggucuccaccucuuucucuguggaggagcuggucaccacucaucugccuuugugccaggugcaguuugucuccaaccuccaaaauccccuuucugcaccuuccccuucucuugcugaccccuuuucuucucuggcauccuuacacuuucucuuucccuucauccaucaaugccuucuucaaaaaagcaugggucagauuccuucacacaaaugccgcauggcuacuuccuccaauaauugcauuuuuacaggggaccacaccugaagccaggucucuuaguaauuacgguccuuggccaccagcaagcuauugggggaaaucaucucuugaaugggcagagagagguacauuuuugguagcuguaaaaugauaucacagagucauucauucucauucauucuuguguucagaagaagagcccaucuuuuaaguacagugaauucuguuagugacauacagguguacaguuucuuuucaaggaccuacaaaauaaaaggggcuaucuuucagaagauauucuucuucacauuggaaauggaugcaguuuugauucuucaacuccauuuucucacuuguccaagguuguaccaaaccacuccaucugagugacauagugauguuucuaacauccacaccucaaauauuggaacuagaggaggggagaaauuucaaagcccacuggaaaaaaacucccugaaauaugaagauacaugacuuuuuccccuagcaucccaggaaaaaaaauaagacuacacaagagggggaaaaaacagcagguuuuccuugaaaugcucuguuuuucccacccucaugcccuaagagaagguagccaacaaaagaaaugaaaagagccaauugcuuguucacauaucuacuuacaacaauggagaauagcugauuuuucaaagacuugggguaaaaaagagguucuagaauuuucuuucaucagcuuugcuguguuuuuccagucugcacaauugugaagccuaucuuuauagccaaacaugucucuggcugcauuuuucuucuuuucaugccauuguuggggcucauuggagacauucuggccucagcugcucauccgccuccacacuugaaaguauuacuaggucauuucacagucuucuuguuugcagucaguauuuccaauucuuuuuaguguuuccuucuaguuauucaacuaaaaauaauagaaacgaauggcuaaauucaagaucaaacucuuccaguaaucucacaccaagcccccuccuuuuuuuuccgcacuugaaaccauuugaaaaauuccaaaaaauauuuuuuccaugaccgugccuagauuuggcuguagcccaagagauaaaagccugugauaaaggcucuucugauggugcuucuaaacucaagccaaacccagcaaggaaugaauggcucucaaguagcccgacuucuuaacagaggagauuuggcaaaguuuagaucaacaccugaauguuuggcuccuuauugcaacuuggaugaacaaacugaauugggaaauuaagugugguggggaaggcggaccuucagccaauacuaaauauuaaacugaauuaaaccgaauuuugaagugccaagaagaaucuccuuaguccuuuguuauuuaucuuuuacugaggucucaguguuguauuuccugcugggauuaaaagagaauggcugagagaaguuucuggaggcuacucaucugaaaaauccagcgauuuaacuggcccaugggguucagaaacuuggaaucaaguucaacaaaggcacuaaguggccaagagcuuaucccaaauaaaucacagcccccaaacaagguguugaaaaucuauggcuuacucucaguucuacugcugauuuauucaaugacuuauugcacuucucuacccucccuccucaauuucaucucuaaagucaaagugaugacaccugguaccugugaaaaugaaugauuucagugguuuccuguguguaagaggcucuucgauccuugccuucaaggcugguugaaaugugguagguuaaguggaugugcuaagacuggcuuuccaugagguuuucucagcccagccucaguuaacacagaggcuuaaaacuauaggcacaauuuacccacuuugucaguuccucagucaccaauuagcaggacuaaguccugagccaaacgggcaaguauugaacacauagaaccucauggguucucuugaccuguccuuuuuguggucuucucuuucugugcacaccuuaaaacaaaugguuucagggaguggccacucccaggagaggacagaguuagggugaagaauggggcagugagcaucauggggcaauggagcccuuuuguucagaaguugccuugucucccucaaccaucacccucuucaaagaacccucaucagaaaggcccucguaccuuucucauuuccuuccuguaaagacaagggaauucuagaggagaggagagcaucaguguuuacuuuacagaggagcaaacagagacccagggaggucaaugacuggucaaggcucugacaccugaggcagaaccacaugggagguaggcauuccgcccccagccuagggcccuccacaucccacgccgcuuccuucagugcagggugaugcugccacugaccaggcuucugagugucucugcuguacacuccagaugacaagccugucaucagcuucaagcagaccucuuaauccacugcucaggguuggcauggaagggacucuucaaagaaaccagcacauuagugaccugaaaugaucugugucccagggcugucuuaaauuauuuacccaaaaguaaccagugguuuggggcagacuucucacuuuccuggccauauugugaagcuccuuuacaaugcgggaaguaaacagugucgaggccaauauacucauacaauaugcucuguguagacacagagcgaaggcugagaauuuucuguaagaaacugcagaaaagcaaacuaaugaaggaaugcuaaucccaaauaaucuuaacuuagaagaaggaagaaaaugagggagagaggaaagauaaaaaaaagugucugugugugugugugugugugugugugugugugugugucagagaaagagagagugagaaagaauggaaagggccauaagagagggccuucuuauuugaggacuaaaucauucucaguaggaauuuccaggcagcagguuggagugucuuggggguguuuccccugagcagcauguguggucuuacacuaccaggcaguguuccagggaaaagcuuauuucauuagaagagguuggguuugugacuggauauggcguucacccuuugugccguaguguugcaauguauugacaagcacacuagagaauauuugacucuuccaggguggaggguguuucuggaacagucuuguggguguuuucauaacuagccacccuggucucucauuccaaaaaaucaggacagcaggagaucagugagaccuugaaucaugccucaccguguaccuacucugucucucgaugaugcagagagaagggacacugaccaaaauaaggugacuuuuuggccugagacugaucuucauaugaaaaugaccagaguuuugugaaguuggguuguauuuguuuuuaagcaguagcuacugugcccacuugauuacucaagcucuguaaaaccccuucccaucauucauucagagcugaccucuuucucucacugugcugaucugcaacagcuggggaagggauggguguuggagaucgggaaggcagaggucugacucucacauagauauaugcaagguggaagauuuguggcaaagcuaggugaucgcuuugaauuccuugaugagccugauacgaaugaaugcaagccaaaagacaagagaucaggugccauguuugaaagcauuucuaucaaucagacagauaaagggaacagaaaucccccgaugcccaacuugcagcagccucaauuccacaguauccuccucuacacucccacauuuuccuuccugauaguggcccaggcucauuugcccaaucccugcccuggacuccagcagcacuugggaguccucuccgcaaugccucacuuucuuucaugcuaauuuggcaugggugagucuucacuucccaaccacccugaagggccuugaugguagacaccuggucccuuacaucuuuauuuuccaaagucaucaguuuguuuccugggcaugcagugagcccucuuacuaagugguguuaggcugguuaguugguuaaugaaaacugcccuuugaagaacaauguaauuuaguuuccugcucugggugaugccugucauggaaagcaugaaaccccaaauuucagauccccacuucuucauguucaugagaagccccucaaagcccuacucuaucaaaguagugagccagugaaacaggcaaccaaaguguguauccagccaauccggaucugagauaaggcagacucuuuuauuuuauuagaagggggcaguagggauauggugguaguuacagugucccagccacacccaaagaacuugaaugcagacuggggauccacccuggcccuaauacaguuauuugagagucaguauuuguagucaggcugaccugagacugaauccacaugggggccuagaaggaaacagggucaugggagcacaaagguugaaagcggaacucgugugggugguaagaucccuuccugaccugcauucuucuagagguuuggcccauuccacucucccuagcccaucucacacucaccaacacacccacccacuaaaacagaguccuggaacuuccucuucaaguuuuccccauugaaaacaaaauucugagucccugguuccuuucucccacucucuccugaugucugcccugacuucggcagcuaggucugccauccuguggcugccauuuccccuuuccagggagcuguggccucuacccucugccuugggcuccuagcucaucauucuccccucugccucccagaggccgguagcuuuacccguugguucuccugguagcaucuuaccugccacaccuugccuauucuuugcuagaacuacagggaccuaaugagagaaccacauuccuuccugcuggccuccuaaggaaacaggcugcaguuuaccuaccaggcucaacagaaaaggaaaguggcugguaaagggcaaagaugcuuuugagagagagaaagcucuuaaucaaacacagauaucaagaauauuagcaaggggacuagagaaaauugcuaucaaaguaaaugguuuuuuguacaaauguucccuuuauuuguguuuuccccagugugccauucuuucuuuaaggcuuggugaacagaugugcuuuugaaaauguugauuaacuuauccuuuuuuugacccccuucccacucacucaaacucaggggagcagugauuauauaaaaagccaagucaagccacuaaaguguucuucuucaccuuaaguagccuuugauucuccaggugcagaaaucucagcugcaucugggcaauugauuucauugagucuuagaaaugggccaauucuuaggaaaucaucucauccaguccucaaccuccagagacaagaggccgugaucuccugugauaaaauguucucaaaaucauuagcaucauuuuacccuuuuuccuuuaagaucaaugccacauucaccccuuuccagccagugaucuaugguauccuaagacuucuucccugagggugugagauggagcaagauggcauucuagccuccaagaauucaucacauccuuggcagaaacaagaucccuaaaagcaagcauaggauuuggcccagaagucacuggcaggagccccgugguucucauccuaggcugauucacauauucuuauccaguguucugccucuuuuacuggugaagauguuaagacauaugagcagcccaucaaaccaauuaauuguuggaaaugugacgguuuucuuccauguuuuuuuuuuuuuucauauggaaaaaaacccuguggguugacuuucacaagcucgauuugaucccugugacaaacaccaccuuccucuuguugauucauguucacaucucccuuccaaggaaacaaccugcucuguuggggccuggaggagaaugcagggaaugggcguugagguggggaggcuggcguggccugcaggugccacuugcugugcuuuaaacaugcaaggaaugggcuggaguuauggaggauuagugccauguggcaucaaucuuuuaaguggggucuuggcaaguuguuuugugcaucccuuacuagggaccgagggggaugagaaugugcuuuagcacuuuggccagaaaugagaaagacuucuaacaugauugaaaccauggccuccaggaaaagacugaauuucaaaugugacagugauggaucaaugcucaguucagaucauggucaaguagaucuuccccgagauguagugcugaugaaggaagcuuucgggauggucuaaaguucuuuuucucccucuugucugauacuucagccguuugggauuuugauuuucuuuuaagccuugauuuuuggauuucaauuuauaguagugacuucaagauuguuuaucugacuugguggaacaaaacucugagagggccauacacauucacuggggcugucuugagcugacagcuuggaaaggcauaauuagcuugugagauaggaagaaaugauaagauguugcucuuugccaugcauuugauguucucuauuaauguuuuaccauuuuagacagauaacuuucagugguucugauuucuauaaguuggacagcacagugaauagagagaccuguauuaucacccucccaaauuaucaugaaaaagaaaaagauagacagugauaauacuggagaaaacucauaguaaauuaacuuagccuggcuagucagauuggaugcccaucuuugaucuauucuaaaccacgaagaaagcuaauaggaaaaauagacuugggaaggaugagaaauauuagcacagauaugugaaggucaacaggcauuaugacaugccuuccauuucugcucuuaaauuaaaacauauaaugaugaaacaagacuuccuuaaacuaccauauguuuacaugaaauccagaggagaaagacucugaugcuuuugugcccacugagaugcgugccuaugaagaggugcagcaugauacacuaaauggacaucccaguaaaggcagcugcuguugggcauaagaugccauugaaggugccuuaaaugaaaccuguguuccuaaugaaugccagucauuaaaaaggcacaguggcagggguugcuuggcacugaagacccagaguuucuucuuaguucuguguuacugguugugguuggaggaagacacaggucaucugaaggagaacaauccaguaauguccauaaugaaugaucuagaaguagaggugauucucuagcugccugccagaauggggagucauucucguaaagauugccucccugccuuuuagccauggugauagaacuuguuauuaacuuguuuuuauuuucuuuauauuauaguggacaucccagaaauacaugagagagaaggauaugaagaugaaauugauggugaguacuguuaugauuuagcagguaaucguaaaauucaaguuugguuauaaaggugucaacaaaaauaaugcucuggguaucggagggcccaaaucuagaacuaucagucagaaauauauaaaagaaucuggagaaaaaugagggaaccaucaauggaucugucagggucaacuuuagagguuuagaaaguuuauugaguuccucugccuaaucugaaacagauccccucuuuccaguaacuuuuuaccuggauggacuuugaaucugaauaaacccuuuacaagugaaagaucagcuccuccauacgugucauagucugaaucuuuugaccuucucccaaaaauggccugagugaaugagcauaaugugaauauucucccagaccugcugugguuucugguucccuggcuugggggaaaccuuccucacacuauucaagauuccaauuuggagcuucuugcaagauuucgguuucuuuuucacacugaccaucucguaucuuuauauuuauuccaaguucuauuuuuccacugcaaacacauauacuucaagaggcuagagggcugcugagcaaauauguagauguaauuucuucccucaacucagaauagcacaggucucucucugggcuucucugaguaccagaguugaucuccaacagacucaacagcaagauuccacuuaaagaauaacuguagacuaagauugaugaauuuaagaggaacaguuuauagagcagcugcuuuuaaccugccuuuaaucagaaacuucaugcguaguuauagaaacuggagugacuaacccaaacagcaccuuguuaacugacugcagacucucccugcaaaacccaguccaacacuccuuuuaugggcaaaagugcaugaccaaccuacauggagagaccgcaguagaucaggcagaggcgcacuggaauggaguagaaagggcaauggguaaggaggcagaaagccugaucuccauuccugcuuuaacugcuugcuaagccugugaccuggagugaguuaccuaguugccuaauuucuuuaaaccucaguuuccucaccuauuaaaauauauauaauauccugccuucuucaugggauuauuaggauauuucaaaaaaugaugcccagaugugggcaugccuuggccacaguguagaaacguaauuagauuagucugcuagggcuuccagaacagagcaccacugacuggguggcuuacaacagacauauauuuucucacaguucuggaggcuagaaauguaagaucaacauguggacaggguugguuccuucugagggcuguaagaaaggaucuauucuagcucugucuccuuggcuuggagauggccauucuccuguucauacgauguucucucaugugugugucucagaauuuccccuuuuucuaaggauaccacuuuuaucggauaaagguccacccucaugaccuuauuuuaacuugauaacaucuguaaaggccuuaucuccaaauaagguggugaggguuaggacuucaauaugaauuuaagugucugggagggggauacaguucaaccaguaacaauaaggcacgaugccuuauuauuaaaggaggucugauggcugggaaaaaucugcugcuuauauggccaggaauaccaaauuaggaaacucaucaugugcaaauagucccagacuguccuuucauuagcuugaggagguuggaaaggagggauguagagguugccuugaacacaaggccauccuaggugcuguaaagccaccccaaaggugcuguuaaaaucagagcuuaccuaauguaagucaaauuauuuauuuauuuauuuauuuuuuuggagacggagucucgcucugucacccaggcuggagugcaguggcgcaaucucggcucacugcaagcucugccucccagguucacgccauucuccugccucagccucccaaguagcugggacuacaggcgcccgccaccacgcccggcuaauuuuuuguauuuuuaguagagacgggguuucaccguguuagccaggauggucucgaucucuugaccucgugaucugcccgccucggccucccaaagugcugggauuacaggcgugagccaccgcgcccggccucaaauuauuuaaauaucggauacuuaguacuuacuauguugcagacaccaagcacuuuacaaauauuaguucauguaauccuccuaacaacccaguugaggcagauuuuacuauuauccccauuucaaagaggagaaaacugaagcaaagagagguucaauagcuugcccaaaguuacacagcuaggaugcggccaggcugggcuuugaacccaggcagucuaauuccagagcugcugcugcuaacuacugugcucugaagagccucugggcuggggaggcucagucacuucacccugacauaggcagugccugcaaucucucaugaauuuuauguaucgcagaugaauacgagguggacuggagcaauucuucuucugcaaccucagggucuggcgcccccucgaccgacaaagaaaagagcuggcuguacacccuggaucccauccucaucaccaucaucgccaugagcucacugggcguccuccugggggccaccugugcaggccuccugcucuacugcaccuguuccuacucgggccugagcucccgaagcugcaccacacuggagaacuacaacuucgagcucuacgauggccuuaagcacaaggucaagaugaaccaccaaaagugcugcuccgaggcaugacggauugcaccugaauccuaucugacguuucauuccagcaagaggggcuggggaagauuacauuuuuuuuuccuuuggaaacugaaugccauaaucucgaucaaaccgauccagaauaccgaagguauggacaggacagaaaagcgagucgcaggaggaagggagaugcagccgcacaggggaugauuacccuccuaggaccgcgguggcuaagucauugcaggaacggggcuguguucucugcugggacaaaacaggagcucaucucuuuggggucacaguucuauuuuguuugugaguuuguauuauuauuauuauuauuauuauuauuauauuuuauuucuuuggucugugagcaacucaaagaggcagaagaggagaaugacuuuuccagaauagaaguggagcagugaucauuauucuccgcuuucucuuucuaaucaacacuugaaaagcaaagugucuuuucagccuuuccaucuuuacaaauaaaacucaaaaaagccguccagcuuaucccauccucugauugucuucugacuuaagggauuuacugugguguagguucugccagccaacccuacaagcugccauuuccaguccuagcauuuaaguaggauguuguugccuuuaacuuuucuuauccaggggaaaauugccauuuuagggucagcaugaacagcucuuucuuguaugcgauuuaaaacaaacuggaaaggaaacuucacacgucaaaauccauagaagcgccuggacgaggcuuaaagugcuuugugagugaauaggagccauucgcuaauucuagacccacagugucuggugguggggcuucccuuguggggcuucugguggugguuuugccuuuucuuuucccuccuccauguucuucuaaaacauauacauauauacauacacacauacacauauucuucaggucucuaagccccuggaagcagcauugugugauauucucagaggcaggggaaaauagagggaaaaauagagacuauugguauguucuccccaucagcgaguuauuguaacuggucaccacuggacgggaaggagaacagaggagagggaaagagaagcccaaccucugugaucauaugagggccaaggcugagcaguguagacagagacccuuugaaaugcauuugucucucaaauagacuaguaaacaccgacuucuccuuuggguuacaaacaccauuucaaccuuucgggagagucagagcuaggauguacaagaacugauucuaaccagaaguccgcaaguacuguggacaagaaugcuuaaccaugcugcuucagccuugagagaccuagguucuuacacauaugcacacacgcauacacacaugcacgcacacacacauacacacaugcacgcacgcacgcaugcacaccaauuuauguuuuuauuaagugccuugaaaaaaugaagaaaaauguauuuucccuuuauguaaaaauuagugaauaucuuaugaauuaaggcauuccucuuucccuaaccccgauggcuccauucccaaguaccccaacucacugcugauccuauuaaaggaaugaguccugcuacccgagugguagucauagcccuagaugacucucaacuacucuucaaagggaggcaucaggaauagaaugaaacugugugaaggauaagauuguucgcaucaagauccaaaucuugauuucauauuaacgccuaaggauugccugugugcuggaaauauauuugaaacucaaccaguaugcccagccuauugcauaucauugucagaccauuuuugcugcuguggucacccacgauuucauuugucuuauacccaggugaaaggggaagggugaaugggacuggcugguuccuuuaaauguuaacuuauggaaaugcuaguucaaaugguaaugucacaguguuuuguaugcagagagcaagaguucaaccaacagcuguuuauucaugugugugugucuuugcugcuuugaguucucuguaucuacuguguaugugaauggucaugugggacucaguggugguguugugacuuugaccuaggguccgagugucacagcugaucuuggcacucggcacucauuggcacagugguaguuagaggugaaaaguagagcugucaagcccaagggcuuagcuuuagggcuccuccugaguucggcccacaguagaagcaagauuuuaacuagccccuuuuccucuucacccucccaugaugcgcaguguucagaaagcugguaaguccuagggauuuccagaaguagccugcagaagaagguaaguuugaaagccacuccagggguccugaugcugucaugcucagugagccauuuuacaguucuccaaagucuagcccuguuucggaccugcacuucaccucuaaguuauguacaacucaaccugcaucccucuaaaaguccuauauccauauucaccauuggcuaauuugaggcccugagugggccuugaaugcuaaaaagaagcaggguacgcagggcuacauguagauaccacaccaaggcuggaggcuggucugucauaagacagaaagaaagacgcugggcccaauuuugacuuggccaggggacaccuugguguguuuguuaucuuuaucuguggguaggcuagcugacccaucuccuugagucauucccuuugggaaaccccacugccaguauugaucuccuuuuugccuuguacugaaugacacauuaccuccacacucucccggacuagguggucaacagggccacaggguugcuuucugucuuugguggggcaggggaguugacagggaugaggguccaaggaauaagcaugaaugacaagaaaacaagggaaagaguuaaccugucacauagcagguuaacuuuuucaggguuugcaguuagagguauucgaccauucacuggcugagccagaucacgggaacuugagagcuuuuacugugauucuucaauguaaaaaauaaacaacaaugucaaacuguguuuauaugauuuguauaaagccuuuuuaagauuacuauuuaaauaaacauuauaccagagauau

SEQ ID NO: 12723 - RNA, 178216 nt, Homo sapiens
caugcgcagugcguuccgggccaggcaacagcagcagcacagcauccagcaacagcaucagcacccgaagccccgcucgggcgcgcucucggggggcggggcgcacgcccgcuccgcgcguccccgcgccgcucgcucccgcgcguccccgcgccgcucgcucccgcgcgccgccucagcauccucaggcccggcggcagcccccgcagucgcugaagcggccgcgcccgccgggggagggaguagccgcuggggaggcuccaaguuggcggagcggcgaggaccccuggacuccucugcgucccgccccgggaguggcugcgaggcuaggcgagccgggaaagggggcgccgcccagccccgagccccgcgccccgugccccgagcccggagcccccugcccgccgcggcaccaugcgcgccgagccggcgugaccggcuccgcccgcggccgccccgcagcuagcccggcgcucucgccggccacacggagcggcgcccgggagcuaugagccaugaagccgcccggcagcagcucgcggcagccgccccuggcgggcugcagccuugccggcgcuuccugcggcccccaacgcggccccgccggcucggugccugccagcgccccggcccgcacgccgcccugccgccugcuucucguccuucuccugcugccuccgcucgccgccucgucccggccccgcgccuggggggcugcugcgcccagcgguggguauggccccgugcccuuugcguuggcuuucccgcggggcccugcagaggaaagcgaagggcgcgcggguccgugugcuccgggcuuguccccggcucggccuuuccuucccucccugccugucuuuccacccuucucguucccaaacccccauucaucccaguucacuuuuggaaguccauuucuguugcauucgcgaaaaacccauuccaauucuuguugguuccacugggagguguuuaguggauccugggucccucagcgaucucugugcaacuugcggaggggcaaccaguggaugggaaauacagcgagggagcaaguugcuacuugcgugguggaaccuuaaugugaaugcggggaggauguagugauaauagugguaaugggcuguuuccucaaauuucguauccggcgcauucagugcgguuggaauuaaggugggggaggcacacuucggggaccaaagaauuaaggugcugaagacauacuucaugcacgaccuuugguucugauuucucaaagugcuugucauuauaaugaacaauuaauauaauaccaucuucuauauauugaugauuggaagucacugaaagcagaaagcuggcuuugucaggaaaauaaaaagaaauugggaagcugccagcaucuguaucccuacauggcaaaguauguuugcucaucuuaaaguuaaaagagaagggaauuguccauuuuguuaaaagagucgauuaauauucgguauccauaaauucaguacucaaguuaucuuaggagcguucuuagcucuuggaugggaugccacuaggcagaguagaguugugcuucuguggacucagagaagggguggagaucgggggcaggaccccugaacauguucauuuaaugacucuucuucccucaaguucauucuaccccccccccaacacuuagaaguauagauuugagucugacuagaaauguauauauaagacauaaaucaaaauaaauagugcacaguuguauaagccuuauuggcuauuuauuaacuucuccaggccauuuuauuguugaaauaacuugcuuuacucuagcucuacuucuuaacugcuuauaaauagaaaacuuuguguuugaaauuaaaggaaaaaugcauuuuagugcuuauguauuuaugggguaaauauguguguguuuguguauguuuguauuuucugcucccccaccccccuaccuccaccagcuccgcauuggaaugaaacugcagaaaaaaauuugggaguccuggcagaugaagacaauacauugcaacagaauagcagcaguaauaucaguuacagcaaugcaaugcagaaagaaaucacacugccuucaagacucauauauuacaucaaccaagacucggaaagcccuuaucacguucuugacacaaaggcaagacaccagcaaaaacauaauaagguaggcaggaggcuggcuaugcaaaaguaacuaucaugaagaguuuuccuuugauuugauuuucugccagaaucugaguucacaaauuuuacugcagcauuuuauuaagaaagcaauuaauauuaugauaggggagaaacuggaaggaauuaacuugggaucuacugggauaagacuguuguuucucuucucugacuaaacuggaacuagaauuuucugauaccugaaaugauauccauguaucuuucagguacauugggcacugaacaguaguuaagugaauguguuuaugauucuaacuuguuucugugaggcuuuauguaagggugcaguauucugccuugauauaaaacugucucccaugauauaaaaacugcuuucaaucugcacaugcaagauugcuucaagaagcuauuuggcugcagugucuccaucagucuuuccacuuagaaauugaguguuuaaacagucuguuucuuuaauugaucaguaggaggaaaaaaaaauuuucuguuguauuuucaauagguaaacaauuugacauuuaaaaagauuauggugacuagacacaaauuauuugcauaauaugaagaccaauuuugauuggcauaauucuucaguaccuacucugcauugauuaugagcaguugcuuuacuuucagguuaguucagaaaguggaacugauauuuaccaagguaucaguagaagacaaauguuuaauauccaaagaguuuaagggaucuuuuucccuguguuacuauucuuuacuugaauuaauauuauuuugaaccccgagcagauuuaaacaauggauuaucgguucuucuguuguuuaucgggagcagaaaauagagucuguauguuaaauguuucauuuugaucuguacuuguucaggugagaacaacaguuagcaauuaacugucuaaacaucuagaauuuaagaaaguaucugcaguuuacaucauuguuuuuuauuaguuuucuaaaauauaggugagugguaacaguauuuauccccauuuuacaaauggggagcuagaaauuuaaggcuuuugggugauuuuccuauguuguaaagcagcuaauauaaaauucaggugaccugaauguuuaauuuuuacuauuuuuuacaaguuaggucucugagaaagugcuuucuucaccuugaauauuacuggagaggugaacuuucuuucacauuauuuugaaguggcugcuacccaccgugagauaaaugugucucuguucucagccagcccuuuucuccauaagcuccuauauaacuuaauggggugacuaauaggucaugucuaacucauuugucuuauugauaggagaaauggguguugucuuuaaagaagagaaauccaaggcccuuuugauaaaaugcauugaggcuuuuauagcuuuccuuaugaaugagaccuuuuagaguuaagugguuaguucucaaacuccagcaccuuugcuuaggaugcuggaggaaggaaaaacagcugccucaaagccuguuucaaagaaugcucaagcccuccucagcagagacuugaaauuucaguggcacuuuuuaauaacucagauguuugaggcuaugacuaaugcuugccuuauaguuuaaccuuauguggcuguuuucuuuggugggacgugguuugacuguaauauaccugacuuccgugauaauaagguuuguuaaaccuguacccaccgcuuaccuagaggaauaguuggguuucuuuuauacuguacuuugaaaagaauguuucuacagaaaucguauuugaaagcauuuuucuuauuaguuuaacucuauaaacauuuguugcaccuuucucauaugcaagcgguaugcuaaguauucaaagauaagagauaaagguuaaaaggaugaaaagacaugaucuauccuccaggaggcaggaaaaugagauaagcaagauucuaaaagugcucccguacagguauagacaguguuguuguuuggugggugccuugaaauuacccuuuguguucugugaccucccuuuuacuucuguuuuuaagcaucucuugaaguaguugauaaaaaguguuccaucugcuuucugcuguaucuuaggaugacuugcuuaauaacagugaugagagacacuugccaguucugcugcuuuagaaauguuucaguaagaaaguauagaauuucauuucugcuuuuauguaaagaaguuuuuaauaucuguguuauguaccuuuuuuucccucuccugauuucauugcacugaagcacauuuuaaugaaagccuuagaaaugcugaaucacugugccuuucucauggaucccuagacuggggguagagguggaaauggaaauucccaaauauagguugcaaggccaagcuccacauuuaugucugaagaaauuucguaaauguucaauguugaucaaucuuuauuacuuuauagcugugaaaguuaacauguuuauuaacucuuccagaauuggugaguguaaaagcagauugugcaaaccaccucuuugcauccuaauguuucugaaugccuuaauguuucuuugucaaacaauguugaaaaaucuuuuuuaucugcauagagugauguauaaccaguuguccaaacugugccauuuuuuaaaguagaagugggcacuccuaauaauuaugccagguuaguaggcauaaaccaagguagucuagagcaggcagggaguuuugacaccuuggauccaaaugcuguauuccuugauuuuuggugcuuacucaaauucaagauucuuuaaagacaauuuuauuuucugaugauuuauuauaaauucuuucuugcuagcuaggaagucagauuccugccguguagcaguauuagggucugaaauggaaaaauuuaauuuugcuuugugugauauugugaaauguauuugguaauuauccuguuuccugguacacagcuucgaagaccguuggaaucuccagagugaugagugucuuucauaugccaaugagaugauggguggcugggggucccuaaauagcuucaggaugggagcuggucaccagaaagaccagcacauuauuagagguuugggauuugcaccccacaaccccaaagagagaggcagaagguugaguugaucaccaauagccagugauuuaaucagucaugccuauguaaggaagcauccauaaacacccaaaagacuggguucuggaaacuuuuggauagcugaacauguggaacuuccuggaggguggaguuccuggggagggcauugaagauccucgcccuaugugucucuuccaucuggcucuucaucuguauucuuuguaauaucuguuauguaaaugguaaguguaaguaaaguauuuccugaguucugugaaccgcucuagcaaauuaauuuaagggaauuguggcuacccuaguuuauagcugaucugucaggagcacaggccuccaucuggggcuugagauuggcaucugaagugggcauuuguaggcuugugggacuaggccuucaaccaguggaucugacgcugucuccaggcuaagagugucagaauugaauuggaggacaucgaggugguaugugauggagaaucugcagaauuacuugguguguggggaaaacccucccauacgucagaugucagaaguguuggguuaaguguugugugagacuagagaaggaaaaaacauugcuuuuuucuuauaucucuuacuuuguuaucaagaucgaucguuuucacuuguggagacuuuuaugggcguaaauggaauuguaugauuacuaaauauaagcauuuuauuaaccauuaaugcaauauauuaauaaaauggaccauacauuuuaaaagcaggagaaacacuuuagauucauucauucauucugagauaauccuauguggucuguuccuaggagaguuaaggaagcuuuuccugaaacuuuagucaaaaacuacuuguccugcugggcgugguggcucaugccuguaaucccagcacucugggaggcugaggcgguuggaucaccugaggucaggaguuugagaccagccuggucaauauggugaaaccccaucucuacuaaaaaaauacaaaaauuagccgggcgcaguggugcgcaccuguaaucccagcuacucgggagacugaggcaugagaaucgcuugaucccgggaggcggagguugcggugagcgucacugcaguccacccugggccacagaaugagacucugucucaaaaaacaaacaaacaaaaaaccccccuaaaaaacuacuuguccuauaucaugcucccuuaggauucucgucucuucugguugggaagggauuguggagaugcacgaugcauagcaccggaccuuggggaaagcugacuuuaguugaccuguguggcucagucuuuugcuuucucuacuaccuaccaccccagguugaagagagaagagagagaaguuuaagugaauuuagaucuuggugauuauuuuuguuuccuucucuauuuuaggauaggacugguuccacauuucuugacuuuccagaaaccaguuguuccauuguuguugguaugggacaacagaaagaggaacauaggaugaagacucccaccugucucugccaugagauguuagcacacguuuuuacaauucuggaacauaaauuuuuaugaccuuuauuauaaggaauuaauuuuaaaaaucaauagaaaguuuuauacuguggaacauggggaaaagauuucccuucuggaaguuucuuuagcaagccuagacuuuaucuaaagagcugccuuuaucuaaacagccuucccaaguuuuccaggucuuccuaagcagucauuacaaaauuguaauauauagaauucaggcuuguaaugauuuuacuuguaaugcuuggcauguaguaggccuucuguggaaugaauugaugauugaacacuuauauguuagaguauagggguucccauggaauucauguuauaaucaaacuaaaauucaaaaggacccucaaaauacucaaguauuuuuggcacugugcuccucacugcuacugaggagagauaauuuuggucuugaguuuuuagcacugcauaagucacacuaacuauaugcuuacacuaccuaaaguagcaaaaaugccuguaucaacaauucuuagauaaugucucucacugcuacccaucauuaaugugauugugauaaucaagagcugguaguuuuuguuauuuuuaugguggagcaagaugugucuuucuacucaaauaguuuccaguaaaucagauuuacacauaguagguguucaguuuuguuugauucagcagacauuuauugaauacuucuuuugaaucaggcgcugugcuagacucuggggaaaacgaagaagacuaacacuuugucccuaccuuugcucacugguggagugucagaaucaagguagccgcugaugugugguuuauguuagugcaguuacuaguggaaggaacagaaggcuguaggcauccaaaggagagaauaaccguugccuagggaagucaaagaaaaccucauagaggaagaagcaauugagcuggcccuaaagaguaauuaggaguuaaguuugugcagaagguggagaaaggaagagccacagaaucggcagaggagaggcuccaggugcaaaggccugacuugcuuggguaguagcagguuauuuggguggugagugcaagaaggggaaacucaaguguaggaaacuucaaagacagagucucacucuguugcccaggcuguagugcaauggcacgaccuuggcucacugcagucucugccucucggguucaagcaguucucccacuucagccucccauguagcuaggacuacaggugugugccaccacacccagguaauuuuugcguuuccaguagagaugggguuucaccauguuggccagguuggucuugaacuccugaccucaggugauccgcccacuuuggccucccaaaguucugggauuacaggcauaaaccacugugccuggccuaguguaacauuuguaaucaauuuuuaaauauccuacuuaguuccucuaagaacccagugacauaggcauuuauagacauagcaguugagauuuauaguuaguaucuucaguaaggacaaauagcuaguaaauggcagagagagccaggauuugaauccaggucuucccuuugcagagcucaugcugaagagagguaggguguauugggaguggcaggaagugaagguggaagguugugaagacugugaagacacaagggggucuggauuuauucuauaucaaacuguaaguccuaggaagucaagagaugagcgcauauugauugagcauagaugagugccaauuauguggcuccccagcgagcuuuacuucuaguaggaagagacagaccauaaacauguccagagcagcaaugacaaccacaugaagauuuuagguauugacacgugcuugcagaagauaaaaaggcauaauaugguagagaguggugggugugaugauuucucuugaagaaucagaagauugggcuuacggcccuggaugggaguaauucaccuagggaguaacccaccuacagguaagauguggcuccucuuuagauaggaugacacaugcuguuuacugcagugcccucauucuuuguugcuaacacuaacccuucugcauuucuggucccuuugggcauuugaguuuggauccuugucuuugauuauucucuuccauaaagucuagaccauuuuuggacauuucauccugguuugguccaacugcuaacugugcuuuccagcagccuacagcugagcugugcuguugaaagucuugcuucagcaugugucccuaaauaaugcuuucugcucacggguugacucauuccugcuaacuauguaacuauuagugucauucugucuucacuuauucucaggcuuuguuagcaggguggaccacuguccuucucuuuacaguuggugaaaaaauaacccaggaggccaggugcaguggcucacaccugucauccaggcauuuugggaggcugaggugggaggaucacuuaaggcuaggaguuugagagcaacucaggcaagcuagccagaaccugugucuacaauaaguuaaaaaaauuaaaaagaaaaaauaacccaggagcauuugcccaauggugaugcccugugugaagguaaaucaugcaggaagagagcucuccuuccugccuuccucaucuuucucagccaugccccucaguuuucccagcuaucuaagagugaaccuugggagucaucuuugacuccucccucuccugccuauaaauagucgcugauuaagucuugacgugucucccaugacuccaucccuccccucuucucugcauuguguucuugucaucgccucuggucucucucucugucaauccaucagucccacugcugacagauuaaucuuuauggaacacuuauuucaucaugugacucccuuuauccacauucagcaagcauaauuucagcuagaugaauuuuccucuuggagccagggagaggauguaaaagucucuugagaagaacugcugcuuuccuucuuacaccacacauuugcuguucccuucuccuuucagcacuuuuccaggccuguuuacccaaaggucaguccauagcagguuauaauuuuggaugauucuauucauuucuguccaaacccuggggcuaguuauagaaaaccccugugaccaguggcaagaaccgaaucuaucaggaauguguucuuagacuuucaaguccaaauucuguuaaauuccugcuucagaacaucaugucaucuccaucuuuaagaucugaauaauuaauugcuuguagaauaucaguuuucuaaaugaaaauauuuuauuccuuucaagaauguauacaauuauaaggcuuuauucauacaaaguauucaguucacaauugauaugggcacccuuuaaccuuaugaaagacucauucauucauauaauucauucauucagaaucuacugagugaauuuucaauuuuacaagggagucuuuguauuuagaauuuguaugaauucaguaugauuuuaauuaaauuuaaugguagaaaugcuauuauaaaaaggcuagauccaguuauguuuuacucagaauaaugagaaauuaaaaacaaucauguuaauucauggccaguuugaauaaaacuuuugcuuucuauaagugacaugagagguucauucuccaucacagggcaccccagccugggacagaugugaaccugugaauuagcacaauguuucaaauaaaguuuuguuauauggguguccuguauggcuaaagaauauagagaggcuaauuuccucaucuggaacauuacacauugauaaauucaagccauguguauugugaaagauguuuguuaccaagaucuaccuuaagaucuaaguguucucuaagccuuuuauuuggaaaugaaaaggauggaaauucaaacaagucuucucugcugauaggcacuaauuacagaguaguuaaguucaaacaaaccagugaaccaaaguguaaauagaaccuuuguauuaguccauucucacacugcuauaaagaacuaccugagacuggguaauuuaugaagaaaagagguuuaauuaacacauaguuccacaggucguacuggaagcauggcuaggaggucucaggaaacuuaaagucuugguggaaggugaaggggaagcaagcaagucuuaccauggcauagcaggaaagagagagagagagaagugccauacacuuuuaaaccaucagcccucgugagaacucacugucaugagaacagcauggggcagucuguccccaugauccagucaccucccaccaggucccuaccccaacacuaaggauuacaauucaacaugagauuuggguggggacacagaaccaaaccauaacauuccacccuagcccaucccaaaucuccuguucuucucacauuucaaaaccaaucauaccuuccaacaguucccccaaagucuuaacucauuccaguguuaacugaaaaguucaaguccagagucucaucugagacaaggcaagucccuucuaccugugagucuguaaaauaaaaaacaaguuaguuacuuccaagauacagugaggguagaggcaguggguaaaugcucccauuccaaaagggauacauuggccaaaauaaaggggcuacaggcuccaugcaaguccgaaaccuagcaggacagucacuaaaucuuaaagcucugaaauaauugccuuucucacaucagggcacacugaugcaggggaugggcugccacagccuugggcaucucugccuuuauagcucugcaggguacagccucuguggcugcuuucaugggcuggcauugagugcccguggccuuucuaggugcauggugcaagcuguugauggaucuaccauucugaggucuagagggcaguaacucucuucucacagcuccaauaggcagugccccaguggggacuguguauggaagcuccaaccaaacauuuccccucugcacugcccucauagagguucuccaugggggcucugccccugcagcagauuucugccuggauagccagguguuucguacauccucugaaaucuaggcagaaguucucaagccuugacuuuuaccuucugcauacaugugggcccaauaccacguggaagccaccaaggcuugaggcuuggacccacugaaauaagagcuugagcuguaccuuggcucuuucuagccauggcuagagcuggaguagauggaugcaggguaccauguccugaggcugcacagagcaauggggcccaggucuggcccaagaaaccauuuuucccuucuaggccucuggaccuaugaugggaggggcugccaugaaggucucugaaaugccuuggaggcauuuucauucaccuccucuuaggcaagcuucugcagcaggcuugaauuucuccugagaaaauggguuuguguuuucugccacauggucaggcugcaaauuuuccaaacguuuaugcucugcuucucuuuuaaauauaaguuccaguuucagcccaucucuucauucacgcauaugggcacauacuuuuagaagcagccaggucacaucuugaaugcuuugcugcuuugaaauuucuuccacaagauacccuaaaucaucucucaauuucaguguuccacagaucucuggagcagggcacagugccuccagacucuuugcuaaagcauagcaagagugaucuuuacuccaguucccaauaaguuccucauuuccauuucagaucaccucagccuggacuuugcuguccauaucacuaucagcauuuugguuaaaaucauucgagaggucuguaugaaguuccagacuuucccacauuuuccugucuucuucugagcccuccaaacuguuccaaccuccgccuguuacccaguuccaaaggcgcuuccacauuuuccgguuucuuuauaacaauguuccacuccugguaccaauuuucuguauuaguucguucucacacugcuauaaagaacuaccugagacuagguaauuuaugaagaaaagaaguuuaauugacucacaguuccguaagcuauacaggaaguaugacugggaggucuuaggaaacuuaucauggcagaaggcaaaggggaagcaugcacaccuuaccaugguggagcaggagagagagagcaagcaaggggggaagugccacacacuuaaaccaucagcucucaugagaacucacucacucucaugagaacagcaugagggaaauccacccccgagauccaaucaccucccaccaggacccuccucuaaaacuggggauuacaauucaacaugagauuugcguagggacauagagccaaaucauaucaacccuggacuggugacuaugagagcaggaugugggaaauccguccccaugauccagucacuucccaccaggucccucccucaacacuggagauuacaauucaacaugauauuugcaugcaggcacagagccaaucauguaaaccuuggaccagugacuauguugcucuugagcuuugaucuguaauuauauagcugggcacacucacuuuugcuuaucugcaugacagugagggagucauccugccacauuaaaaaaaaaaucuuagaugguagugagaacaagguagucacguauuccuggaccacuucuuuuugcccucaguggggcuaaagauuaaauuuagaaguagucaaauccaagcacagcuagagacaucauaaagaacauuccagagucauggagauagagguuuuugaguaucuguugaauuccagugccuguuuuagaaccuccuuucccuuagugugguuauuuaauaauuuacugcaucaaguuguagucugaaucacuuagucgggugcuuugugcugucuuuuaauuguaagcaggccugcuaauaccauauacuauaauagcuguauugcagaugggcuccauuaacaaugugaaucaaucaaugcuuaagagaguccucucuccccauguuuauccuugcuuuuuauguuuucagguaaguagaaugcaugaaaucaacuuuagcucaacucuccaaugcauugguaauaaauauaauauauugccuuucuauggaaccugaaugguuuuauugaggcacuuucauaucuauaaucucacaugguccuugcagcauaacugccaagaugauuauuauuucuguguucuggaugaggaaaugcaaccagagaaugagucaaaagcccaaacaagucaggucaguuugcuagaggucuuaagaauuauuagcgugaccaaaacgaccaggacugugguuuauagacuuccagucucuuguuucuuuuuucacacaucuguggguugaauagggaaguuucuguccuuuguagacagcuuucuucuugaugauaaagaccugugaacuaacugcagcugaacuauaugcauguguacacaccucacuuggccuuccucuaugaccagcugguuuucucaucuuuuuuuuuccuucccuaaaugaguacuccagauaaauaaccuuguuuaaacuacuagcauuuuuagaauauuuugcuuaucugcuuaccuuuccuucuuuaauuuucacuuuccucuagcaguuuuuccuucuuucuuguauauggaacaaagugguuauguuugguguuuccaaauaauaugucagacauucguaccauucuagaaguagauuuucuuuuuguuuugaaaaauauuuucuaauacagaaguaugcugcuugaagaaguaggucuucaaaauaaacugaauuuaauuauaacugguuaauauacccuuuauuuuuuacuaauuaaggaaaugauauacaccaaauuuaaacuuuuugucagcaugugaaaugcaguauagccaguguuucuacacugacaucauauuuuggugcaaagcaaggaaauuggcauuuuaacgauccaguguagccauuuauuugcaggauaaauaugauugugcugcuaggcuguauagaaugucagaaauuccuuugacuucucucuucuggaggaagaaugguuggaggucaaguuucuggaggucugacagaucagcuguuaccaacuaucuggaacuggacaaguuacuuagccccucuaagccccagcuuccuuaucaaucgcacagugccuggcauacaggagguacaugggaaauguuaccaauuaaugacugaccagaggcuuagggaauccaaguugugaacugcucuuucaugaauaauguauuucuuucauuaaaaaagaaaggagauuuaaggguaauugugagacaguuguggcgaggggugauucucagggucuuucugguuguauggcugcagaugagcuugauuggucuaccucagacguaagugaacaccuaagaaggagagacuacauugggaugcacaugaugucucagaggcugcaagcccuggaccacauugaggcaguuguacuguagggguguaaagaaguuuuccauaaaccuuugccuauaaucagggcacucuaagucaggcuuggauauuaggcauuuuaguggguugucaaggugaaccauuugcuucuuggagcuaauugucaggauggguaugguauggccccaaauacucauacuauaaauagcacacguucagaugauaauuuccccaagauguauuccaauuagacauccacccaccuccucucuuuuccccaacucaccaaacgaaaccaaaccuaagaaauacuuucaucugccuuugguaguuuucuggcuuuggaaugaaauggaacaauuauaaaaccaugacaaauagaauaggacauagaccucccaacccagaagaaauuuaacaggguagaaauaucagacauaaauucuguuuuuauuuggacacuaggacaauugaauauguuaugacaaggagauaagauuuugguuuuugcgucuuaacagucuuaaccaagaagaguuaauacacugauuccccucuucuuauaaauuauggcuaaaauuaugagaguuaguaaacuugguaauuacuguggacagcccuguguaauguaauggaguuucaucucugcagaacguuuagacuguaguuagaagcauuuaucaccguugggcugcauaaguacugucacuuguucccuucagaaccagugugauacugagaugaugccgucuuauuacuuuuggcuuugcagugguuuguuaaacaguuuuuggaaaugguuaauuauuauucuuuacccuucugauuaacuauaacuauauccuuauuuauucuuuuauuugggauguuaauccuuuuaagaccuacuaaugcauuuuaggauuguuacccaaauaguauauuuaugaauuaucuugucugccaucagaucuuaaauuuguuuuuccauuuaguuuuucagaguucuuggacuucccuuauauuuucacaccguaauguguuaaacauuuauuaacuuacuuguaugaaacacuuguuugugauguaaucguuugagaaucuuuguucuuucacagaaagcauaaucucuuccuugauacacagaccuacauauccaacuauuuaaccuauaucuccacuuggaugucuuauaggcaacucaagcuuaacauacccaaaauggaacucuugauuguacuaucaucuacccuagcccgucccucccaaauccuucccaucugguuaaauggaacaucaccuuccaguugcuuaggccaaaaaccuuuugccuucucuuccucucaagcaucaugccaagccaucaaguuuuguguucccuuaaaaaacuauccagagauccagccacuucuucuuugcugccaaccuggucuaacccacuaucucucacaugcaccauuagaguaucuucuucucuucucccugauuuugucccucuccuaucacucugguucuccucuguuucacacauaucaggcagaaugauccuuuuuaaauucugauuggaucauuucacucuuggcucaaccuccagggauuucccaucuacucagaaugacuuuuuuuuuuuuuuucccaccuccaaucauaauguggucacugaagaaaauuaggcuacuguuaguuguuauaguugguuggcaggaagugcucuuuauguuuguguauuuaaacacaugcccuagaaaaacuaaugagauauaaaaaguugggcgcuuauaauucuauuuuuaauuuuuggaggaaccuccauagcauuuuccaugaugguugcaccauuuuauaaucucacugauggugcacaaggguuccaauucuccacauccuuaccagcacugguuauuuucuguuauuuauuuuuuaaaaaauauuagccacucuaaugaguaugaagugguaucuuugugguuugguugcauuucccuaaugauuagugauguugaacaucuuuucauguguuuauuggccauuuuuacauuuuauuuggagaaguaucuuucaauucuucgcucauuuucuaaucuaguuguuuguguuuuuuuugguuguugcugcugaguuguaggaguucuuuauguacucuggauaucaaucccuuaccagauacaugauuuacaaauauuuucucccauucuauggguuggcuuuucauucuguggauagaguccuuugaugcacaaaaguuuuaaauuuugaugcaguccgauuuaucuguuauuuauuuuguugccugugcauuugguguuauauucaagaaaucauugccaaauccuauguuaugaagguuuuccccucuguuuccugcugaguuuagucacuuuagcucuuauguuuaggacuuagguccauuuugaguuaauuuuuaaaugguguagguuaggaaccaacuuuauuuuaauuuuuugcauguggaugucuaguuuucacaacaccauuuguugaaaagaccauccuuucccuugugaauguuuucccauuuguuugugucuuuaauuucuuucauucuuuuucuucuucuuuuuuuuuuuuuuuuugagauggagucucccucuguugcccaggcuggagugcaguggagugaucuuggcucacugcaacaucgccuccucgguuuaagugauucuccugccucaaccuccugaguagcugggaugacaggcccccaccaccacaccuggcuaauuuuuguauuuuuagaagagaugggguuucaccauguuggucaggcuggucuugaacuccugaccucaagugacccaccugccuuggccucccgaagugcgugauuacaggcgugacccaucgcgucuggcuugaaguaguuuccuucuaucuguuuuugcauauuuuaucucauaaguuucuuuaaaagggagaccagacuaugaguagaauaauugacuggcugugcaauagauagccaguuuuggguaagacacuuauaucuagauuuaaauuuccuaauuuuaaaaauaaggagguuggguuagauuugggaaucucaaacuuuagugugaguuggaaccacuuggggaaguuguugaaaagauuuugaguuuguaggucuguauggggucuggugguuugcauuuuuauaagucucaggugauuuugaucuggaugcguuuguucucuagaaucccuuauggcucuaaaauucuuugaaauauccuccaguaaaaggcauuuggguauuuauuagaggacaugaaaugaggguaugggccauugaauuagggauuguuuguuauuccaaaucaugguugcauuuguggacaagcugccuccugagauuugggcauguuagauggagaguaggaauuaugaagugaggacauuuauugcuugaaaaugaaaagaguagcugccuucaggaguggcuggugugagaugauucagggacaaaagagcuuuugcaaaauagaagcagaggagaggggcuaaggaacaguggucagcagagaggcuguuggggggaucacacugccucgauuuaucacuaggaaguccagaaaguccugauuugccgccaggaaguccagaaacagacagucucuggucugggaauucuaaacaggagugcugggagccuagagcaaaggaauguuacuggaggugaaaaacugaugaccaauuugcauacacaugcacacuuacaccuguaaaguuaguauaaauaugucauauaaaauuggugguuacucugguauauuuacuuacauggucuaagaauucagaguucauaaaaauauaauaugaaaagugaaaauuucucucccagcacgccccaaaggcuguuacauuucuguuuuuaguucucacaacguuaaauaauuuaucucuacccuauuuuuagauccuucaaccuaaguacuaucuuuugucugccugcucugaaaggcaaagacuguaucacacuaugguguucuuccccuuuucgcccuaccacuucgauuuuucuuccuuacuuauuuugaauuugcuguggucauuuuacauuugaaaaggacuuggagcagcgggacuuaggguuagaauucuguguucaguuguugucuucugccccuggggagaaaaguaaacuuggagacucagcaagaacagcuggaacccaaguacccccauuuaaggauuugccgggagcuccugcuuggcauacaaagccucagaagguugauggugagggauggagagacauuuugugaaggaaaaauugcauauuuccugcucuguuauuuuuuuuuaaaguuaagaaggggccagaggaggaagagucuauacagauuuuguugugguuucaucaggaagccacugauggguuuuaaacaaggaaauaacauuaccugauuuauauuuuaauaagaucauuauggcagcucucuggaagacggacuggauggggcaagaguggcugcagggauaccaguugggagggguuuacauuuguccaggcagugaugguguggacugcacugggugaugagcagaggaauugcagggaugcaaguagauuugggauacauuuuggauuauuguaggcuagaagaggagaggaguuauaguagacagauuccccuaaagauguccacauccuaaucuccaacaccugugaauauguucucuugcauggcagaagacacuuuguagauaugacuaaauugaggcuacugagaugggaguauauccuggauuaucugggugggcccaguguaaucacaagggcccugauacagucagagagaaggagauguaauguuggaaacagagguuugagugaugcgaggaggggcccacaagccaaggaauacagacagccuuuagaagguggaaaagauuaggaaacaggcucuucccuagaaccuccagauggagccagcccugccaacaccuuaacuuuaaacuuuagacuuugauuuuggacuuuugaccuccagaaguguaagaugauaauuuauguuguuuuaagcccugacauccagggaaauuuguuaggguagcagcaggaaauaauccagcagucaaaaaugacuacuauucuuuguccuggggaauagugcugcuaugucccaauguggggccgaaaaggaagguuuaggaggcugacaggaaacugagccuguucagcucaggaggacuguuggucaucugugugcauauguuaaugaccucguuguccccgggaucaggggcaggucaggaugagauggaaaugugggagccuucaccagguaaaugguauguagagaccucgggguuucacccauggagagacuguauuacgugaauuguggaaaaacagcuuaguaauuucuuucagaggcuacauagagaccuauucccucucauugcuugcugucuaaauuauaguuguuuucuuuugagucaucaaaugacauuucaaaagacaauaugaagcugccacuuugggagaaagaaagcaauauuaagcagcuuuuucgaagaucaaauuucuggacucuguagauaguugcaauauuucuucuguuauuauuuuuugaaggauacauaugagcucauuugacagauuuaaaccuguaguuuaauuuggggggaaggcuuguauggcuauauauuuuuaaaaaucuaguucuuuucaguuggauuauauuuaacuguugaaagaacgaaacuucccauuuuuguuugcaucaguuacuucuugcuguuuuguuucaagggccuuggugacagcugaaaauaagcuuugaaaauaaaguugaauuuugacugggcaugguggcugacgccuguaaucccagcacuuugggagggcgagacggguggaucaccugaggucaggaguuugagaccagccuggccaacauggcaaaaccccgucucuauuaaaaauacaaaaauuagccgggcgugguggcacgugccuguagucucagcuacuugggaggcugaggcaggauaaucacuugaacccaggaggcggagguugcagugagccgagaacgcaccacugcucuccagccugggugacagagugagacugucucaaaaaaaaaaauaauaauaauaauaaaaagaaacaaaaguugaauuuuguguugaggcaacacaucuagaggaagcuauacauacaucuucuguacauagagaguagggguucucaaccaguuugcuccccgcugccaacacucccccauaggacauuuggcagugucuggagauauuuuugguugucagaacugggcgggggaggcuacuggaaucuaguggguggaggcuagugaugcugccaaauguaccacagggcacaggacaguccccuaaaaucaaagaaguaucuagccuaacaggucaauagugcugagguagagaaacccugcaguagaacuuguaaacuuaucaguuaggaauauggcaacuguuaucuuucugucacucagcacuguuuccuacauugcaucuaguugcucagugaaccagccagcuuaguuuuuuucugcccuaaguacuacaacauuuucuuucuuuguuuuucuuagagauggguuuuugcucuuuuacucaggcuggagugcaguggugugaucguugcucgccguagccucaaacuuuugggcuuaagcaauccucagccucuugcguagcuaggacuguaggcucacaccaccaugccuggcuauuuuuuucuacuguuuguacagaaaaggucuuacugcguugaccagccuggccucaaacuccuugccuuaauucauccucuggccucagccucccgaagaauugagauuacaggugugagccacugcaucuggccuacguucuugcagauucuauaauuuuuauuuugugggaaauuggcuaauuuaguauucacuggaauaggaagcagaaaaaaaagaguuugcuugaagucuucauuuaaauggauuauaaaauuuucuuuuugccaagauaaaaguguuaaauuuauuauaguccucuacuuuuggaaaaaaauuaauguacuguaaguagcuuuuauuuugagcucuuaaucaaguauuaauagcauuauguuuucucuaauuauggcuaauuaaauauugcccagauauaguuauuugcuuauuucagguaauuaaaaacaucaucugaaauaaccguaauugaaauaauauaaaauuguaaaaauugcucuguuuguuuuuuauucuuuggcacuauuacaaaauuuugaagcacugugaauuuuuuuaaaaauucaagaaaagucuucuugcugucauuuggugacuuaaguagcagcucggagaacagauguaggaaugaagugauuuauauaaugcuucagaaucuuuuuguuccugaauuucacaauauaaacuuuaauuaugaaauugguaagagauuuugagaaaccuacauuauuuaguaggaugugggauauaucuuaauuucugugacuuaaaaugaggucucuaagaugggagauauaguuaguaaauaaaaauaaauaaguuuaugccuuuaaaaauuccuaaaaugagauauuguauaugacaauguauaugaugauguaugccuaaaaguagugacauguuugaaauauuagaagcaguagagauaucaugacuuccagaacauggaagugaacuuucggaaaaucaaagauaaacauuauguuguuucuuaggaauguuuaauauauauacauucaugcaugugauccaugugguuuguuagagagcugugucuucauuugcugaucauucuuuugaaauuuuaacauguaugugcaagacauaagaaagugaugcucuuggacuugaauucuuuuugggaaguuuauagugcauaauaucucuugguuuucaaagugacacuguccuaauuaaaaauguugauuuuaaaacccgauuaguauguugcuuuacaauugacuucuauaauuuuuucucuguuaucuuagguuucucauuuaaacucuagcucuaucagacaguaaguuauccacagaauuauauacccuccuuuauucauuuacuaggauuuuuuuaucccuaauaugcccuuauuuacucauucauaugucucucauuuacucacuuguccauuacuacgaaauuuauucacucaguaaacauuaaaggauauaucuuuaauuaguguauuagucuguucucaaaucgcuauaaagaaauaccugagacuggguaauguguaaagaagagguuuaauuggcuuauggcucuccacacuuuuaaacaacuaaaucucaugacagcucacuacugcgaugccagcuccaagggggauggcucugcaggcuauacaggaggcauggcagcaucugcuucuggggaggccucaggaaacuuuuacucaugguggaaggcaaagugggagcaaggugucuuacauggcaggaguaggaccgagauggggggaaagugugacacacucuuaaacaaccagcucucaugagaacucacuguuguaacaacaacuccagugggaauauuguuaaaccauggaaaaccgcuugcgugaucaaaucaccucccaacaguccacaccuccaacacuggguauuauaaaugaacaugagauuuggguggggacacagauccaaaucauaaaauuccacccuggccccucccaaaucucguguccuuuucauauugcaaaauccagucaugccuucugaacagucccccagaaucuuaacucauuccagcauuaacucagaaguccaaagucuuuucugagauaacgcuagucccuucugccuaugcaccuauaaaaucaaaaccaagauaguuacuuccaaauuacaauagagguacaggcauuugguaaauacucccauuccaaaagggagaaaucagcgaaaagaaaggggcuuauaggccccaugcaagucugaaacccaccugagcagucauuaaaccuuaaaguuacaaaauaaucuuugacugcaugucucccauccagggcacacuguugugagguguggcucccaaggccuuggcagcccugccccuguggcuuugcagaguucagcccccaaggcugcucuuaagggcuggcauugagugccuguggcuuuuacaggcacagggugcaagcugcugguggauguaccauuuugaggucuucaggauggugaccccuucucacagcucaacuaggcaguaccccaguggggacucugugugggggcucaaccugacauuuccccucugcacuucccuacuagagguucuccaugagggcuccgccccugaagcaggcuucugcuugcacauccaggcuuuuccauauauccccuugaaguccaggcagagguucccaagccucaacucuuauauucugugcaccggcaggcuuaaugcuacauggaagcugccaaguuucauggcuugcacccucugaagcagcagccugagcuguaccugggccucuuuuaaccaugacuggccggagcuagagugccugggaagcagggagcaguguccugaggcagacugcagugcccugggcuuggccagugaaacaauucaauucuucccuccuaggccucugggccugugauggucugcugugagagucucuaaaaugccuugaaggcuuuuuucccauugucuuggcuaucagcacuugacuccuuuuuccuuaugcaaauuucugcaauccccuugaauuuuucuccugaaaaugggcuuuucguuuuucaccacauggccaggcugcaaauuuuccaaacuuuuauguucugccucccuuuuaaacauaaguucuaguuucaguucauuucuugacucaugcauaugagcauaaguuguuugaagcagccacaucuugaacaccacugcuuagaaauuucuucuacuagauauccuaaaucaucucucucaaguucaaaguuccauggauccccaaggcaggggcacaguccagccaaaguauaauaaaagugaccuuugcuauaguucccaauaaguuccucuucuccaucugagaccucaucaggcuggccaucucuguucaugucacuaugagcacuuuggucauaaccauucaacuagucucuaggaaguuccaaauguucccccaucuucugucuucuucugagcccuccaaacucuuccagccucugccuguuacccaguuccauggcugcuuccacauuuucagguaucuuuauagcaauaccucacucuugguaccaauuuucuguauuaguccauucucacauugcaauaaaaaaauaccugagacuguuaauugauaaagaaaagagguuuaauuggcucaugguucuguaggcuguacaggaaccaugacagcaucugcuucuggggaagccucagggagcuuuuacccgugguggaaagcaaagugggagcagucauucacauggccagaacaggaggaagagagaugggacgaggugccacacacuuuuaaacaaccaaaucucaugacaacucacuacugcgaugacagcuccaagggggaugguguuaaaaccaugagaaaccguccucuugaucaaauccucaugaucaccuccuacuagaccccaccuccaacauuggggauuacaauugaacaugagauuugggugggguacagguccaaaccauaccauaguuuaaaggauuuauucuuuauaucuaacugccuauucacaacuccacuuggguauguaaugugcauaucaaacuuagauucagaguccugaauuccuaccaccaccuccuucuccugcaauuuuccccaucuuaauaaauugcuugcuccuuuugguuacucaggccagacauuuuagaguuuucuugucuccucuauuucauuauaauccaugucuacucuguaagugaguccuauugacuuugccuucacuaucuucccagaaucugaccaagucucaucaacucuauuguuauuucccaagucaaaccccuaucaccuccuaccuggauuauuuugcaaaagucucuuaaggcuacucugcuucucccuugcccucugaccacuuuagugcauaguccgcacaauagcuuccagugaauuuuaaaaaauggaaaccugaucauaucauuccucacucaaaauucucagcaaauuacuauuucauucagaauaaaaggcagaguucauacaguggcccacaaggugcuacacaauugacgccucauugguucugugacuauugccugcacaacuccucuagucucccuccacuugacccacacuggccuuuuuauugcuauucuuugaauacaccaagugugccccugccucggggcuucuacaacuagcuguucccucugucugggauucucuuuccuuagguauuuacaugacuugcaccuucaccuagucuuugcucaaauaucagcuuuucaaagacuccuucuuugaccauccuauuuaaaacuaucaccucuuucuucuaaaaacucccuaacuuauuuugacucuugucuacuuuaaucuuuuuaccuauaucacucaucacuaucuaacuuacuuuauauuguugguuguauuagccaucccccacaaaacacacacccuaaaauguaaacccuggaaggccagggcuucugcuugaaaugugguagacacacgugauuauuugcuuaaugaguaaaugauuucauguaugauguagaagccaacaagguaauauauaaucugaggaaauagauauauuccucagauacauaauagacauauucuauuuuuauuucuauaugucuucaaggcuccaucuaauuuucuagguucacauuuagaaaaaaaaauggaguuuuaauaggccuaaaacauuacauggacguggugagaccuaucauuugcguaugaaaauaggagauucugcauaguggucaguauucuaaauguuaguuuuaaaaauugugcaaauacagguugagugguugaucguuuccagagcucuguggaaguucgauauuagagaacaugaggucacguaucaauauuagcuuuucuacaucuagcuuuggguaaaguauguguaguacacauuuguuuugaguaaaauugugaaacaggacaguugugggccucuauguugaggaacaggccuuaaucauguuacuuaggaagucuacuggcaccugcauuuuuguaaaauggagaaauccauuuuuggcaugacucccaaugugaaaguuacucuuuucauccaaagggguagaauacaacccauccauagucguagaugaggucagaauucagugcaaaggacagagccagacauggcugaggaccagagaacacugaacuuuuccuaaucuguagcuguaguucucuguagauaaaagggaucucugccccaguaaugugcaacuugcugaggguagucaaggaaagcaaagaccacuuaggaauaucauugucaaacagcuguauauuuaacaugaacuuugagcagucucauaagcagagccugaaaaauucugcaaauggaaauaucagcucugguauagagaucccaacauaaaucacuggguagaaacaguaugaaaccuaucaacaaggaucagugaaucgagguauuucaggagaagagagcucuggccuggacaggucugcucagccuucuuugauuacauguuuucaguaauuuauuagugagggagaauuggagguuaauauuugaaucuacucuauaucauuuaugguuugcuagguagaacaaugcuaaaaugaacuguauaauuacuguaccauaauuuucauuuuguauuucagaauuucucauucuuaacgaauccuuguguagucaucauaaagacucaaguuaaagaaccuucuauugccuuggauugauauuugcauugacaugaguccacuggauuguuauagucaaaauuccaaggaccagaguaggcagacuagggaaguaggacuccuuaaggaggguugccucacaugaggcuuuuuuuuucuuuuagaauaguauucacauuauauaagcaaauuuaaaaaacugccauguaaugagucacagacacuaagcauggugcuuggugucuugcuuuccaaaacuuauauuuuauuuccauucuuuuauuuaaauuauuuaguggguguucaauaauucuggcuagaaagacaaaauauguucuugcuuuaugacacaaguguuagcagagagagaaguguuccuuggaguugugcaguuuggugauguaggaauugacgaggaaaaagaacaaggugaaucacaccucagcuacuagauuaaugcaccacauuaaauguuacuauucaggaaggcaguuaccaagaagcuuccaugguaacuguugucauaguuguauuuuuacucaucuuucaaaaaauauaugaaagugaaauaauacugcuguagugauacuugugcugcuuuacccauuuuaaauagcaagugcuccaaaggcuuguaauucagucuuucuccuuaguuggcauugccaguuuaauauccagcaaacauuaaucacuaacaguaaauguauagaagacguuucauauacauguccaaggaugcuuugucagugaaaguguauuguuacagaguccuccaggguugcuaaauaaucacuagggaaaaucuuaguuugaccucccccauacccaccauaagauuaaauguagcuucucuucuuuggcuggccaugaagaauuuuaaaaagaaauauuuaguguggcuaaugugauugacuggaauauguauuuggauuaucagugccuacuuccucuuucucuucagcguccaucuuuugcauauuuaagaguacuucggcugggcgaaguggcucaugccuguaaucccaguaccuugggaggccgagguggguggaucacuugaggucaggaguucaagacuagccuggccaauauggugaaacccugucuuuacuaaaaaaaaaacaaaaauuagcuggguguauuggcgcacaccuguagucccagcuacuugggaggcugaggcacgagaauugcuugaacccaggaggcggagguuguggugcugagaucaugucacugugcuccagccuggaugacaaagcgagacuccaucucaggggaaaaaaaaaaaaagaguaccucaaacugagguacauaagaaaagagaggaagaugaauuuggaaucucuuuaaaauugauuuauuuagaaaagagcucuuguauaagauuuggucagaaguuaaaauugacaaauccauaaauccaagcuuuccuuuuuucuguaccaucagaucgcauaaucgaauauuggcuagauuucuuuuagaguagaaguuccaucuuuuucggcuagguuggcacagagaacaaagucacacggugaucugcuuccuuuaaguaggagauguucaucguggguugugagaagagugugcuuuguugaugcuuuggucuuguuucuguaauagccuucaaacgguaugacuuaagcuuccuaauuuaaggccaaaagauagauugauuaacauuuucgggcauguauguuuucgggcauuuuucgggcauguauguuuccccccuacuugucauucuuguaaaaugcuuuauuuuaugauaaacugucauguuuaacucacaccacaauccacauugcaguauaacacuccagaauggaaggcaucuuguguuuuacuuuaaaagcauguuucuuaagcauuuauuuguuagcaaauacuuauuaacacuuuauaauuucauucuauuaaauaaauccuagaagagcugucugaauucuuucuuuaaaugcggagaaagucuuccucauaagccauucucagcucucuccagcccccagcagacucacuccacaaauucaaaugcgcuuguugcccuuacuccaaauuugguaauuaaucaugcuuauauugugugugguaucuuuacaaauaauauuuaugccagggguaguggcucacaccuguaaucucagcauuuuggguggcuaagaugggaggauugcuugaggaggccaggaguucaagaccagcuggggcaacacagugagacccaucucuaaaauaauaauaauaauaauaauaauaauaacaacaacaacaacaacaauaacgauucuuauuuaauugacauauuauauuuuucacucuuuucaguuacucauuugauuuccuuaaccauauuauaaucuuuuugaucuaaguguuaauucucggccaggcaugguagcucacaccuauaaucccagcacuuuuugggagaucaaggcgggugaauuguugagccuaggaguuugugaccagccuggacagcauggugcgaccccaucucuaugaaaaaauaaauaaaaauauuagcugagagcaguggcauguaccuguggucccagcuauuugggaggcugaggugggaggauugcuucagcuaggaggucaaggcugcagugaguugugauugcaccacuccacaccaacuugggcaacagagugagacccugucucaaaaaaaaaaaaacaaaaaaaaaaaaccagaaaaacaaaacuaacucuccuauacuaaucugcucuaguaucuuacauaagguagguauuuaauacaaauuguugcugguuagcccauaauacuaucaauuggaacaugguagaagaaaacaugauaauauuuuucuccuucaaacuaccuguuuaaaugcaucauggcaagaauguucagcaaauuacccuaauuugcagaaccgccuucauguagcauuugcagcuguuucacuucuguggaaaaugauucauauuauuuugaagacaugacaacuugaacaaggucaaagcauaauacauaaugguaauuagcaauaaaaauacaaaauuugcaaauuuugcugaguguaaaugcacauuggaauuugcuagaugguggcuaacuauccugggagggaacuuuagggugggguugauugauacccuuccaaaauguuacuguauucuuuuuucucuuuuuccuacuuuacugucuccuuccuaaaugacugagcuuuuucacuguggcugagcuacauuggucacauuauuauuauugcuauuuucuuugagaaugggucucauucugucacccagacugagugcaguggcaugaucuuggcuaacugcagccucaaacaccugggcucaggugauucuccugccccagccuccugaguagcugggacuagaggcaugcaccaccaugccuggcuaauuuuuguauuuuucauagaggcaggguuucaccauguugcccagccuggucuugaacuccuggcuucaagcgauccuccugccuuagccucucaaaguguugggauuacaggcaugagccacugcgccuggccgucaguugcauuauuguauuauuuaauccucgcacacaucauguuguuaagcuauuauuauuuguauuuuauugaccggaaaacauugaggcuugcagauguaaggacuucuggcauaaguauggcacuuuuuugucauuuaacuaaaacuaacaccucauguuucuuccuuugaucuaugaccuuggacaauaacauuaguuaaucucucucugcccuuuaaaaaaguuucuuuucuauaaaaggguaauaaaaaugucugcuguaccaauugcauggggugcuguguucuagauagacaugacaguacuuugagaugauuaaaauguaagaaaugugaggcauuauuauuuuuaucauaacacaaaccugugcaaucaccaguguaucaauuuagaaugagggauuagaacaaaauuacaauuaaaaauggucuguugauauuuucuuuuggacuucaaaacuuuuaagauauauuuacauauuuggauuuuugcauuauacagaaaaagauucacaagcuggacuuucauguuucucuagcuacaggauagguccaaacuaguccucuuuagaaaaaccucugugauugaaaagaagugacuucuuuuccucaaacuuauuucaauuuaaaguugacauuuuauucucauugauauuuaauuaucugggaugcuggauucugugccuacuguuuucguaugaaaagaaaaacauaccaaacagccacgcugaugaaagucuuccuggugaaguggacucuuguucucagcagcucaacccaugaugacaaaggcagggucccucuagcaucaaauuagcgaauuuuccuccucccaucuuguuaguuggugaauuuucaaaucugccuucucugaaacauuauaaaauguccugaaucucaaaaaaaggugauguuuuauauucuaugaccuuucuccaccauauuugaagauaauggaguggaaacucuugaagggucuauugaaaaacuguaaagguaaggaaaagaaccguaugcaacaagauaaaggaaauaaaauacuuccugaaaagguuaugguuacacacacacacucacacaccugucacauguauacaguguagcugcuguauucaguguuuuaacagacauagaauaaacauuguuuuuucuauguuagaauaaacagagaagacaggcaucugcuuacugacuuuugcggucucuaaugcccucuuuccugaagccgagaccuguagcccucuucuuuacgaaguugaaugugaaucauuccacugguguuugcuuaggccugcuugauacccuaaagggcuucuuaccucuguuuguaaaacauuuucuugucuauugauauuccacuuugggcauguuucguucauuacuuaaaugaauaucucccuaaauaaacugaauauaucuuaagaucaggaaaccacuuccaaauucuguuauguuucucacaccaccuauaguuuagagcagggguccccaacuuccaggucacauugauaucaggcuguggccgguuaggaacugggccacacaguaggaggugaguggugggugagugagcauuacugccugaguuccaccuccugucagaucagcaguggcauuagagucucauaggagcaugaccccuauugugaacugcacgugcgauggaucuagguugcauacuccuuaugagaaucuaaugccugaugaucugaaguggaacaguuucauccugaaaccaucccccacuccaccccauccguggaaaaauuaucuuccgugaaacuggacccuggugccaaaaagguuggggaccacugguuuagagcauacuaaggugaaauauaugucucagaagaugugaugauccauaguguaggcacucaguuacccaaguugcucaauuucuacuaaauuuuacaauuuaguagaaauucagccuuaugauauuuuuugaauucugggaaaauguuauuucccauuuucaguuccaguuauggguacgcucuacagaacucacaaauucuugccaaguagugaagaauacuguuugaacaccuauuaugugugaaacauaguugcaugaaaacauguauauccugcaaauggcugccuuuuauuuuuaugauuagauauagaguuauuuuucuucuuguuuuuaugucuauauuagcuauucuagaauauaagucccaagaaaacacaauaguaucuauugagccuauuuaauguacccuacacagaguugagcauguaugauugcuuaaugucauaacauugcuugaugauaaggugagaaacaagucuuagccgaagaacccaauagcuuucuuaaaguuauuuaauauaccauuagaugccauccacuagaaagaaaaaauaaaaacaaaagcacauugcuaagacguguaaacuguucuccagugaaggagguuuguguauauaauugaguuuaauuguuuuucuuuucagagcuccuguaauuucccugugccagauucugaguuaaaagaaaaauacuaaagugguuaggcagcagcuguucucaguccuucagggugguaauucugagcccagggacaugcucauucuuguugugaaaugauguucuuuggcuauaaaacccugcauucuuccccagugcuauuauagugaauguccuuauaaaagcaaggcuguuuaacagauaucccgaaagagaaaauaacugauuaugaccuaauaugugguucaugaacucuucucugaagcauuccuaggaucugauuuuguauuacugaacacauuucuaaaccucacuguauaguuccuuuguaaaagaagaacaauacuguagguagucuuuguauuuuuaauggauuucagugaugcuggucaguucauuaucucuaaaaucuguuaaaucaacuaaaaaugauauggcuguauauuguaagacuuuguacucaucccagccauucuucuaacuuuucuaccauuuggaagaagcaagccaauauucuguuaaaaaaaaaaaaaaaaaauauauauauauauauauauauauaaaacaacaaugugguuuauaaaauaaugacucacuuuacaugauuugaaaacauuuaaaaugggcauauauaaaaacuguguaauauuuuguuaaagaaaaagugacaaauugaaauggacugcauagcauccagaaguuaaacacuauuuuaauugugucuaagacagggcagaaauaaaaugauagggaaaaguagcacuugucagguauuuauuuugguauagagaagaaucuguacugucuaagcacuugcagaauguauagcaauggaaagagaaacagaauguaagcaaaauaacauacaucaauauauuuaaaugacuuaaaauggauauaaauguauuagaugaaacuaauuccauuugauacauugacaaagaagaugaauauggugaggaaaucuuaaaucauuuuauagaaaaugugcuuccucuuagaauuaaaauauuaaaacauucuuacugauaaagguaauaaaaucagguuuuuuuuuuccuauggauaaacagauaucuuguugcuggcaugauaaauugcuucaguucuggagaguaaucuguuaagauguuugaaucauaaugauaugaugaugaugaugaugaugaugaugaugaugauggcgugugccagaaauggugcugagugaguuugagggaguggccauuuaggagaaggcucauugucuuggccacauguucuuguuugcgaucauaaaugucacugaucaugucacgugaagccugccagucuccaucccaccuuuucagauucauuguuugacauuucaucugaaaaccauuuuccuacaggccauauucauuuuuuaaaaaauuuaaaaagcuuauuuuucucacauucauuuugacucgauuuuuauaaauguuuuccuccaugccuugagugucuuuucuuucucugacacguggauucuuauucaucuuuugaguuguuguucaaauagcaccuugucaguggauccuuucugcaccucucugugccuggaugggguucagccauggucccuguggcccauuagacaagcugaggcugacaguuguaccugccccucuggagaccaucacuucuuagagggcggaagcugugucccagcuaucuuuauaugcaaagcaggacuuaauauguuuguguggaaugauugaaugcaaaagcaaaaggaaaacccaguaugauuuacuagcucuuugauuaaauucuauuaaacugaagcuagucacauugacuugguauaaaccuauucuagcaauuaucaaauuguguaacuccuacaauucuguaaaaugaagguacuacauuuaccaccagauuaccuuauuuugcaagaguguugucaguguuuguacuugucacaucacuuauuugcuauaaaauaagccuuuuacugagucucugucaaguucuucuuaguguuuauaaagauguucaaggagguauauuuaucagcucuuuuagaccagggugccacuaaugaacucaucucuacuguauaauauucuuaagagaaacuauacuuaaggauuuaucuuauucuuaggaaguaaauuuuacauacuuaaagcuuuuuugaucuagagcugaaaaaucucuccuuguacaaauuauucaucaauauaaauaucuuuaugcaaaaauuaaugcuucaagguacagaaugaauuugaagacuaguggauauuuguauugaauagagguucuguuguggauaacagagaccacacuugacagaaguuucucucucucucucucuuucucucucucucucacucauaguuguauggauacaggaagcccacaaguauggugacccuguucuagaagguuguuuggaauuugacuugguguccuauggcauuaaggauuuaggagccuuguuucucauuguucuguauuuaaaauuuaauauuuguuaauuuccuuuuuacauuuuauggauuauuauugagugacuaucugauuuggcagugugcuugacugaaaguauaagucaugguuuauuuauaguguuuuauggguuugguauggcaaaaagaucuugacaaugaauauuuggugaauuacuuggaaggucagauaugcuggggaagagucauuaaucuagaccuguuugcaagaccccugugauauauguuguggagcuuaccacccaggggagggaugggaaagggagagacagggaagcacaaauaaagugcuuccaaagcccugaacgugaagacugugugaagaaagacuucaugaaaagcauugcaggugggacgccuuugaaggauggggagaguuucaaucaucauaaauacagggaaggcaaagaggagcaugggguaguauuggggggaaggagggaauagaaaguacugggagggagaugccugguguguucaugcugguguccaguuaccaugcaugaagcacuucacagaugauuugcagcacccacugugccuuaggaaugcaauucuggaggaaggacguuagugagucaaggaaguacaguguagguguuucauuuagccuuguucuuuuuuuuuuuuuuuccugauagugugacaaaggagaguuuuauguuagcuaauacuuugacaaaacuuuauugauuuguuaauuugcaauauucaagaugcuucugugagcuauaauaaucuuuaacaucuaguaaauaggauucauguuuagauggaauuaucuuuguaguuugaauuaagacaaaauaaugacaauauuuauaaacauaugacucuuaaagggggacauaagcucucaguauucacaaaaggccagguucuaagugcuuucugaaguuacaagguuguacucucccauuuuacugucauauucugcugauacaucauuuagagaacguuccaagaaaguucuaauuccugcugaagagcagagcacugacaugauuuuucacuuaggugugcagaaagaguuguuuagcuuuaugcacaaaacgggcugaaaucaagcuuuaauuagucagacuuuugcauaauucgucacggucacuuuguaaguccagcagaauaugcuguugguuuuuaucuuaguggguucauuuucaaggauguguugucuuauuagcucuuugcuacccaaauauuuagauuuuccuagcaaaaccaugauauuguaucuagucuccuaaagaaaugaauugcuauaugaugauacauaaggaaaugaacugauacauaaaaguuauucgucuuaaauaucauucuugauaauaaucugucuuaaagacaggaaaguaaguuaagguucuucugucuuuuugaauccauaggcuguccaucuggcccaggcaagcuuccagauugaagccuucggcuccaaauucauucuugaccucauacugaacaagugaguauuuagacauaaucuucuuaagaagcaggugcaauaaagcuuuguuuuuauaauaucgguuuagucaaaauaaugucuguuguuuaacaacuauuuucuagcagauuauuauagagcauguaaaguauaaaauucugaauggugaauuauauauuuuuuuccgaaauaaaagauauuuaacauguuaagcaucucaaacccagcacuuacauauuauaauuuuaaauggaauaaauauuugaaguaauccaguuaauuaaauguuaauuauaaucaucacuauauauaagaagcaugauaaauuuacugauucaaguauaauuugacuacagucuagaaauuucuuccauuuacucuuuauaaugcaauucgcaugacuucugugggaagaacagaguaagugaugacuugcaaauaccuauuuugagaagauucuuugcuuuauaauuugcucuaauaugguuucuuagaaauuuugguccugaugaaaauuuacccgauugucucugagcauguguuuguugauauuuaaaugcuguuuccuaaguucaaaucaguuguacagaugucuuuguacaaagugugaacaagagcuguugacuuaacuaaggcucuucagccucaaauagaucuagcagugagccuuucuuuggugaaagagauuuucuaugugguuuucuugaguuacagaaauuauagucaguauuuuaagcuuuugucaguauuuugaucaggacugcaucuuugcaagaaaaauaccuguuaaugcuaucaaacacuauaauguaagugaccacaaccaauauuugagaaauugcaaagaauuauaaagaacaacuauuaaauuuuuuguaugccaaauucugugagcucugcagaaaaaaaugcaaagucagcuuggguguuccuuaccaaguguuauugcagcuuuaagucagaaugaaucagcagaacucagaauugccuauguaaagguauugcagguuuuccucuuugguugaguuccguuucaccaugcugugucagcaguuugucugccuaagggacuugucuugccaaaucuuacacuauguugaguggcaagauagagcuaauuuuaguguaaguccucaauuccuuuaacucuuacugcgguggagaccaucauuucaaacuguagcgagaugaucgcaaccaacccugcuguguguuuugagcaauaaaauaucucagccauagcagagccucccagucaauuaguacauggcagagaaagggucauaugggauggccaggguacuuagaggucuggaaaugugccagaaguuaucaguaacauuuagcaugcaaaggaaucagguugagcaccuauuaugagcagucccugacuugaggaauuuagagucuacuugggggaagguugauagacaaguacguaauuuuagaagaguaugaaauaugcuggagguuaaaauggaauguuaugguagcaccaaggaguggcagcucucaggcuggaggagugugaaaaggcgucuugggaaaggugaugcuugagcuaaaucuugaaguguguucuaggcaugugagauaguauaucugaagaggcaaggccacguugcaguguggcauguuagaggagcaugagccuuuuguugaccuuccucauaaaugacaagauugagacgaggaagaugaguugggagagguaagccuagggacagcucagcucauggaaguucugguauuucacgugucagugcugggccauuauccccuagacugaaaaaucaagucaggggaauaaacagagguccuguucucaggaagugcuaagaggcguggagagggaauacuuucaauaaaucugcaguugauaaaaauuauuaggauugcuccauguggauaacaaggcagagaggauaguuaaagccaacagagguaccucgauugguugguugguuugagggugaugucuagcugaaaugggcaguaccagggaacaaacagguuaaauggugaagggaagagaauguggcaucagaagagacaugauagauuugaggggcuuugggacauacauguggccaugucuaggagguagcuggauauaaccucaggggagagaugggagcuagagauaguagacuugguagguauuuuuauauaaauguuaaugaccaacauggcugugaaugagguuaccgagggaggguagguagaguaaggagacagaagcugagaagacagguaagaggaggggagaagaggaggcacccaugaaggaaauugagaaggagugauuggagaaauaggacaaucaggagaaugauuaaacagaguuucaaaaugggaaggugugauuuacagugucaucugcaguagagccaucuacuggcacaugcuguggaauaaucuaaugagguaagaggcaaaauuugcccuuuggauuugccauuugagcagucaccggugguuggaaagcagcaguuucaaugaaacucugggguggaggaaaugagaggggacagaaaccggguuacaguaggcugggagugaaugagaggagaugauguggaggcagcaaauauccauugaggagguuuggaugagaagaaaagagagcagaagacauugggaucaaggcagggcuuuuuaaugaugacagagcaaguuggcagagcaaguuaacagagcaaguuugguggacugagagacggagcugauaagagugggagguugaagaugcagaaaggagagaggagauaucuauagggcaagagcuggguagagacugaagggaaugagaucaaagcccaagggcagaacuuaguuuugaaccgguaaagacagguuguccugcacuggugugaagcuguagggugugugcagauggagauugacuugcaggugaggggauggaguugaagaaacacauuucugaaguuaucuacuguagggguugggauggagagggagguuggguuggggcuugaggaaaaugacaaaauugcugggaagaaugagugaggaagcccaucaaggucaaaugcaagaauuuuugagcaaccuucauuagaaaucaugugcuauguguuagucuuuguguauuucuuucugguguuguuuuuuauauuuuauuuguauuauuuuuaaaaauuggagugcuuugucacugcagagugugaaugaaggaggcagacuguaguguggacccagggcucaaucucugugguagcacagaauaagaacaguguaggcaaagcucuuugaauacucaugaauaacuugcauaguuaaguaucaggauccagucuggguuagaagggagaugaggucaagaggaggcuaugaacuggggacaaauggaggucucugaagggaaaacuaacugcagugagagagaggccaugagagcugcacucaagugcuaucucccuugauaugguuuggcugugucccuacccaaaucuuacuuugaauuguagcuuucauaauccccaugugucaugggagggccccagugggagguaacugaaucaugggggcggguuuuuccccugcuguucuugugauaaugaauaagucucacgagaucugaugguuuuaugaaggucaguuacccugcacaugcucucuugccugccgccauguaagacaugccuuugcuccuccuucaccuucugccauaauuauaaggcauccccagccauauggaacuaugaguccauuaaagcuuuuuuucuuuauaaauuaccuagucucagguaugucuuuaugagcagcaugagaauggacuaauguaauacaucccccaugcuguccugagcuuucugagugcaaccugagugugcaaggcuggcaugaugaacuggaaaugagggaacuguguuagaacaugagauguguugcugggggugggcucuaguuuagauuacuucugucugggauuaaccaaaaaguuugauauguguuagaauaaagguagagagucaggagaauguuuaagucaguaauagaggacccaaaagagcuucugaggaaagagggaccucauuuccacuauaggaugaucauugcuacauuacagacagagguguuaaguuaucaaaggagggaaaggugucugguaaguaugugggcucaggguguggaggaaugagcacauaaagguguuaccauaaguuaauccagguggugaccauagaaucuucagaguuggugaccucaccaggcccagaagcccagcuugugaggacuaaccugacaggaguuccugagaggagagccugguuugcaucuggcuuguggaggcaucucauggcagugcuguguguuuuauucauuuguucagcaaauguugagugagcaucugcuaugugccucuggcuguuauaggugcugauguugcugagaauaagauagacaagacuugugccuucccuuuuagagcuucauuccagaggaggaggcaaacagugggccaccacauaaagacauauaggauggagagggacuggaggugggguguccagcaugauuuagauggucagaagaagcaagaaggccuaucugaggagggaaccugagcugagcccugguugucaaagaggagccacaacacguugcuggaaggcugaggguucugcacagcugggacagcaagacagccagagcuaaggaggaugugggauguucaagaagggcagaggccauuaugcagugcagggcaggggauagugggagaacgaggagacgagaucagagaggaagcagcugugcagucaggcgaugaaggacugugguccauggugaggagugugggucugaagccauuggauggcaguaagcauggaagagacauggucagauuucuauuuuauuuagccccaaaggucuuaguuauggccuuagagguccuuuaauuacacuccucucagggugcuccucuuuuaaaauuuuguuuaguguuuccucuaaaauagccguuauuccagguuacagaagauuuugaaaagaucacuaggguaacguuucuugucuuuccuuuuuuuuuuuuagugucaaacaagcauuuuagauauuuuuuauuuugauuuuuauuauccacuuuauugagguaugauugauguuagagcaacaauucuuaauguuuaucaguccuuggaagucucagaaggucugaggauugauugucucuucucugugugugaucagaauuaugccaaagccuauauuacccauaauuauauuugcugguguuuucagcaaauguuuacugagaauaaccaugauuagaguggcacaaugguugaaagcauggguaacucuuugaucuugggcaagcuucuuaacuucuuccuuuucuucauuuuuccucuuccuccucuuucuccuuuuccuccuccuccuccuucucuucuaccaccuccaccacgaccgucaucaccuaucauaaaacucacuuuucuaaaguuuaccauucaguguuuuaaaauuacauucacaaaauuuugcaguuaucaccacaaucuaauucuagaacguuuucaucauccccaagaaacccuguacccauuagcagucacuccccauucccuucuuccuuaggccccuggugaccgcuaaucuacauucugucuccaugcauucgcguccuggacauuucauacgauaugcagccuuuugugacugaccucuuuuacuuagcauaauguuuugagguucauccauguuguagcugaguaauauaccauuauuuggauauauucuaagcuucuuaagcuuuaguuuccuuccgaagcuguagguuguugcaaggauuagaugagauaacauguggugcuugcacguguuuguugacaaugaauuauuauuaccuccgugaggcagucacugcgcugagauguugggggauucuacauugaggagaagaggcauugaucucauggaacuuaugaucuggugagagcagcucaggucauaagaaaugcugcuugucuucccuuuggcuucagucagucuuuuucugacuuuaguaagugagaagggagggguccacuauguaaucuuuucucucuucaaagucggcugaagaaaaaaaaauggagacaauuugguaggcccuggguugauaggugcucaagguagugagcacugggaauucagauaacauacuuccauugaguugaaagcaugcucgcgagacacuugguacuuguccaguuuucccagagcugcucaccagacauccauuaaagaacaugacacgacuugcaggcuauugcguauauguggguauuuaaguuuccaggccaucugacugguccgaggugaacacccagguccucagcaugcuguccuguuuauugugaagugaaaucccugugcuucuuuuagccccugcccgaugcagagaggaaagaauucuuaggaugcaucaaggguaaugccuucuugguuaaaaaggcagcauuauguuccuucuuaauagaacgcuacuccagcgagagaguguggugaugugacaugucuuuguacauucaucuugaaugaugcccagggagaacuccgggugaaaucaguguaagacauccacauuggguggcugacuccaaaaacugaggaguagacccaaaacuuggagaguaagguaguuucggauuuaggaaaacaaucuuuauucugauuuucugggaaucagagguguuugauuuaagaugaauaucuagaaaaugcugauuuaaagaaauacaugcaggcaguacuuugcucguuaaaagcaguucacgcuguguuuuggaaagaagcagacagcuacacugauauaguuucaguuagcuuaaauacagagcccaaccuucuugcugacugacaugguuaauucauucuucauucagucaacaaacauuuauugagcuucucguuugcguaagacacugugcugagcaacacgggggaauucagagcuguaugaaagaauuucucgucuucaagagccugugguagagaaaugagauuacaguguacacgaauaguguuaaaacaugauagaaagugacuugagagaucuuggugaugagggaagguuuucuggggaaggugggauuccaugggacuccuacaggaggcugccuugguuuuggguccccugguagcagacccugagacaaggagggaggagcuaggaaagggugaguucucaagcuguuuacuccucugggcagcugggauucucacugagagcucugggagucuguggacucaugccagagaguuaucccaccuagaggcagggagcuagaguuuuguccacuaacugccaggcuguuguuggcugaagucuguuucuuggggcaguaacacuuuacuaccuccuccuggguagaguacaaagcccucaggcccagggucucaggcaguuccagucagcugccuucaguguguggaagugaaugccaagggcauaguggcagggcccaguggagcccauagcaggugcuuuagacuuugaaaggugugggaaggagaaagacgcagacuccacaggaaguggcaggcagagguguggaagcccaaaagcaccaaacuccuggggugagucaggacuggugaggcccccucucuuaaagaaccugaauuaccaagcugcaaacagaaggcaaacugccuggugggagucccuggauccuaagggggauauucagcuuuauuuggcuaaauguuuuuuucagcucugcggauuuggagauugaacuuaaauaugguuguaagaaggaacauguggagaagaaacaggccuccugccucauuuuucucuuguggucgaguaagaccaggacaggagucaggagcuguggcuggggacagcuugaggcaccuugaccuauaccagccugagcugugguguugcugucuuacgucuugguuucuaaauuuuugugauuccugaauccagauuggcaggccuuuugugucauugcuggccuuuuucucuccaacuagcagcccaucaugcucacugcugucauuucucuuacacaucugagagagggaaucagggaaggcacuggccuuaggaauuuggagucaagacuuccaauuucaccucugcuucagagagcuggucacacacucugggccuuaguccgaaggaauuagaggagacuaugugaacauugcuuuccauuucaggagucucgggguuuaugaugcugcuaacucgaagguuaaaugcuuuacuucccaguuucaagagaucugcagaaggaaggcuuucuauuauggugauagacacugugccaagcccuauguguacccauagucuccuauuuaaguuccuuugauaacccugugaggaagaugugauuauccccauuuuacugcugaguaacaugcgggcuggcgagauucagucacaugcagggacuccagcaugggcugucugcuuggagucuccuucaccguggcugcuguggucacagcacuggacuaccaauuugcaagugagcugaaccuaauucugaugauugcauaucuguucacauuaagugagaaaaagaguggaauuauuuuggucaauuuguaacuauaugaggaaaacacggaaggucccaaauaggauugaaaauaaugcuguuuguugaguagaaccaucuguuaugcucugugugucucccacucugcauucguacguugaaguucuaaccccuaguaccuaagaauguaacuauauuuggaaugaagucuuuaaaaagguaauuaaguuaaaaugaaaucuuuuggguggcccuuaauuuaauauuacuauugucaugaaaagagaaaguuuggacacagacacuaguguguuggaggaaagaccaugugaagacacagugagauggacggcggcugucugcaagccaaggagagagcccugugaauaaaaccagcccugcugacaccuugaucuuggacuucuagccuuccgaacugugaggaaauacauuucuguugguuaaacuaccagucugugguacuuuguggcauccuuagcaaacuaauacaccguucuaauucacuuauugcucaccuauugcagugagacauucagcauuaagugcugcuuguuaauggguaaaacuguuugucccuuauacuaugauuuucaagugcuguuuugagaaauugugguuucuuuugcauuuagguacuuuaggaugauuggaacuguuuugguaguuuugaaaaagugugugaugauaaagaaucuuaagaggcagguauccccaaaguugcuguaaauauugauugccacugugcugugugcaauaugauguagucaaauauugcauuguauauguccuagaggccugauaguauucuaagcuuucuagugcugguaggaaugaguugcuauggauuuuucucuccugaagccacccuuuccugucugcuucuaaacuuuuuaauucuagagugccagguaacucuuuuuguugccauauuuucucugaucagggugaucagacauuucuggucugagucaacccauauugaaugccuuggguauuaucauuugcuuuugaugacucaucuuuaugcugguagaucagguccagaaaaucuugaaaacauauacaauaaaagaaauauugucuaaauuuuaguagauucugguucuauuuacuuagggugucuaugcaaccuacuuucaaaaugguuugagaaugacuugcacaauuaaacauaacaagauuauuaaaaauaaaaucacaaccaaaccauugauacuuauauacugauucuugauuuucauagaugaacaaaauccagcauaacucuuggguggugaaauucaauggauguuugcccucugccugccccuaccccugcuugccuauuaacaauaauuauugugagugacugggacccagggagauuaagcaccaggcuagagaaaugaggagggccacaggagccagauuuagauuuucuagguucugggagaugagaaaacugggauugcccagaaaagaggacccuguggcuacagucuuuagcaggagaauaaaaaguauggcaacuaagaauuuguagcaaaaucaaaagaauuuaauuguugaugggaucauauuacacuguuuaucuuaccuaggauauaaaagacaucucuagugagucaggagacuauuucuugacugguggauaaaaggagacccuuugcggguauccaccccaaugcagaaugugggcaaauaaaaucugaacuugacucauuuuuucagagcacuucuuggucuuuugaagacaaagacaaauaauguauaaaaauuccagcagaaguuaauugugacaaaaaauugaaaagcacagagaauuagaugugaccaagcaucugagauaaguuuauuacaguaguuacugaaaugagaucuuaccuuuuaguggguuguguaauuuucauuaucugauacaagaauuuuaucucucuagagauauaaauguuuccuugucaaagaggaauuaucccuugacgccugauguaguagggcauucaauagcauaaugguuaaugugugcaaccauuauuuuucuuaaauggguuucucauauugacccucuguguuagccaaguguauaaaguucuuucuaaccugaguugauggauagauuuccauugacagaagccauucaugaaugauuccgagcacuuuuauuucacaaauguuuauugagugccugcuaagugccaggcacugucaaaguuugccuggagaaguccuucccucaugaagcuuauagaacaauggaggaggaaagacaaaucuguaggcauuuaaugacaaucugagaaguacugugauggggaaaguacaggauguuuuuaucccacauaggagggguaccuaacccagauuagagguagaaauggauaacaagguaaauguuuauggagcuaaaugucucaacucaggccuaaagcauguuuaagagguggucagaaaaggcuugaagggggagagaguguggaggccugaagguaagcaagaaacuugggacauggagugagagaaaauggaggcuuugagaggugaacagaaccacacagcuaguaaguaacagccaagaacagaccuaggaaugcccauugucaaagccuuggagaguugagacauuaucuaauucguuugugcugcuauaacaaaaugccauggacugggcaauauuuauauauuguuuauacaauagaaauuuacuucugaugguucuggaggcugggaaauccaagaccaagccuugauaucuggugagggaucucugcuugcaagauugugccuuguugcuguguccucacguggcagaagagccauauggaagggccaggcaauucucccaaagccuuuauuguaagggcauuaaucucauugaucaucucauuaaucucauuaaucucauugauaaaggcaaagcucucauggccuaaucacccugaaaagaccccaccucuucauaggugggguuuaaauuuccacaugaauuuuggagggaccuauacauucaaaccauagcagacguuuucagugauaaagaagucugacuaaaaauguguuugaaaagcucuacaaaugugaaccuuagagaaauaaaaaacuuuauaucauuugugucuuaaccuugcuuuauuuugaauacuacuauucauugcauaaaucuagucccaaacaauaacuuauuaaauuuuccucuugguucuccauagauuuauauaaaguaagggcuugacaucacaugaacuggcucauuaagacucuugauggucaucuguugccagugagaauuguguuguuuuagaaccauuuuuuggaugauucauacacuagaaucucaucaucuagagucauuucuccuaaucuuuuaaaauuaauuauaaauuagaauccccaaauaagaauccuaacuaugguuuauuaugggcuauuuauaaaaguacucucuuuaacaaguuuguucuaaugcuucuuccaugaugauauccaugagccuuaauauaauauuuagauuguguuuaaaaacaaaauaaucuauacuggcuuuuuauuuauuuauuuuuuugagacggaguuucgcucuugucacccaggcuggagugcaguggcgcgaucucggcucacugcaaccucuaccucccagguucaagcaauucuccuaccucagccucccagguagcugggauuacaggcauccgccaccacgcccagcuaauuuuuguauuuuuaguagagacaguguuuugccauguuggccaggcuggucucgaacucccgaccucaggugauccaccugccucggccucccaagugcugggauuacaggcgugagccaccacaccuagccuauauuggcuuuuuaaaugaaacaauuucuacaaaaaguuucacguccuuuaauauaauuacaaauauauuuuuccauuuuacaggaauaucuuucaaauaagaagguggaaaucucuaauacauuguagagagcacauuucauuucuuccuccuuucuuuuuugcccaagugaguucacacauccaauaaaucagacuaaacuacaugugaccagaaggaucucacagcauaagaauagauuauaucucuuguaaaucuccaggauuucuuguuuuucuugaaugucccccucucaucuuuauugaagauaauggacagauaaaaauuaugcauauuuaagguauacaaggugauguuuuaauuuuuguauacauugugaaaugaucaccacgcucaagcuaauuaacauauccaucaccucagaugguuaucuuuuuucuguuuuugugcugagacuauguaagaucuccuuuugcaaauuucaauuauacaauacaguauaauuaauuauagucaccauacugcacauuacauccacugaacuuacugauucugcaaaauggaaacugaaacccuuugaccaaccaagggauucuuagaaacuuacuagugucugaggcucucccuuauuacuguucauauuuauucauuaaggacugagcuaauacuugacccuaaaaaaauguuugcucuuuaaagcuguucagugguaaaggguuucuuuauaugauugcuagcauuugcccucccugugcacuaugccagcucauagggaaacaagaauaagaugcaguucguuuaaggagcccacaguuuagggugggaucagggaaagcuauacagaggaggagaugguugagcuguuuugaaggaugacuaauuugagggugaguaguucaguacuuuuggguguggugagggacaauaacuuuuugagcauccauuuauuuuagcuggccauucagugguugauaucaaauguuuacuggauaaauggaagugauggauuguugauacagcuuagcuauuuugcaucuuuuuucccacuaguaucucaaccugacacagcuuuaacagccagaaguuuuauaagcugcaaaaaugaguacuacugauauuuuagcugagguuaaaaauguacaugugaaaaccauggcacgagaacuaugugacgaaugcacaagccucaguaaccaaugcuaucaacuggaagaaaggguaucagcgauggaagacaaaaugaaugaaaugaagcgugaagagaaguuuagauaaaaaaagaauaaaaagaaacgaacaaagccuccaagaaauaugggacuaugugaaaagaccaaaucuacgucuaauugguguaccugaaagugacggggagaauggaaccaaguuggaaaacacucugcaggauauuauccaggagaacuuccccaaucuagcaaggcaggccaacauucaaauucaggaaaaauagagaacgccacaaagauacuccucgagaagagcaacuccaagacacauaauugucagauuucaccaaaguugaaaugaaggaaaaaauguuaagggcagccagagagaaaggucagguuacccacaaagggaagcccaucagacuaacagcugaucucucggcagaaacucuacaagccagaagagagugggggccaauauucaacauucuuaaagaaaagaauuuucaacccagaauuucauauccagccaaacuaagcuucauaagugaaggagaaauaaaauccuuuacagacaagcaaaugcugagagauuucgucaccaccaggccugcccuaaaagagcuccugaaggaagcacuaaacauggaaaggaacaaccgguaccagccacugcaaaaacaugccaaauuguaaagaccaucaaggcuaggaagaaacugcaucaacuaaugagcaaaauaaccagcuaacaucauaaugacaggaucaaauucacacauaacaauacuaaccuuaaauauaaaugggcuaaaugcuccaauuaaaaggcacagacuggcaaauuggguaaagagucaagacccaucagugugcuauguucaggaaacccaucucaugugcagagacacacauaggcucaaaauaaagggauggaggaagaucuaccaagccaauggaaaacaaaaaaaggcagggguugcaauccuagucucggauuaaacagacuuuaaaccaacaaagaucaaaagagacaaagaaggccauuauguaaugguaaagggaucaauucaacaagaagaacuaacuauccuaaauauauaugcacccaauacaggagcacccagauucauaaagcaaguccuuagugaccuacaaagagacuuagacucccacacaauaauaaugggagacuuaaacaccccacugucaauauuagacagaucaaugagauagaaaguuaacaaggauauccaggaauugaacucagcucugcaccaagcagaccuaauagacaucuacagaacucuacaccccaaaucaacagaauauacauucuuuucagcaccacaccacaccuauuccaaaauugaccacauaguuggaaguaaaacacuccucagcaaauauaaaagaacagaaauuauaacagacugucucucagaccacagugcaaucaaacuagaacucaggauuaagaaacucacucaaaaccgcucaacuacauggaaacugaacaaccugcuccugaauaacuacuggguacauaacgaaaugaaggcagaaauaaagauguucuuugaaaccaacgagaacaaagacacaaaaaaccagaaucucugggacacauucaaagcaguguguagagggaaauuuauagcacuaaaugcccacaagagaaagcaggaaagaucuaaaauugacacccuaacaucacaaucaaaagaaguagagaagcaagagcauacacacucaaaagcuagcagaaggcaagaaauaacuaagaucagagcacaacugaaggaaauagagacacaaaaaacccuucaaaaaaucaaugaauccaggagcugguuuuuugaacagaucaacaaaauugauagacugcuagcaagacuaauaaagaagaaaagagagaagaaucaaauagacacaauaaaaaaugacaaaggggauaucaccaccgaucccacagaaauacaaacuaccaucagagaauacuauaaacaccucuacgcaaauaaacuagaaaaucuagaagaaauggauaaauuccucgacacauacacucucccaagacuaaaccaggaagaaguugaaucucugaauagaccaauaacgggcucugaaauugaggcaauaauuaauagcuuaccaaccaaaaaaaguccaggaccagauggauucauagccgaauucuaccaaagguacaaggaggagcugguaccauuccuucugaaacuauuccaaucaauagaaaaugagggaauccucccuaacucauuuuaugaggccagcaucauccugauaccaaagccuggcagagacacaacgaaaaaagagaauuuuagaccaauauccuugaugaacauugaugcaaaaauccucaguaaaauacuggcaaaccgaauccagcaacacaucaaaaagcuuauccaccaugaucaagugggcuucauccaugggaugcaaggcugguucaacauacgaaaaucaauaaauguaauccagcauauaaacagaaccaaagacaaaaaccacaugauuaucucaauagaugcagaaaaggccuuugaaaaaauucaacaacccuucaugcuaaaaauucucaauaaauuagguaucgaugggacauaucucaaaauaauaagagcuaucuaugacaaacccacagccaauaucauacugaauggacaaaaacuggaagcauucccuuugaaaacuggcacaagacagggaugcccucucucaccacuccuauucaacauagugugggaaguucugaccagggcagucaggcaggagaagggaauaaagggcauucaauuaggaauagaggaagucaaguugucccuguuugcagaugacaugauuguguaucuagaaaaccccaucaucucagcccaaaaucuccuuaagcugauaagcaacuucagcaaagucucaagauacaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggagcucuucaagaacuacaauccacugcucaaugaaauaaaaggggauacaaacaaauggaagaacacuccaugcucauggguaggaagaaucaauaucgugaaaauggccauacugcccaagguaauuuauagauucaaugccauccccaucaagcuaccaaugacuuucuucacagaauuggaaaaaacuacuuuaaaguuuauauggaaccaaaaaagagcccgcauugccaagucaauccuaagccaaaagaacaaagcuggaggcaucgagcuacuugacuucaaacuauacuacaaggcuacaguaaccaaaacagcauguuacugguaccaaaacagagauguagaccaauggaacagaacagagcccucagaaauaaugccgcauaucuacaacuaucugaucuuugacaaaccugacaaaaagaagaaauggggaaaggauucccuauuuaauaaauggugcugggaaaacuggcuacccauauguagaaagcugaaacuggaucccuuccuuacaccuuauacaaaaauuaauucaagauggauuaaagacuuacauguuagaccuaaaaccauaaaaacccuacaagaaaaccuaggcaauaccauucaggacagaggcaugggcaaggacuucaugucuaaaauaccaaaagcaauggcaacaaaagccaaaauugacaaaugggaucuaauuaaacuaaagagcuuuugcacagcaaaagaaacuaccaucagagugaacaggcagccuacagaaugggagaaaauuuuugcaaccuacucaucugacaaagggcuaauauccagaaucuacaaugaacucaaacaaauuuacaagaaaaaaacaaccccaucaaaaagugggugaaggauaugaacagacauuucucaaaagaagauauuuaugcagccaaaaaaacaugaaaaaugcucaucaucacuggccaucagagaaaugcaaaucagaaccgcaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucagugugaugauuccucagggaucuagaacuagaaauaccauuugacccagccaucccauuacuggguauguacccaaaggauuguaaaucaugcugcuauaaagacacaugcacacguauguuuauuguggcacuauucacaauagcaaagacuuggaaccaacccaaauguccaacaaugauagacuggauuaagaaaauguggcacguauacaccauauacuaugcagccauaaaaaaggaugaguucauguccuuuguagggacauggaugaagcuggaaaccaucauucucagcaaacuaucgcaaggacaaaaaaccaaacacugcauguucucacucauaggugggaauugaacaaugagaacacauggacacaggaagaggaacaucacacaccagggacuguugugggguggggggaggggggauagcauuaggagauauaccuaaugcuaaaugacgaguuaaugggugcagcaaaccaacauggcacauguauacauauguaacaaaccugcacguugugcacauguacccuaaaacuuaaaguauaauaauaauaagaaaauaaauaaaauaaaaaaaauuuacaugugaucuuacuccuuugagagguuuaguuaacucuguugcugugaaaucacuaauguucucaugucugaauggaaacaucuagugacaacagugcuuuuagaaguaaauaauaugucuauuuucaugcagcuuugaauuccuggguucuuuguauacguuugauucagugaacuaugaaaaaaugagcaaaccuuaagacaccaugaaguauuuucaauaaaagcaguuugagacaagguuuucagguuggcggauuaaaggaaucaaacuguuccuucacccagcaccgugaacaacacccguacuacauuuuucuuguuuugaguuuaucucuccugaagauaugcuguuuggaaguauuuuuuuauuauuaaaauauugcacgacuuguuugaaaauuuauuuuugcugguuauuuuuuaugcagaaaauucuuucuuccuauaaggcccagaauauaaggcuagcuuaaugccuuguuguguugaucagauacuaauaucaguguagaugaucucguacucauuguugcauuagaucuauugucaugguagccacaccauauaggaagcaaaagaaaacuaguguuuuugucucuuucuuugaaggcaacuuccugguaaguaaugauuaaauuauaugacucucaaaguacaaaaauaacacaauuccuuagauauuacuccacauuuguguagcaccaacaugcagguaguuagccaugauaauggauauuauguucaugaaaaaucggugcucaaaaguagcuuuuagaagggaaacaaaaccuuguauauuaguaagauuuaucucuaucucagcggugaaugauacagggucuguaaucaaaauguuuuucuuaguauaauuugacuacuagcucuauagguaauaccuuucacagagaagcauggaugcccaucuccucuccuuugugcacaauccugaggguuagucuuguccuuccucugcccuuggcaucaagggaccuccaggaaccugagaguguguaucuuugggcuguaucuacugucaucugcuuccaccugugugagggaucccugguucgcugggagauacuuuccugccagcauuuuuauccaccguugaugaaucacccucucucaucugccacaucugguagggcuuugagugucacaaccucaugcuuuuaauuauuuauuuuuuuaguagaagauacaguuuucuuacuguugaagaaagcauaguucaaccucuuuuuugaaaguuggguuucaguguuuuccuguuuaaagucaauauaucaaagaaggcuaagaggugagccacucacuuuuuuuuuuuuuugacuuaguuguguguaguguuugaauugcagggauuuauacaggcuacugaauugaaaagagcuuugauugugauaccucagugaaaacgauuacauguauguuuguguauuuguuuccuguuuccaagaacaacuuguagcuuuuuaaaaaugagcuuccuuuuuaucaugacauguugagguuagauaaaucuuuaaauguccugcaaucuaacucccuagcugauuuucgaaucucuucuuaucccuauugagagcucuucugguguauuccugaacacuuccagacuuagguagcugauucuuaaacuaugcugauugcuaucaaguacuuuuuuuuuucaugucauucuguaacguuuuauccccugguuucaauuuuugcacuuaaagcaacucacucauggagacugagcauuaggcuacuucauucaguuaucagcaccuccuggaaauugguuccugacauugcuauugucccaaagauaacagccaaaguucuguucguauguguuuaccuagaauauaaaauaagaauacagaucauuuuccaagaguggaaaauuauaaaaagaacuuuucuaaggcaugaaaaauacuauauuuuaagcacauaagaagcuauuuauaguuucuuccugccaguguccagugcuauuaaacagcaggagauuuuuauagucugaaaagggauauuuugagucuauaagaacuuuuugcaaggugauagcaaucucagguugaauucugccagauuuugcugucucaauaugauuuacaaaugaauugaaguuaauacugucuguuaagagagaaguuaauaccuacccauuauuaaauauaaaaccaauguguuaaauauaauuuaguuuuauuucuaaaauuucauugaaauauaauguuuuagcauucugguuagaauugaaaugcaguaacacaaauauguuuuuaguaucuucuuuacagaaaauauuaguuuauucuaaaaauuaaauuugaugccaaaaauuaauuuguaucugguugcauugggaagaauaaugucaaaaaugcacuaacuuccuuugccuugauuuggggaaugauggugguguauaaaaaaugauuuagaaaccaucaguaugcaauaccacaauuuugugauuauuguuaucuuuuguuauucuuaacacaucuaucuuccaaaugcgauugaaaacagggcaugcuguuuaaacuggcucuuuggccauagucuuuguucaaaacaggucaccuuuugaugauuuuaccuaaaaacauuuuauaaauaacuguaguuauuuucuccuguguuaccuaugagccagcagaaacuuuucuucuguguuuauggauuuaaaagaguuuuuuguuuguuuuuuugguuuguaauuaugacauucagcuuauuacuucuuucauauguaauacaaauguuggccaaaaauugguauuuuuccaucgacuuugaagaacuguagaaaagaagucaaacacuuguaaaucguauguuuuggugauucuaagugauacuccuuggguuuccaaugaacuucagguacagagggcuguuguuaauugucuuucacauuuaugccauguuagaucauugaucugagcaaagccccaguauuguuuaauguuuucauuaucuuuaucuaucuccaguccccaucuuauuuucccugaccauauccuaaugaggcaaccaacccgauguguuuuacacgaucuuuuuauuauagguguucuuaaaaauuacaguuuguggacauguaauuuuauuuacuaaaaauaguguuaugcuauagaucucuacucaauacaauguuuaaaggucugucuguaaaccuguguacauuuuuauaucuaaccgugguagaguacccuauauugugucucuaacugcuucaucccccagggggagcuauguagauuccccguggcucuccacaaccacaagccauauuauaauguauauguauaaaucaggaugaauagagcccauuuauacauauacauauacauuggcuguauaggccaaugggcuuuauccauccugauuuauacaugugcguuauaauauggcuugugguuguguugcugguuuauugggccaguguguacuuaauuugaugaaguacuucaggaucguccuccagaagggcugcacugaucuccucuugagcaaagcaugauguucacuagaguguucaaaucucauauuuguuuuugggaugaacuaaaugacuuuuuuucccuaggcauaguuacucucuguauguuggguuugaaugggugauuucuuacaguagacaagaagguacuugucugaaaguuaaaggagaggagauaaugaagugagaaaaggaugagggaaaaagaaauacauugcuuaucagcuccuaaaacuaggccugacacaagguagagggucagucaauguuuguauaaugagugaauuaauagugugguaugguagauguuuuagauuuauagcuaaauauuuugacuuacauucugcuucugccacuggggggaaaucgugagaccacucugacccucaguuuaugaaacugaaaacugagauugauggaagggcuaauugaggugcaguaugugaagggacuggcauguauaauaggcauuuaacggguguuucauuccuuuggcaaaguauacuuucuauuacaugaccaguaauaaucaguuucuucugcaaauauucugucauaagucaauucugauuuuggccuuuuuaauggcugcuguaaggauuugugaacagucuguuauuuccuauuuugcuauucauggaagcauuaaguaagguuuuacuuaaaaaccacucagaguuaucauggcuucacuaacacaguugucugugcugcaacuacguaaauuuugaccuaauuuuuucccgaucaccuaaaaccuauaaaggacuauuuugaaaggucuuauauuguaaagccucauuuauacaggcuucugggaauggaguuuuacacauuaaguagguuuuccagguaacuuaaauuuauuccuugauauaacuuuuauauauccuugguauaucuuugauauauuccuugauauauucaugaccuauuucuugauauaaucuuuauauaucuuuaauacaacuuuuaaaaaaggugccauuuaaaaauccucuauaauauguuaaauacauuuuuuugauagaauguauuagauguaauuuuacuuuuuaauaugcaaaauuauugguuugccuguuuaaucagcaauaugauaggcuuugugacuguuuucuuguuauauagguuaucauauuugcccugagugaaccuguuguaucagcccagcucuuaacuaauuuguuccuuuuuaauguguuagagccagaauaagaaauaaccaaaauuaguagcauuuuauguuagucauggguuaguaaccuugaauaaagacuugaggucuucucuggccaaguguaagagacgcccugccuugaaaauagugcuuuugaagacucaacuuuguauccuagaugcuggccauguuccagguacuuaagaguaucaugaaucugaaaucuggaaaacaaagggcuuuauuucaauuuuuagcaaaauaacuucagaaauguagcuauuaauuugacacauacuuuguagaguuacagaguuugcaccaaauuccaccaucuacagaugaagacccagaaauuuaguaguggacacuuuuguccaggguccccuugggguguguugagcccuagaacccaggacucuggacuuucagcccauagcucuugucauucuccuuuacuaauagggacaguauugccuauagggcucuuauauguguaagcuguagauuauguauguggaauuauuaaauguaccgucuguaccuaaauauuucagaauauuuaaauaguaaagauuaaguaaaaagaagaauaaguaugucaaaacauuaaugaagauucugggacugagaauauguuuugaggucuucaguaccagauuugauugcuauaagacuuccucuccugacuuugguaagagccaaguggccuauaggggaagaaggggcuaucaaaccuacuagcuauagaauuuuccaggagguauguauuugcaaacuaaagcuucuaaaaugguaguuuagauuugguuuucaccuccagaauugucagcaaaaggauaaaaauuuuagcucaaaguuaacagggccuggaauccaggcaaaauaacacuaauaaucaacuuaaucacuaauaaucuacacauuuccaguguguguuauaguguccaaagugccuuauaugagcuaacucauuuuguucucacagcaaccggggagauaguuacuauuuguauuaguuuguucucacauggcuauaaagaaauuccugaaacuggguaaggguuuauggagaaaagagguuuaacuggcucuugguguugcaggcucuacaggaagcauggcuggggaggccucaggaaacuuacagucauagcggaaggugaggggaagcaggcaacgucuuacaugaccagaguaggaggaagagagagaagggggagguuccacacacuuuuaaacaaccagaucuuggauaacuugcucacugucacgaaaacagcacuaaagagugaauccucccucaugauccagucacuuuccacaaggcccuaccuucaacauuggggauuacaugagauuugggcagggacacagacucaaaccauauuacuauuauuauccccguuugcagaugaugaaacugaggcauggaggaguuagaucuugaauguuaaguuguacauauaguugauuucaucugcauucuggcucuggaucuccaccggcugucuaaagaggcacccccauauagcugcaagugcaaaggauauccagauuuucaccaggcuuucuccuuuuccuuagagagagaaugugggauuuuugugggugacacagauuuacauugguucuugggaagguccagcccuuuuuuaguuguguguugacacuuuauagaauggaucaucacauuaagaaggguuagauuuaaagucuagaguucucagacaagacaaaauaauuuauuuccuguuaaauuaacauaugccucauagaggcuaccagauuucaugaaauuucuuaccaagucucuucuagacaagccuuuuguuuuugccucaccacaacaauuucugcaaacaaaaggugguaucuuucuacacgguuauucuuugucauauuuaagcaacuuuugcagaggaaaaggcuuauggguggggauucauuaccacaugcugacccuggacccuguaggaugguaggaaaauaaaguagaagcaaagcagaauagggaugcaaaaaguaguaacuucagcugaaaagugaaauguagugggcuaagccuuugcucucaagguucaccaaguggagcugauguuucgcuaggcagaagaaaacuucaguuuaggagucuuucuccaggccuuguccaccuacucacacuacaggcugucauggaccuuaacguuccuagguucccacuguuugguuuuuacucuuucaagcauuucgucaguuauagcuugaaaucuguauuuccauauugagguaaacagaguaccuucauuuggauuuuaccuuuuagauugcagaucuagucuguuuauuuuucuggauguuugcucucugaaggguaaagcccgucaugcuuaaucaucauuugcauuuuuuucuuaacuucucugcuguucacaaaacaaucuaauucuuuaagcagguguguagucaugucccuugguuuuaucuaaguaaaaugagaaaaaucuuguuuuccaaucaaucauacuugcauuuugacaugaaacagcagguauuugucaaaauuaauuguuagauaaaccuguauaagugaaaaagagugggauggcugaaaucauuuuuaaaaauggaaaaaggugcucagaggaucugaaaaauguuggauuggauuguaccuuaccuugcaauaaaaggagauucacaucuauuuaaggacucuugcuuuucaacauucacauagugagauauaaaugcagggcuauuuuuuuuaacuauaagaaaguauauuuaaaauuugaccauugauaaaacuaugacaucccauaugauaaguugcagucagaugcuugcaugguaggugauaugguuuggaucuguggccccaccgaaugucaugucgaauuguaauccccagugguggagguggggccuggugggaggugauuggagcaugggggcagacuucucaugcauggguuagcacuguaucccccuggguacuguccucacaauagugaguugaguucuaaugaaaucugguuguuuauaaguaugcagcaccaccccccuugcauccucuuccuccugcucuggccaugugaaaugccggccucccaccuucaccuuccacugugauuguaaguuuuuugaggccuucccagaagcugagcagaugccaccaugcuuccuguauagccuacagaacugugaaccaauuaaaccacuuuucuuuauaaauuacucaggcucagguauuucuuuauagcaaugcgagaaaguacuaauacaguaggauuuauuguauggcuuuuuccugcgugcuucauuuaaaaauguacuuuucuuaaugagauuuugucugaauguccacuguuguguauuuuuaagccguagucuaauacuuuuguuuggucucacugauauaaaaaugcaaacuugccuuuuaaguuuauaggugucuuuaagcuuuccugggucuuuuauuuccugauagacuuuauuuuagcccguaaauuuauaggcugguauucaauggugauuauagagcacagaucugcagaccaaugauccugugcagccugcuugggcuucccucauuucuaggucugucucucaguggagguaaggguuuaaugaaaugaagaagagacaaagaguuuuucuccuuuauaaauaaauugccuaguucacuuuuuuuuuugagacggagucucgcucuguuucccaggcuggagugcaguggcgcaaucucggcucacugcaagccccaccucccagguucacgccauucuccugccucagccucccgaguagcugggacuacaggcauccaccaccacgcccagcuaauuuuuuguauuuuuaguagagacgggguuucaccguguuagccaggauggucuugaucugaccucgugauccgcccaccuuggccuccugaagugcugggauuacaggcgugagccacuguguccggccgccuaguuuacuuuuuaucacuuuacuaacaggucuuagaaaaggcuaggcugggcgugguggcucucaccuguaaucccagaacuuugggaggcagaggcgagcggaucaccugaggucaggaguuugagaccagccuggccaacauggggaaaccccaucucuacuaacaauacaaaaauuagccgggcgugguggcucacaccuguagucgcagcuacccaggaggcugaggcaggagaaucgcuugaaccugggaagcagaggcugcagugaaccaagaucaugccacugcacuccagccuggacugagacugagacucugucuccaaaaaaaaaaaaaaaaagaaagaaaaagaagaaagaaaaggaaggggcuuaguaaagcccccugcuuuucaaauaucaccuaaugaagcuaaacauagcaugcauugagguaccuacuaaguuccaggugcugaaauaggcauuuuguauuugaguaguaaagaccuugucuuauuucugagaagucaucaacaacauaagacuuguaacaaacgcaccuuauaacucuaugaauaauuuucucaauuuuucucucugagaucgcuggcaaaguuuuguccaaaaccaaggauucauuaaaauggcagcuugucaugaugaagcaaugaauaucccaaguuacuuguucauccucaguagugaaguuagagaccuguugucaccaaaccaucauaugaaaagaagauagcaauagauguuuauauuaguuucuuuuucauugucagaaaucuuuguacuuuugagacauagaagaauagcuguuaaaucaaaagcaguuuuuuuguaaagagauaauguuuuuggaaaagugacugcucauuauaaaaugucaagucgauacaaaaagaauacaaagaaaaagugaaaaacagauucguauucagaaguaaccauuauuaauauuguuaaacuuaauucagagaacucuguauguauacugauagaaggcuugauaguguacacauaugagauuauucuauaaugauauuuuaaauauaaaugauuaaauuuaacaaaauuugaauacaauauuaaauuuauuuuucagggggagauuauuuguauuuucuuuuuucuuuuuuuucuuuuggagauggagucucgcucugucacccaggcuggagugcaguggcuugaucuuggcucacugcaaccucugccuccugaguucuagcgauucuccugccucagccucucgaguagcugcgacuacaggcaugcgccaucacgcccagcuaauuuuuguauuuuuaguggagaugggauuucaccauguugguuaggcacgucucaaacuccugaccucaggugauccgccggccuuggccucccaaagugcugggauuacaggugugagccacugcgcccagccuguauuuucuuuaccucuguauuuuugacauuguaaugaacuuguauuauuuucauaguuaaaauuauauaacaaaaaauaaacuaugguaauaaguuuuauguaaugaagacaaguaucaguaguggcugugugacacaugagugauuccuucucuccuccugagcccguggcuuugacauuagcuaauaguuguaggagucuuuccuuuggaucccagacuugagcucagaaucuuuaucaacauaguuuuguagauugucagacccaauugacugcaguuagucuugaauugagacucauuuccuagacuuggucucuuuauuuaguuccuuccuaguuuuugcuuucuaauuaugcaucauaguuaugaagugcauauacugugcaugaaaucacauuaggaggaauuauacguggaggaacucauggucugugauucuaauuaugagcaccuucuuuuggggcuuaauaaauauuaaauuuaaaagaaaaacaaaugaaaugaaaggaauuggugaagaucagacaaauacuguauuucuuuauaacaaaacauauuacuugcuaaaaaaauccuacuaaaguugugaagaacuuuguauggagucguuuaaaaagaaaugccucagauuguauauuuaagaagagaagaaauuuauauacuaagacuucuuucacuucauucucaccuguuauaauguucuuuuuacauugccaagauuuauuaaauuuguguuuuguuuaguaaccacaauaaauaccaauucuuuacuuaaaauaacugggcccaucaugggucuuuuuagcaugguuucuccauacuuccuggauuauuuguguuuggcuugacuggaauuaauuaaaaagcagauugucugagaaagacuuuugaguguuguauuucaugaguucuucaacaguugggaaguguuugaagaauaacuuggcuggacaugaaauuuugaaucauacuuucccugggacuuuauagaaauggcucagcuuaagcuggagauuugcucagugagugugaggccaccuaguuuuuccuuuuagagagcucgcuuuuucagccuuagauggucauaugauuuuucuuuaucaguaacuuccagguguacuaacacuauuuauguucauuguuuuaccaguuuuuccaggaacaugguauaguuuuuugagcugcaaauucaagucuuucuuugauuuuaggaaaguucuguucuguuauauuuuuaccuauuuuuuucucuuccauguguuuuauuuaggaguaccuaccaacaagauguaucuuuuaucuuuuuugucuaucaucucuauaccauuuuaucauugauuccugacuguauuuucguuguuuuuccuuuuucuaauuuggguugcacccuuguacuauuuauuuuuuauuucauuuuuuucucuccugagcuuugccagcugccuuuucauguucuuuuaugaugucucuuugaaguccuuuuacaaaagagguucuuucuauaauuucuuugagaucagaguauuugaacauuuccucuguuuucuuaugaugcauauccuucaucuccccugcgguuugcuacuuuccuucuuucuuuucuuccugguuaucuguguucuuuucuuucucauuaugauucuuccaugcauggggacagcuauuugcugaagcagaguguggggaggagagccaguggggacagggagggaagagugagccaggguuccacagcuuguuuggaguuuguuguuuugaucacucuucaccagucuguuguucucugccuuggaggggugcaucccucccuaggggcauaaucaggacaguggagcucauagcagaaccuccuuggagcucuguguggcaagcaggcguuugaacuuucacauuucuucacuucaccccuagaagguccucugaccuguugaaauucuggggaugcauguguuggcuuagacuucucaguauuuagcuuuguaguuuuuagcagcuugaaauuggacuaauuucuuucuguagggaauguguaguaauuuuuuauuccucuuuuuuuauuccuuuguugcuauuuaugaggaacuuaucugugcaaggaauccaaauaaggaaaaauuaaugauagucuaagacagaaaaugagagggaaggaaacauuuucauucccuggaaguauuuugauuguuacauauuucccuagguauguuacagugucaguggccuuggaugacaagguaacgaaugagguucuguuaacuaggaacauucacugagguauucaacacuaggugcagaugacugggauuuggaauauuuagaagguaauuucaaugacauauguggugaaauguagguaacuguaggaaaugguguaaugcuuagaauucacauaaaagagauaaagagaacugauagccacaugcuuauuucaugagauuauggguuuaaaaauuagaauuacuuucaauuuucuaaacaagcugcuuaauagccucuuaaaggacgaacaaauucaaauucuucucuaguuaagaauuguaagaaugaucaggcaugagacacagaaaaaaggaaaaaagccucauuaugcuauuacuucacucaucauuucugauuuuaaauugcaguuuaguguggguauuuaaauugcuagcuauuucaaaaauguccucugguuuuagauacuauaaucagcugaaaaggcuauugagugccguuacauggccucaagaucuaaaaacuuuuguauaaaaauagaacaauuuauaauacugaucugacccucugagcaugcaugugaagacauuccuagaauaacccuuuuuagaauuauuggauguucuaaauagucuaacaauguaacguauugucuuugaugaaaaaauagaaacucugaaaaagacuuuuuuuuugagcaaaaagcaucuggaagugccuugaacuauauaaaaugagugcacagauauaccuaguuuuauguucuucacuuaauugugcuuugcagauauugugcuucuaacaaguugaagguuuuugggagccgugcauugagcaagucuauuggcaccauuuuuccaacagcgcaugcucacuucucugucugugucauauuuugguaauucucgcaguauuucagacuuuuucauuauuauuuaaauuauuaugaucugugaucagugauguuugauguuacuauuaugguuguuuuggggguaccacagacuguacccauagaauccagugaacuuuauggauaaauguguauguccuggcuucuccacugacuggccauuccccuucucucucccucucuggccuccuuauuccaugaaacacaacaauuuugaaauuaggucaauuaacaaccuuauaccggccucuauguguuuaagugaaaggaagagucacaugucucucacuugaaauuaaaagguaggaauuacuaagcauaguuucaaggcauguugaaagcugagacagguugaaacugaggccucuugagucaguuagcaaaguugugaaugcaaaggaaaaguuucugaaggaaauuaaaugugcuauuccagugaacacaggaaugauaagaaagugaaacagccuuguugcugauauggagaaaguuuuaauguucuggauagaagaucaaaccagccaaaacauuccauucagugaaagcugaauccagagcauaucuccccucaauuuuaugaagacagagagagaugaaaaagcugcagaagaaaaguuugaagcuagcagaauuugguucaugagauuuaaggaaagaagcuguuuccauaacauaaaagugcaagguaaagcagcaagugcuaauguagaagcugaagcaaguuauccagaacaucuagcuaagauaauuaauaaaaguggcuacacuaaacaacagauuuucaauguagaugaaacagccuuccuauuggaagaagacuccaucuaggacuuuccuaacuagagaggagaacucaaaaccuggcuucgacgcugcaaagaacaggcugacucuuguuuggugauaaugcagcuugugacuuuagguugaagccagugcucauuuagcauucugaaaauccuagagcccuuaagaauuaugcgaaaucuguucugccugugcuccauaaauggaacaacaaagccugggugacagcacaucuguuuacaauaugguuuacugaauauuuuaagcacacuguugagaccuauggcacaggacaaaaaaagauuccuuuuuaaaauauuacugcucauugacaaugcaccuggccaccaaagagugcugauggagauguacgagguuaauguuguuuuuaugccugauaacacaacauccauucugaagcccaugaaucaaggaguaauuucaacuuucaagucuuauuauuucagaaauacauuuuguauuacauuuuguaaagugauaguugccauagaucgugauuacucuauugggucugggcaaaguaaauagaaaaccuucuggaaaggauuaaccauucuggauuccauuaagaacauuccuaauuaauggaaggaggugaaaauauaaacauuuacaggaguuuggaauaaguugauuucaaccgucauggaugacuuugagggguucaagaguucaguggaggaagucacugcagacgugguagaaagacaguaagagaggaacaacuagaaguggagcccgaagaugugacugaacugcugcaaucucaugauaagacuugaauggaugaagaguuacuuaagugguuucaugagauggaaucuacugcuggugaaguugcugugaacauuguugaaaugacagcaaaggauuuagaauauuacauaaacuugguugggcagaguuugagaggauugacuccaauuuugaaagaaguucugcugcggguaaaaugcugucacacagcaucacaugcuacagagaaaucuuucaugaagagucaaucaaugagacaaacuucauuguugucuuauuucaauaaauuggcacagccacucuagccuucagcaaccacugaucacucaguucagcagccaucaacaucaagacaagacccucuaccagcaaaaugauuacaacuugcugaagggcucaggugaucauuagcguuuuuuagcaauaaaguauuuuuagauauaaugcuauuacaugcauaauagacuagaguacaguauaguguaaaccuaccuuuuauguacacuggggaaccaaaaaauuguguaacuugcuuuauugugauacuugcuuuauugugguagucuggaacagauccugcaguauccccaagguaugccuguaucucaguauagucgugaucauaggucuugcuuuucuuuagauucacuguugguguuaucauccaugaauuucaccuuccuguguacaaacaucucuuauuacaguaggagaauaugggagucagaaaaggaagacauuuauugucauuaugaacucagaaauauguuuucuagugaucauugaaacaacugagauugauauuuuccagccacggcaguuuuggugauugaaagcaagaucuguuuuuuaaaaauuaaauauaaguuugcacauucuuccagggaagggcacgggauaauuucccuugccauuuuauuuugaaaccagcuuuguugugguggcacgcuccaugagauuugcuccaugagauuugcuccauguugcaccacacacagucuuugcuccuguguccuuccauagaaaaaaacaguguggggaaggauuugguuugucuuacccuuuaaucuucugcuccuacagcucucuggucugauaguucacuauuuugguaauaaagucagauauaguucaaauccugucuggucuauuauuucgugaaauuuuugaacuuuuccaugcuuuggcauccuccaagaacuuuuuccuuucuaaguuuuacuguuuuaauauaaauggacuccuaugugaacacuuuuagacuggagucuaaaaguggccuaauaggcuugcuauuuuuagagaaggagaaaguugccuuuuguucucucugugcuuuucaccucccacauguucuuuagaguuuuuuuuccuguucuggucuuaguagugacagcuuucuaauuccagaggcuuuuuccugggucuguuucuggcucauuuugucucauacucaaaauuuuuaaugucagaauugggcugggcucuucucuuucuauuaucuguaaacauuuuggguuucuuuuccucuaauuuaugaaaauuaugaaauguacacauaaaggaguggaaaauauauucacccaguuuaaagaagaguaauaaaauggacauucguauauacccaccauccagguugagaaauagaacauugcuugugucucagaagcucucuguguuccucucagucacguucccccaccccaacuccuacccaagguaaccucucauccugaagcuuacauggaagauuugggcauuuuuauuaaaaaaaaaaaaaagaaagaaaaagccaaguagugauaaaaaauaguaacaauagaauuuucaggaaaaaaauaaagauaauguaaaugcguuuuuuuucuaacauuccacaaaagaauaauuuguuuaggauugaggagagaauuaaugcuugucuuagucugcucaggcugcuauagcaaaauuucaucaacugggaagcuuaaacaacauuuauuucucacaguuuuggaggcuaggaagucuaagaucaaggcaccucaagauuuaguggcuggcagagacccucuuccuggcuuauagacaagccaccuucuugcugugucuucauaugguagagagagagagggagagacaaaguucuuuggucucuucuuaaaaaagagaggacuucaccccuuugcccucaucuaaaccuaauuaccuccuaaaagccccaucuccuaguaccaucacauuggggguuagggccucaauauaugaauuuugggagggcacagacguucacucuugaaggauuucagcuauucgugcugugucacugaaauuagaacuaguguaaaaagaaaaguucacguacauauaaugcaaauauucagugagcuggcacccaaccuacccuuguuugauaaggaauaauuggaaauuuucuauuuuggccuagcaguuugagggcagacaacuucuucugaccucauuuccuccugaucauuguggacauacaccagcagcauuuccuugucuuacaauaguaagcuugcuaaaauaauaauaaauaaauaaauaaaaauaaaauaauaguaagcuugcuaaaauaaaaaaacacgcucguacacacaacacauacaccuaaacacacguaugcacuuucuuuguaaagcucuguuugaaauauacuaaagaggacuguuccugaaguaaucuugcagucaugucugcucucauccuuuguucuuucagccucacauucccagucuucaugggcugacugccugggauugacuuuugccuucacagauacuuaucugcaaaagauagagacagaaaguagcccgagucucaaaguuuucuugcugccacugccgugugcuaccucagaccccucauugcuuaccugggggcuaagcccugccucuaggacccucagguuccuguggauuccugucuugaguauggugugccaucuuguuuuuuucugagcugcuugacuuguugacucuucaucaacaaauguuagaaugccuacucuguguaggcagcuauaccaagaacuguggaugcaauguggugccuguccuuuuuaugggaugguuauuuuggagagucuuguuugcuuuucuaguguccacaggcugguaugaucucuagccuuuauaggcauuucucuugacccagaauuuugacucugcuagaccacaagcuucuggauuuuuccuggaguggccacuucauuuuucuaccccugucaugaguuaccaaccuugguguggcuuuccuggaugugaaucaguucauuuaggacuuuucucauaucuucucuaguccuaaccauucugguuccuggaacugauacugauaguaaauucgccauaauggaccauauacaguuaaugcuagcauuucuaccaggguucuaaaaaugucugguuuuaagauuaaauuaaaaauagucccucugaaagaccuaaauagaauaguuucucucuuuuucugugucagucucuuugggauuuggcugcuucuggaaucuuacaaagguuuugcuuuugauccaaacacugcaaggcacuuugugaaugugaguaagauagucuacaugggcugaaaauuuaagaccauuuaaugaaaguugucuggcugcaggaaaaaugcucauuuuuacaaauugucuuaaaguucugauuuauagaucuguucugcauuuuucuacuaccacuggauuuuauuacuggcacauuauauuuaauuaggauagaaggaaugugugugcucauaauuauuuaaaaugauuucaggacauauauuuagagaaucgaguguaaauacuuaauaauaguuaaaagauaaaaauucaguuuuaguauuaugcaaaaugucuagacucuauaauuagccuggaguagauuaaauuaugcaccucuaaucacuauuuuauacaugucuuucaaagugacaucaauugucaucaaauuugcuuauuauaagauuuugcuggaugaguacuuauauuuucaguauauuuauuuuuuagugucuuugugauuaaaaacauguuagcaugacucucagguuuuuaaaauuuguuuuaauuacaauuaagugaugguuuucuaauuguguugucugauuuucagcagaccacuuaaauaguuugguguuaaugcaacuguggcuuuagcagaucuugaucauuagcucucagaugaauuucuauguaaaggaauuuuguuaucaaucuaaucuguagaaagaguguaucacuuuacaucuugguaauugggguacagucuuuuuguugagguacauagaaauauguagaauuagaagaaaauuucagcagcucuuuacagcauauaggcaauacgaauagaacuguucuuucagcaccuucugaaaaagaugggccugaagucaucccaguaugcaauagcugauuauuugacaaagcauguaucaaauagaugaaaauaucaaauagacguguguguuaauaguccucaacuuccaguuuagccuagguguauauuuaagguaggagaugaugacaaucauacucauauucacucuuuuagacuuagaaguuuucuuggagacccuauaauucaacauucuugguuuuuguaagggagaagacuaguuggacaauguuaguuacuucucugagaucucagagauggucagcuccugggugccuguuuaguucaggcauuccccugugacaggauaugacagcacagugaaaaagggccgguuagcacgcucauaaacaacacugaaucugaaaguccacaccaguuggaagaauuauccuuuccaaagaagcuacaaaugacugauaguuuuuccaauauauucuguaauuuucagagguaucuuagcuuguuauuauuuuaaaauuguacauaauuuagaagaaugaaaauucuguuuguuagagaaauuaguugugauuuagguaagcaaagcacaaucaugacuuuuuuuuaaacaaucgaagucccagugaacaauuuuugugaugcuaugaaaugugcucagaaggugggcuuauuugaaggucauuuuucuaaaugauaacuuaaaaaaauaguugccacuuuguaugauaguaguuuuguacccacaugaagaaagcauuaaaaauucucuguucucuuucucuucuugguagguuguguucuuaucuaccauacugguuugagauuacuguagaaguauguuucuaauugcuacauugugacaauuacuuaaacauaucuacuauuuaagaagaaccagccuggcaagguggcuauuucuucuaauaccagcacuuugggaagccaagaagggaggauugcuugagcccaggaguuggagaccagccuggggaagauagugagacuccaucucuacaaaaaaauaaaaaagauaagccacucaugguggcacaugccugugguucccagcuacuugggaggccaaggugggagaauugcuugaaccugggagguugaggcugcugugggucgugauauuucuaccaccuucuagccuggguaacagagcaagagccugccucaaaaaaauaaaaaauaaaaaggagcaagauuaucaucucuaaagauuccuguguuauauguaugaaggguaccaugauugcacagaauauuguuuucuguauaguacagagaaaucaagggugacaacuucaaaugccuuuuacuuuacaggguugugcagacaugcccucagucugucucuuggggauuugcucuacagaggccccugucucaguucagccaguagauauauuccaggcucagguugugguggugcaggagaaaucaagaguugggcuucuccuagguaggacaaaaagagaggaagagagcacacaaaagacaauaguaguaguucuacaaaaaucuuacucuuccuuuauuaaaacaguguaaaauuacaaaguacacauuagcauuugcauaauaaauuuuaggacaaacaucuauaacuuacagugaaagaauuuaaagaaauggcaacauuuaguuaaaaaccuuuaucuuuguuaaucauuucuuuaauucucuucuucuuauuuuuuucucucacucaguaucuucggccguuaauugaaugaguggaggacaguuaaagccacagguuuucauauguggagaggcugcuccuuaaugucuuugcuggucucuugccguucucuccugcugcuaacauuaauuacuuugcugauggcucuaauugacccaguaaaagaaucuuaucuguguucagcccuucccagguccugaagucuuugcagcuucugcuugcuuucagccuuuauaaauagccuuccaaguucugaguucugguucuagaguucccuuuccuuugaaaguccuaccccuugcuuaagccuguggaucacuguuucuaaacccaccuuuucaacacuauugccccauaucacugaugccccagcucaacuggacuuuuagcuuuucccugaauaggccucuuugccuuuuccuguuucauggauuuguacacaguggucccugucuauaggaucuucucuuuccugcccauauuucccuguccaaauuguaucguagagacugccuaagcccugcuucuucacuaaaggguucccugaucauauuaauugaaauuaauuuucuccuugagggcugcuugaugcuuuguuuguuauuuaugguaguaggcuaacugcugccuuggcuuauuuuagcaaugagauuauaaucaccuugacggugagaggcauuuuguuucucuuuuugucuuuaccuacucccaccagcugauauucagggaacaucugucucauugaguuuaggggauguagggaaagccuggucagcugcugcucccugcaugguagguggugguauugugaaugucugugguuccugguguuuccuggacucgaaauuaguccuuaauuaaauaauuccuuuauuaaaggaacuaugcuucuuuuccuuuaaaaauauagcuuguauugugguuucgucuuaaaauggcaguauacauucauuguaaaaauuuuggguaauacaguuaagcaaaagaaagaaaauaaaaacucuugaaaguucugcaggaaacaguagcucacugcuacauuugguauacaccuuuucagacauuuuucuauaugugaauguauguauauaaacauacuucuaaaaaguugccaagcauaguauucuuuuauuuuucuuuucacugaaugauguugugaacaucuuucuaagugugaaagccuugaaagcugcucucaccuacaucaugcauguauuguuuuuugucuagucauuuccucaggaaacccuuaugaguggaacuuguggauuauagggugaacaugcuuucagggcuuuugauaccuauugccaaauugcccucugcaugccaguuuuccuacauccuugccagcaguggcuacugucauucauuuuuauuuucuaaagugaugggggaaaacgaucucuuucauuauuuuaauucacagguauuuuauugcuagugcagcuguagguugguguaugauugaucaccaugaauauuucuuguuuucuuuuuuucaugaguugcauguuguauacauaauucuucauguuuauuuaaauccaaguuuauucauagguuauauauauguauguaaauauauauguauguauauucauauauauauaucucuguguacauuauacauauauaaauaaauucaacuauauuuguacacauauaaaauuuguuguuguuaguagaaacuuuucccccuagauuauuuuuagauguuuuuuguugguuguacaucuagaaauguguuuuguuuuugcauauuuaucuuguaaccagucaccuuacuuaacuguuauuauuucugauaguuuuucuguugguuucuuuuuuauucuuuuggcuauuuuauauauaccuaggaagaauagaacaccauauaaacagaugugcaguuuuucuguauagaaugaaaaaugaaaaaaguaaagaaaaaaguaaaaaaaugaaaagaguucuuuuccuagaauguggcaaaaacuggacuuggaagagaguaguuucuucuguacaagguuaccagaaggcaaagcugaucauggauccucuucuguucucugcaauuucucuaugugugaugcuugcuuuauaguuauguuaauaaauauuggauguaucagaaaagaagcuggauuagcaauagucaccaacuacauucauuauuagcuuugaaauuuguucaucauagcauuucagugauguguaacuaugugcagaagauaggccuuuuuuauuuggauccaguuuuccuuguguuuaauuuuuuuuuuuuugguuuuaugacauacggggguaaaacuagauugugaaaguaaccaugauucugucauaaaggaaucucaaaauuacuggaaacuuggagagacacugguagccacaacuagaaauguguuauccacuucauauggucgagcuuuaaguuaaggggaagaaacgaaacaucuuucaucuuuuauuuaaagauuuuucuucugauaccacccuccucagaagggaacucucacuggcuuuuaggcugaucaagccagcugagugaggguucucagcuuuuauaucaccucaagucuccuaacucuuuguuucuccacucuacaauuagcuugcaggccugccuauguuuccuguccucauuauacuaggguuuucuaaacuuuauuauggcuaaugggaccauuaccugagaugcaggaguaccuacacauuuacauuuccacugcaaucucucauaugguuuaggagaucauuaaauuucucuuguuacccccaaagaaaaaccucuauaaccuauucaugcuaggaacauucucugccugcaguucuguuccuaugaaaugugcccacacuuaccagcccuugccgggcaugccaucuuugucugacuuaacgcaaagccucuaugcaaccuauaauuauuuucacccacuuaauauaucauugcuacaugcuuaaaucccagccucuccauguccucgaucuuuuaacguagcuuaaaauucuuacuguauuguuuacacucaaaggaguguauauuuuuuagcugaaacaacuuuugguaugaaaacuauuuuaggugguaugagucuauuuuuuuuuuaaaacuuuagaaaaguaaugguugaaaaauuguuauacuuuuaaagucuucuguuacaaaaagaaaagaaauauaagagcaagcauaauuguaggauacaagcuuauguuuauaugaauguauugaguuuaaauuuugugucugcauuaccacuuacaguaauuaucuagugaauuuaaaauaucuuauguguauaaaaggacaaaacagagaagcuucuaauggaaagagggagcgggcacgaugcuucacuguggcuucauggagccuugggcauaacaaugucacuacgcucgaggcuccaugaaguugagagucuccgcagugacagcauugguugucauuaaaugaaugaaauguguaccuggaaggaaggggugguaggagacuucuuggaugaaugucagcgcucauuuaggugugauuagggcucccaguacugagaacuuaaguacuuucaagcagcagauaaucagaugacugacuuugcaugagaaauaugggcauuugugguacuccuuuucuagauaucauuuaauuuuucuacuguuuguuuaacuucuguuccagucccaauuugaacacauauggaaguaacuuacauguuuuacuacugagaauugaauuaggguauuugugcuacuguuuacuuaggaacaaagauguauggcaaggugcauggcuagucaccaccugacaaguucagugucuugcagugaaugugaucucauagcuuccugacuuccacaacuuacacugcugacuccucuugcccagauccaccuacugauguuaugcacugagagagccuaaggcaccuacucaaggcuuuccuaaaacaguggcuguauuaguccauuuucacucugcuaauaaagacauucccaagacuggguaauuuauaaagaaaaagagguuuaauggacucacaguuccaccuggcuagggaggccccacaaucaugguggaaggugaaggguaugucuuacaugguggcagacaagagagaaugcgagucaagugaaagggguuuccccuuauaaaacaucagaucucgugagacuuacucacuaccaugagaacaguaucagggaaacugccucccaugaaucagugaucucccacugggucccucccacaacacgugggaauuaugggagcuacaauucaagaugagauuugggugaggacacagccaaacuguaucaguggccaugugaaguaugaugacagaacccaaaagcaacuggaggagaggacauacucacagacuguuugcuuacuagaaucucagcuuuugaguauuuuccaccuuguagaccaaccugaccuuccauguagaacucgauguguauaccuuaaauuuggccuuuagguagggugaccauaugccccaguuuucccaggauagcccuuccugguuuauguaugucuguuguccuggcacaauuauuaauaugccucuuuucauuuccacaaaugcccuaguuuggaugauaaauuauauggccauccaguuguuaggccuuggugcuugcuacuauucaucuagacuuuuuuuuaccuaguucugcuggugaagaaaugcugugugggccucuagguuccuucagacaagcuuguucucagcaacucacucaauuuccuaguuagaaauaaacugagugcuuaauacaaaauuucagagaauacagauuuuaaaacuagaaaggacuuccagagacugguaguucaaccacuuuuuacaaugaaguaaaugauuuuaagucauguagaaaaaaugauuuccuuugugguccaauguauaucuuuucuaguagccuuccucauagcccaaggcccaguuagccacgucgucuuguucugaacaauuguuuucuuugaucagccugcccuuaaacuuuucugaccagaauuacuccaaagagaagcauauuuuuguuuguuuguuuguuuguuuuguuuuauucugagacagagucuugcucugucgcucaggcuggaaugcaguggugugaucucggcucacugcaaccucugccucacagguucaagcaauucuccugccucagccuccugaguagcugggauuacagacgcucaccaccacaccuggcuaauuuuuguauuuuuaguacagaugggguuucagcauguuggccaggcuggucucaaacuccugacccugugauccgccugccucagucucccaaaaugcugagauuauaggcaugagccaccgcgucuggcugguucuuuguuuaaaguaagggguucaaguuauuuuccaaaaaaacuggaucuacucuucuugguuaauagcuuuccuagauacuagggaaucuugguaccuaacuuuuccaauuauuagaauccuuggcuucuccauauggaacuuccuuguaauggaagauauaaacuuuugggaguuuugaccacauggcuguuuaugugucuacuuacauuagaaacaugaaucucauauucaaggauuccaacaaauacacacacacacacacacacacacacacacacacacacagacacacacagacacacgucuauacacauacauauaaaacuuuccugagguaaaucucuuuuugugaauuuccaauuccuaaauauaauagcagcucugcuuguauaguugcugaugauugugaaauucuuugaacauagauuucuaaaagauauuugugauaaauccugaaauuaggacaguuuagacaauguuucagugacaaacaugaaaucugagacuucagcacuguaaaauguuaucucuuccccacacugcgauauagugcaaguugaguagcucuuuuagacaguucuucuccaaaucaugaugaaagggucuaggcugcauucauauuucuguuaugccaucuggagcauguggcuuccaggguugccauggaagagagggcuuagauaauccugcagggauuuuaguggucacacuagaggggcagacaucacuuccuucaugucucauuagccaugauccauugucuuggcccuaaccuaacugcagcagaaccugcaaaauguggucuuaucaggaugccaggaaggggaaaaugaaauagcauuugguggacacacagcauuauuucugccacaguucccuucauugaccugauucuuggcucauuugucauguuucaauaguuuuauauucuccugcucuuacauguucuucauauuuugaguaaaaucauauuuagucucauucuagaguuccuagaguuuucaccacuuuaguggugcagauucaccaugaagggcagagugaguggguucaagaguuuccuuguucuaguucuuccacuuucuuucacuggcuugaacuuccauccuacguuuauucauuuacuuauaaaggucacuccucuuucaacagauaaccugcaugagaagcaugggaguagccagagaauacagcuuuucuguagcuucagugauugaaaaaagauguuuauuuuagaauuuaggauguucagaguuugcccacaaguuguuagcaucuucagaaccaaacauccaauuggcugaucaacaaaguaaaaugccaguuuauauuuggguccgcaauugcuaaauagaugaguauuagcauuucagaacauucuguuuccaacaggaaauuguauuaggacuacagaaagcagagguggaggaaaggacaacucaucuucaggcauguggagacauagauuaccgguuccuuccuggcuggguggggcuggagacaccacugcacaaucaacuauucccuucucccuuuuuaguguuucuuguccaucaucaaaaauuacauuucacuauuauuucaagacuuuuauaauuaauuagguuacauuucaguugauguaauucacucucaaggagauuacaaaauaauauuuuugagugaggugaucaaucuugcacauuugugcugauuuugcuuaguuucaauuugaaaguugcauuuuucacccuguuuccaagccccuauagcagguguugguagauguuugcucacucagcagauauugauuaagggccuacuaugcauuaggcauuaugccaggugcuagggauacugugaugaguggaauaauuaguuucaagggaggcuggcuguggucagacagaaggaaagaauggaguaaauggggaugugugcuauuuacaggaaguagaagaguggacuggcauggugaggaggggcauauggugguguauuucucucaguauuugccauagaccuccugaaaaguagcuguuuuucuucuuuaagauucuaaaaugccagagauacuagaaacagguauguucaugagaagaagagacccuuaaaaagagggaaauaggauaauuaaagugaccuuuaugagauuugggaauucaugguuagaaugcccuuguaauuacaggcaaaauuaagauaacguuguuuccaacucuuagaugugcuccaaugauugugugguugaaaauguugaaaauaguaaauuaccuguagagagacacaguuggaauguaguuagggagaccucucugccuccugguguugcagaagcuuucugcagaagaaugauaccaucaccagcuucaucuauguauaucauagugcugguagccaacuuaauuaacuagcagugaaauaaguuucugcacccugugagauauuccccauguauacagaguucaguaauugucauuacuuuuacuaucugagauuuuuaaaaaggaaugaguagacauaccacaauuuaguuucaaguguagaauuauccuucaguacacauuugguuugugauuuuaaugggaaacaugucuaaaguuuaagcauuggcuuccuuucuguguuggaaagguuguccuucaucacacacaggacauacgcaggacauacccaggaggcccccaguuacucuguugacuggugcucaacaccccuuuccagcccucuucacuggauuauuuuuagaaugcaucagaugcagcucucaaaaugaugcaaaaucauugaguccucccauuuuucagcuaaagaaguagugucacgguuuccuaacaagaaaaccuacuaugaggcaaaauuauagaaaaucagaauagcagaauagggcaugagcugaggaaucuucugcuuuagcccuucauuuuugcauaagaagaaauaaagacccaaguuuagagcauacagcuggcuuagagugggaccuacucuuguccuucaguucccauuaggauuaaaugaguuaauaccauuauaguccuuauaacaguaccugugccauaguaaguggucagcaaaugcgaguuaucacuugucauuauuccuagugauagagcccaaacaggaaccuagaugcccuaauaauccagugcucuucaggaggcacauauuuuguauuuccacauuguauagggagaaauauguuuuaagaaguugaguuaaaauaaaaauagugacugccacaaugccaauuaauguguaccuaaucagcauacucaguacucuguacugaauaaguacuaggcuaagaaaugcaguacuuagccuaguacugcauagucugaguuaaauacugcauauucaugguuuccuuuaauccucacaauguucuaugagauucacauccuugaccaucuccauuugacauacaaguuggggaacuugccuauuuaaaaaauagguuuuaaacacuauuugacuucaaugacuuucuuaaccuuuguuauuuauuuauuuauuuuaaauuucuuuuucuuucuuuugagacagggucucacucugucacccaggcuagagugcaguggugcaaucguagcucacugcagccucgaucuucugggcucaagcaauccuuccaccucaggcucccuaguaguugggaccacaggugcaugccaccacaccuggcuaauguuuuaaauauuuuggaaaugggggucuugcuauguugccaggcugguucucaaacuccuggccucaaacaauucuuugccuuggccuuccaaagcugagauuacaagugugagccacugugccugaccccuuacccuuccuuuuaucccaggaauuggcaaacuauugcacacaagcaaucucuggccauucuuaacuuguacagucugcaaguuaagaauguuuauauguguguguguguguauauauacauuuuuuuuuugagauggagucucacucugucucucaggauggagugcaguggcaugaucucggcucacugcaaccuccgccuccugaguucaagcgauucuucugccucagccuccuguguagcugcgauuacaggugcgugccaccacgcgcggcuaauuuuuguauuuuuguagagaugggguuucaccauauuagccaggauggucuugaucucuugaccucgugauccacccgccucagccucccagagugcugggauuacaggcaugagucaccaugcccggcuuuguuuuauguauuuuuuaaugguugaaaaaaaucaaaagaaggauaauauuccauaacacauaaaaauuaugugaaauuccaauuucaguguccauacaguuuuauuggaauacagccaugcucauuuguuuacauacugcccguggcugcuuuugcaauauaauggcugagcugaguaguuguaguggagcccgcauggcccacaaaaccuaaaauaucuacucccuggccuuuauagaaaacccuugcugaccuuugcuuuauacucuuccuuggugauuacauuuuaugacauuccaacuguuuagggcauaauuguggaauuuuuauaggaucugucuccucaaguuacuugccuuuugguuuguucuguauuaauuaacauaucaaucagauccugaauaaugugaauaaaaagaguucaccguccgggaggcggagcuugcagugagccgagaucgcacuacugcacuccagccugggcgacagggcgagacucagucucaaaaagaaaaaaaaaaaaaaaaagaguucaccguuggauugucugugucuugucuuuuuuuuuuuuuuuuuuuuuucugcagauuggggaguaauuuauuccuggauacugugugaaacucgaugauaaccuguuuuuguuucuguacuaaccauggacugcagcuauuucugguuugcaugccccucacguucauuuauugagccgauuguuuuuaaaccuccaagugucuuagaugcagaaaucacucuauuuucuuuccuuuguagugguuuguugucuucugauuauguggagauucacuacgaaaaugggaaaccacaguacucuaagguacgguuaccggcgucggcaaguacucuaguauaagugugcuuaucauagaguugaucagugcacacugcguuguuuugacgucugucucaguaaaaucaccugugcucuuuuacaaugauacuauuuuuagugaggagaaauuuauuaaaauauacaaauguuugagguaacguuagguauucaggacaaaaaauguuuauuguuuugauuauacaugcaguaccuuuugugauaguauaaagagcuauacaguuccauaucagcaccugaaaguaguuaguaaagaaggaugaggcucauggccaucgaaucuggauuagaagacuggaugggcuguuagaacgguucuuuagugcaaaugauuuugcugcccaagaagggcagaggacaggugggggaagugagauuuagguaguacuuuuucucuaaccuucauaacaauucuaugagguggauguuauuauuccugcuguacuauggaagaaauuaaggcagagagagggcaaauaagccugcuuaaggccacgggacauugaauaugaggguacuuggguaucugauuccuucauuuggagaugaacuuucuugucuucagggaggauuaauaaagagcaaguggauuuggauuaaagcaagagagagagagagaugauuuguauguaagaaacagugaccuccgucagucagggugaagauccccagaauggcuacagaaagaaacucugacuucuagggaaucaacaagugccacugaaccugagcagugucccaguuacuggggacaccagaaaggaaacaaaguggggaaaccucacuggauuuuuguuugucuuuuuccuagauugcuaacacaugucagcauaaaaguagcaccuuucccguauguggacuugugccauauagguaacugggauuuucaaucugauggcuucucagcaaauguuuauagguguccuucauuauaaauacugcucaggaggcccuggcaugucucaggauuuauaacauuucaauuuguaauuggacguguuuuccagccuuugaguuuugugccacagauuaagaacuuucauguaucauucuuauuaguugucaguucuugccuuagguugcauuuggggguuguugagucucccuaaaaguuagugcuguggaaagugagcagaaaagcuaaaucaagcgcgggaacaagcuuccuggcauuuguacaaacugaagcuucugucagcugugccagggcccugagcacugcagaugcugaaucaugagccuggaguagacaagauugcagggaacuuuauagacucagcaaacgagccacauuugcaggacacagaaaccugauccagacuucucacuaaggcacuuaguuacuuuuuuuuuuuuuuuaaagaaacagaauagcuaauuggccuccagaggucauuugaggucccaaaaggagaccuuaucauuaauaagacacuccaaaucugauaucaguuguaacuaaaacuuaaaagguauuucaacucuagcaaaagaaauuguguucacugcaguuuguuuuuguguucacugcuuuucucucuuucaugacccauuuucuucaaacagcucauauacccaaacuuacgugcuucauagauaaugaacuaacagucuguuuuuuaugugucuguauuuauguacaucagaaaaacccaagaugauauggugcacacuauuuuauaucaagauuuuuuaaauguagcaaaauuuuaaauauuuuagcauauauuaaguaaucuucuaaaccuuuaauuuuuaaaaauuucauaauauuauuucuaauucauuuguuauaauauguuuaaaaaugccauggugauagacauuuugacucuuuccaaucuuucacuauccgaauaacuucaagggaaggccuuccagauacguuuugaauacaucccuuauaauugcuucagaauuaauucugagaaaggaauuuucugggucaaagaguugguacaauuuuuuaacacucuucauauauauuaacaauuuuuauuucugaaaguuuguauaaauucauauucccaccaccauuacauauauauauauauuuuuaaagcauuuguaaauaaacuucaugaagauugucuuuuaugcugcuucagaaaaucuuuguacagaguaccagaaaaggaaauuaauauguaagaauggcuagguuaaacuuauuuucacauaaugcagccuuuuuuccccuaaagaucucaaauuguuuuuuuuauuuuuauuuuuuugagauggaguuuugcuuuuacugcccaggcuagagugcaguggugcaaucucggcucacugcaaccuccaccuucugguuucaagcgauucuccugccucagucucccaagucgcugggauuacaggcaccugccaccaugcccaaauaauuuuuuuuguauuuuuaguagagacgggguuucaccauguuggucaggcuggucucgaacugcugaccucgugauccacccgccucagccucccaaagugcugggauuauaggcgugagccaccgugcccggcucaaagaucucaaauuguuuagagaaaaguacaugcacacauuguacacacacauguagacacacaauauuuuccacguaacuaaagaacagucuauuuggcuaugaaguuaaaugugaauguggauauugacagcaucccaggaauuaguugcaaccauacuuugcaaagaggguugucuagguuuucccauuucaccacuaacaagccccucucucauucuuacuucucacuaagaaaagauuaaugucuuggcuuuuacuuuuauugcauggacauggguuaaaagugcuucuuuccaugugaagcaaauauaggagcucgagagguccaaaagaagcguguaauaugaaugcuagguaucaguccaagaauaaggaagaacuuuuguucugcacuugauggagcaauagcuuuuguuuaaguuccuaccagugcuuugcacauaauauauaauaaaacuauuuuguugauuuuuuuacaacuuuaaaaaguaauuuauuuacuuuucuuauuuaaacaaauuuauugggauauaacuuauguaucauaaagcauauaauuguuuuuaguauaucuacagaauugugcauccaucaacauaaucuaauuuuagaauauuuucaucacugcauaaagaaaccacaccaccuguuaacaguugcuccccagucucucuuuuaccaaccauagguaaccacuaaucuauuaauacuuucuaucucaauagauuugccuauucuggacauaaaugaaauaauauaauaggugggccuuugugacuaguuuccuuuuucgucccuaguuuuaaugagauauaauugaaaaauagaaauuacauauauuuaagguauguaacuuaaauuguauauauaggaauuguauguauuauucaaaacaucagguugauauguugguacauugugaaauggucaccacacucaagcuaaugaacacacccaucaccucacauaguuaucuuuuuuuuuuuuguagugagaacauuuaagauccacccucuuagcauguuucaaguacuauauauuuguugaccaacuuugcugaugagccuauuuaaauaaguuaauuuuuagcauuucaguucuuauaaaauaauaagcaucaacaaaacacuaugaaaguacuuuucaaaauuaacauauuucuauuaagucuuuuuuggugagcugcuaauacauauuuguaagugcuuacuaauacuuugauuucucuucugcuuacgucagcagucaugaugaauaaauagaugaagugccuccaucccaacuucccucuaccuuauuacuaucauuauuagguggggaaggcuucuuuuccuaggucuauuuccucacccuggcuucuuccuauuccguugcucauucuugcucagggaaggaagagcggcuugacugcugggaaaguaugucugugcagccaguuccucccucccuuuuuuuuucuuuuuuuuuuguaggaucuaccuuccuacaagaagaguacauucucuccaccuuucucuucucugaauuguacuguggccacccacauguguguauguggcugggguuagguugucccacauugucucugccuggguggguaaggcuagcuacuccugggugcagcauuagcaggccuauuagauucucaacuaauccucuccuccaguauagcucuauaauaaaugaaggugacauuuugauguuucaauucuaugucacucucucauuuaguuuuaaacuugggugggcaccaauucauaccuaugaggauggcuauaaugaaaaugauggacaauaacaagugcugucgagauuguggagagauuggaacccucauacacagcuugugggaauguaaaauguuguguggcugcuuggcagaacaguuuggcaguuccucaaaaaguucaacaaagaguuaccauaucacccagcaguucuacuccuaggcauauacucaagugaauuaaauacauauguccacaaagaaacuuguacauaaauguucauaacauuauucauaguagccaaaagguggaaacacccuaaauguccuucaauuguugaaggaauaagggaaauauggcauauccacauaguggaauuacuauucagucauaaaagaaaugaagcacugauacauacuacaccaaaagauaaaucuuguaaacauuaugcuaaguaaaauaagccauacacgaaggggcacauaugauacgauucuguuuauuugacauguccagaauaggcaaauucauaggaacugaaaguagguucaugauugccagggccugguggaguggaggggaggagaaauggaaacugauugcuaaugguuacaggacuuuuuucugaggugaugagacuauucuggaacuacauaguggggauaguuauacaacucugugaauaugcgaagaaaaacacugaauuuuauacuuaaaaagguaaacuuuaugauuucugaauuauaucuaaauaacaacaacaauaaaaaacccagguggggaauaagaguuuauuuacccacccucuucaucaaacaagaauccuuuaggauuggucuugucacauaugcucaugaauaagccauuccuguucauucauuaaacaaauaugguuuuacuguauagcauaauguccuuuaggucuacccauauuuggcaaaugccaggaucuccuucuuuaaggccgaaugcuauuccauugcguguguguuuguguguguguguguguugaaauaagccagacacagaaagaaaaauauucugugaccucacuuauguguagaaucuaaaaaagucgaauauguauuuauguuggugcaaaagcaauugcgguguucgccauugaaaguaaugucaaaaaccacaaauacuuuugcaccaaccuuauagaacagugguuaccaggggcaggagguggaggggugggaguggggugguggguuggagagauguaggucagaugguacaaaguugcaguuauauaggcucuaagucuaaagauggaauggauagcauaagggcuauggucagucauauuguaugaugggaauuugcuaagagaguagauuuuagguggucacgccacacgcuuaaaacguaacugugagguagaaauaagacauguuaauuugauugacuauaguaauaauuucacuauguauaucaaaauaucauguuguauauuuuagauauacacaacuuuuuuuuuugagacagugucucacucuguuguucaggcuggagugcaguggugcaaucuuagcucacugcaaccucuauuuccuggguucaagagauucuccugucucagccucccgaguagcugggauuacaggcacgugccaccacgcuuggcuaauuuucguauuuuuaguagagacggggugucaccguguuggccaggcuggucucgaacuccugaccucaagugauccacccaccucagccucccaaagugcugggauuacaggcaugagccacugugccuggccugauauauacaacuuuuagaaaacaaaaaagcagaaaaaauauugauuuaccuuguacugugaccuuuuugaggucauaguuccuguucuagguacuagauauguaucagugaaccaaacagauaaagaucccugcccuuauggguccuguguucucuucucaccuuuauucuuuucuuuaucaguauaaccacaucacccuuuuagaauguucuuugugcuuuccuuaucaaaucaucaucacagcucaguucaagcucgcuucuaagagugaaggguuuuuggcagcaggagagcauggauugugaucagguggaguaggucucugugcgcguggcuccuggcugggagguaggguugaugcagaguggaagagauuggaggagugcguguucugaagacccuguccaguguaugaguaagggagggugggcccugcagaagucagucagagucuggccgaggugcuguauuggagucaggguauuuucagacacacgggucugccugucuucccuuuucugaguguuuccccaccucuuucugcuuccuuuccuuuauuuuucucauucccucuucuuuuaguaauauuuuaaugaaguuuucagacuauuuuuuaaaucuauuuucccuucuuuuuuacugccucucagcuugccauaauuggguuuaaaaauucguguuuguauuguuucuaaccagagauaacuuaaaguuuguauuuccacuccuauacuaaaaaugacucuuuuacuugcguguacacuagaauuuuuucccuagucuuugaauuaauagccaguuuuuuaaaaaguuucuuaccacugcauaaauaauaauuuaagcaauaacaaggaaaacagaacuauccacacuaaaucacuuaaauuagauccaggauuaucaguuauuugaauuuugaguauaaaguugaaauuauuauuaaucauucaaaauauugaccuuccuggcaacauucggaguacauuauagaauaugaaaggagcacgggguuaaaaaaugccccaagaaaucaagauagcagaugacacuaguccucacaaagcuauuuuaaguuugaauaguauaauuuaugugaacuauuaaaaauuuacauagcauugguacagccaaacuguucuaauacuuuauuaaacuacugcaagaacauuuuccccauuaaauuuaaugaagguaaauaauuaaauuauuuaauaauuuguguguugggagucucaaguuccccaagucuccaaaauuauuguuuuuuauuuccuuauucugcaguacucaaaaucagguauacaugucccauuauagauaucuuuuucuauuucucauuuguuaucagcucacugauuuuuaaaauaguuuagcauauccuaguaguugauaagcuugaagaauuuaaagauauguauauagaauaaucauuugaguauagugucaguaguuuuuauuauuguauucagaaccuagauaucauaauauacacauuuucuaguuaaggacuguguaguuucuuuucaaauguuuauccagaccugcaggaauagauugaaaauaucaguguauggucacuaucaauguccagguuuuugggaguuucauaagcaguaaagaacuggcugauggaacuuuaccaugcagauggaauaauuagacacaaaguuggggugcuuuuaaaaaccaaauuaaaacuauugguucuauuuccacuaaaaugaguagaaucaaacaguuccuguuguuauuacuauuauuauuauuaucauuauuauuuuuuauagaggcagggucuuucuacauugcccaggcuggucucaaacuccuccugggcuuaagcaauccucccuccuuggccucccaaagugcuaggauuacaggcaugagccaugaugccuguccaguuccuguuauuagauuaguaauaccagagaacuggaucuuuuuuucccuacaaguuguaaucacuagacucacaaaguuauuauccccagccauuucugguuaggaaguauuuuaaaagauggacauggcuucaaugugucaguauaugaagaggaagccugguagguuccaaugggauucugagcuuggaaaccuuguggagcagaguuauuauuugagcaugauauggcuuguggaguguucagcuaugugcaaguagcaggcugagaaagguagggagcauacuaggauuuuuaauuuccugugacuagccaauaacuuccacuuaucagaugcuccauuucuguugaauuuaauuaacugacaguuuuggauccgaaaaugcugaugucuguaugggugcacagagacuugugucaugggcugaaucgagcccuuuuugguugucccugcugccauuugccacgucacaggucugugacccacuccuagguggucagggccagcccucuuuaauugucugaggucuuccuaacuggagaaagaaacauggacuugagaaccugaagaugugggaaucaguuugucuuuuuguuauuuuuagaagagccuuuugcacuuuguuucuguccccauauggguacauggagacagcagucacugugagguaaugguuguugaagauggccagaucccuggguggaaggcaccccuggagcugacuguccaaagucaugauugccagugcccuuaagaagugggcucccuguacuggcccacuucuguuaugcuuggcacccaagauggauugcucuuucucucucaggauuuauuuuauaugagauaacucaagaucuuacuuugcaguggucugaaguguuaccaaauaauauuuuuccauaguacucuuuaaaaacuugguauuaauuuaguaauaaaaaaaucagaaaauccucuaauacugcuaguacuaauauuaaauuggaagcuaccaaauuguuuauaauguuuaauauaacuacacaauuuagcuauuaaaacuuucuuaugaugauaaacaucagagauuggauguugccugaagucucauuuaaguuuaaaaaaauacagugauucaaggccaggcacgauggugcaugccuguaaucccagcuacucaggaggcugaagcacaagaauugcuugaaccugggagguagagguugcagugagcugagaucaugccacugcacuccagccugggcgacagagugagacugucuuuaaaaaagaaaagaaaagaaaagcagcccuucacuguacacacacacacacacacacacacacacacacacacacacacacacacacacaguuguccuugaacugcacggguccacuuauauguagacuuuuuucaaccaaacacaguauuugugggaugcaaaaccugugcauauagagggcugacuuuccauauaugugguuuccacagggccgacugugagacuugaguaugugcagauuugggaaauauguaggaguucuagaaccaaucccugacuuuauaaauauauauuuaucucuguuuucucccgauaacccaccuaaauaacaguuaggggauaaaaaaggauaugaacccaccaauacaaagacaggagaagagaaaacaagcaggugagauguagccauaaaauuucaggagauggaaaguggaugaggagugacucuuagcuuugagcuuuucaugcucugcuaaguucguauggggggaaaccaagaagaaacaagucaacuuaugucacuuaucccagaaaggcagaaauaaaagcaucugaaaaaagaaaaauugguugaaaguagauguagagcgguuaaguccccaauucacugccugcccuguggagccagauaagcagauaggaagucggggacuucccuagucugguaggagcucauguauggaaaaaaauggauaggagagaauucucagcuauauuuuauaaauaauaaaaauuauuauuuuuauuauuauaaaauucuuuuauaaauauuauuuauaaauauuauuuuuauaauaauaaaaauuuauuauuauuuauuuuaaaaagcugcccagaacugaagugcauaguuuucuugauuaaaaggugucacagcaggaggcugaggcaggagaaucucuugaacccaggaggcggagguuguagugagcugagaucacgccauugcacuccagccugggcagcaggguaagaccccgucuccaagaaaaaaauaaaaauaaaagugucacagaguacccaguacaacaaaggagcaaaaauucuaaaaauaaauaaauaaauaaaaauggagcaagaaugaaaauacaauaauuauaguggcagagcugugaacaauauuuguguacacauaaacaaugaauauagauuuaacuaaaacuggugauaugaauuagaauguacugggggugagagagguuuucgagauccuauauuagguagauaauuucuaaaauggaauuagucagaacauaaaaaguauaaacauucaaaaauauauagccaaacaccagaagaaacagcuuaaaacauuaaaaaugguugccuuggagguggaggggaaagagggacaaaggaaacugcuguguuuuuuuaaaaauaaaacuuguaguuauuauuugacuuugaaaacuacauucauauauugcuucuaaaauguuuuuaaaguuaauuuuuaaagguaagaaaacaaauaagauauuguauaauuuuccauuaaaaaugauuauaaacaaacuuuuggagucucucuucagucaaguggaaguccuuauucuauaacaacaucugaaaaguaccuguacuccuacaauacauacuuaagaaauguauguuuuauuaauuaccuuggugucauuguuuuuuaaagccuuuucuccuucauucaauuuaacacacacaugcuuguuauaaaaaaguugaaaaauugccuagucuuauuugcaacuuuauauaggaggaguuucuaggguuauuaauacagugcacauauaugcccauccuugcauuucuuuuugcuuuauggaagcacccaaagaauuaaucauaaugcauaaaauacaaccaaucaaugaaaccugcuuuccaggguggagagcacuguuacuaccauggaagcaucagaggcgucaaagacuccaagguggcucugucaaccugcaauggacuucaguaagugggaaucucauuggcauuuuauucauugacccuuuccaguuucccuuuuauggauauauauauuuuagugacucuuccgugccagugcuguguuagggacugcauguggaguggugcacaaggagggcaaugucccuguccucuugaacacuuaguguuugcaggagauucagagauuaaccaaaugauuacauagaugaauguuuaaucaccauuguguuaagagcuguaaaggggaaggacagaugcuuguggaguggcaaaaccuaguccaggaagguuucccagcggcauauuccagaggacauaucaguuagaccuacagcuagacuugagagucaguaggccuuagaucuaagaaacuuagaccuaacaguaaguuggaguuagccaggcaaggguggggugacaaagagagggguucgcacauugaccuaggggugggcucuaacaaaaccauguguuggcaccuuuuagaccuggacacaguagcaccucauauaaagacuuaguuucggccaugugacgacaaagaaucuugaaacuuuucgcccuuuuauaaaaaaccuuaugucccugaaaauuaaauguaauuuguaugacauagagucauacugcuugauggcaguucagaauuuauaagcguaaagauaccacuguuugcuucuucagaaccagaugguuuuagauuauucucauauauaaagaaucuguuuucuuacagaugauauugaauuugcauaauuagaaauuuguauaguuguacaugguucuggaauaauuacuuuagagacugccacugagugaauaguccuaucucagaguaauuuucuaaucugucuguugaauuucaaacaucaguuauaucagguauaauuugcaugcauuugauguauacuuuuauaauuuuuauagccuccaugcugccuaauagagugcuggggccacacugggacuccaugcagauaugugaauuaaacuugugacaguguaaagggauuuguucaguuauacucuuuauuuugaagacacaauaaugaagcucacuugcuauuucuugccauuuccuguguuuguuuauucccuccuuugugugguuucuuuugugcuaguggcauguuugaagaugauaccuucguguauaugauagagccacuagagcugguucaugaugaggugagucuaugccaucaguugccugauggcguucuacuccuccagcaacuuugucuuugagaagaaaagagaaaagaguguagauuucaaagugccuuuguacauguuaacuuauuucaaacuuagaguaguacccugaguuuugaaguuuuaaguugcacaugccaggcccauguacccguaaaggauaguaaaagacaucaaacauagguuuucugaagcaaauccuaguccuucccagucuaugaaaagagcagagaggauauuuuguuuuguauuagccagccuccuuacuuuaaacuagcuuucauagaagucauuauaugaaaaagauacuugcacacacacauuuauagcagcacaauuugcaauugcagaaauauggaaccagccuaaauguccaucaaucagcaaguagauaaguaaaaugugauacacacacacacacacacacgcacacgcaccauggaauacuacucagccauaaaaaggaaugaaauaauggcauucacagcaaccuggauggaauuggagacuauuacuauaagugaaguaacucaggaguggaaaaccaaacauuguguguucucauucauauguggaagcuaagccaugaggacacaaaggcauaagaaugauacauuggacuuuggaggcucgggaaaguggaagguggugagugauaaaacacauuggguacaguguacacuacuugggugaugggugcaccuaaaucucagaaaucaccacuaaagaacuuauucauguaacccaacaccaccuguuccccaaaaaccuauugaaauuagaaaaaaaaacagcuuucauucuuacugucaucuuuagacaauugugugacuauaagaauguacuuaacuuuuaugaaccugaaaaucuuuaguggggaaaucugugggcugaacuaugauuauauuauaaaauacuuaguuuucuuuacagauagggaagaaaauaauguuuagagucaugcacaaaccagugauuuagacaagaaaucacaugcucuaauaguguugcuugcuaauagaaugcaaucaaauuuaaaauuugacauauauucaguaaauauuguauugagggcuuacuacaagcuggguauuauuuuagguucuggggauacuuuggugacaaaauagacagagauugagccaaauggggcuuacagucuacagaggcagauagagauacacagaaugaauaaguaauuacaugugguauguuagauagugauacaugguaaggagaaaaagugaagccaggagaguggagaguuaaauuuuuuuuuuuuuuuuuuugagauagucucgcucuuucgccuaggcuggagugcaguggcacuaucuuggcucacugcaagcuccgccugcuggguucacgccauucuccugccucagccucccaaguagcugggacuacaggugcccgccaccgcacccagcuaauuuuuuguauuuuuaguagagacgggauuucaccguguuagccaggauggaguuaaauuuuuuauacauacacaguuccgggaaguccaccaagagaagacaaguggugaaugaagcacuuaaggaaauuagagagcuggaagaacauucuagaagaugagcaaauacaaaggccuugaggcaggagugugccuaggguguucgaggagcuuugaggaaccugacaggguuggagaggagugaacaaggggaagaaugggaggagauuaaggcacugagagguaacaguacagaagucagaucagugaaaagaacuguagcgggaaaauaauauuuugugagugauagaguuagauuauugcaguuauuugauggggaacagaaaacauuuuuuaucuuuagggauuucaaauuuagauaaaauugggcugggcgugguagcucacgccuauaauccuagcacuuugggaggcugaggugcgcagaucacgaggucaggaguuugagaccagcccagccaauauggugaaacccugucuccacuaaaaauacaaaaauuagcugggcguggugacgggagccuguaaucccagcuaguggggaggcugaggcagaagaaucgcuugaaccugggaggcagagguuacagcgagccaagauugcaccuuugcacuccagccugggcgacagagcgagacuccaucucaauaaauaaauuaauuaauuaauuaauuuugaaacagcuaacaguuagauaggcuacugauaauaaaagcugaacagacaaacuuuuauugucuugguuauggcgauguauguaugaauaugggguaaauuucaaaguugaugcagaaaaguuuuaaaggguugguguuugaauaaaccucugucauuuucaacuaguaacuauaaaaauuaucagguaaugaagacagcccacuuagauaaagacauuuugauuaaguaaaauguuauuuaucucacuccaguaaggaaagauaaucuguguacagcaaaauuauucgacucauucagcaaaaacucugacuuugauuucuggcuuugauuaauggcccugguacccuaacaaaauccacaaagaacaaaacacagauucccaaauaauaacuauuuaagccuuagaguuuuuuaaauguauaaaaugagauaauuuuuaaugcauucauaguagggcaauuuuguagauuugaugaauuaauaaauguaggugacaaugucuauuaaacugucauaaggauuuauaaauauaaacuauuguuauaauguuuaaagcauugguuuugcauuguuuacuugugaucauauuauucagggccugauuguuacaugcaaauugccuucucuuugccuuccuuccuguugccuaccuuuugguuauguaaugauuuguccucauccacacuauggguagaggaaaggaauagugcuuuaaacuuuagucgauuuuuuaaauuguguugcugaucccauuguuaauuucauuacuaucuuuucaccuuuuaccagaauuuagagcuuacuguaauuaauuuuagauauuuugauguuuguuguuagauauuauugauuuuaguaugcuuugcgauaagucaaguaauacgcaugggauauuucuaaugagaauucauguuaucucucaaguaauaaaugaauagcaaaacuguuauaaguuuuauguaaccuauuaagaaguuucuuuuuuauaacuuuuucugauuauaaaacuaauauaggaaauuuggaaaagcaaaacaaauacuuaaauaguaauuuuccauuauccugucccccaaagauaacuucuugucauguuucagaauauguucuuccaguuuucaaugauauagucccauauauuuuuaaaaauagauuggaucauuauuuuauaagauaauuuuaagacaaugauguaucucccugagccucaauaucuuuauuuguaaaauagggauaaaccaugcacuauauggcgucuuugucaggacuaaauuaaauaauguguacauuaacaguaccugauacauacuaugcacucaguaauggaagcuaauaggaauaagaauaaugguaauagacauuccuaaaagcauaauuucuagggcaaaaaauguaaauguuuucacguuuguugauauaccuuacuaaauuucucucucaaacuaugcuaccaauuuccucuugccagcaaggugugagagugcuuuuggccuuacaaugguaauuaacuauggauaucguaauuuuuaaaacuucaucaguuuuauggcaaaaguuggugcuucauuaaaaaaaaugcauguugaaggaauaugaaagcauucggcauguuuuuacauguuuauugacuuuuuguguuucuugugaauuucccauuuauagcuuuaaagaaagcuaagauuuaagaguaaccaguaacacuauguuuuuaucuaaacuggggcaauuagaugauacucuuuuauuuaaaauuaagauuucaauaagacauacuuuucacuuuugauagcuaaaaaacugacauauaaauauucccauuuuaggaaggacauuagagaaaguuccaacacuguuucauagaggcuuguucacaucuugcuuucuaaauugccuacaauuguuuuguuucagaaaagcacaggucgaccacauauaauccagaaaaccuuggcaggacaguauucuaagcaaaugaagaaucucaguaaguuuuaacuaaaaauagcgauuauauuuuauguaguaugagcuuuuaucugguggagcucaguagauaugcaggcuuguuggaaguggaauuggucugauaucaggggugaacaucguggaucagcacuggaaugagugguggcucuuguguaaagaggcauggagagucauuuccagugcagacuaaaacaugaagacuuugaguaaagcugccuugggaaccagaaaguguggucaaauuuaguacagugauuuacagugagguucauccugaaaucuuccuggcaguuugcugcucuugagccagcuuggauugccucccucucaugcucugcuccagacacaucuuaagugugcuaauguuggaagaagcuucuuuuugauuguuggggcaugugauuuuauuucuguauauuacugcuaaaagucuuuaauaauuuaugcaaaagcuaaugccauacauuauuuugaaugcuaaaaugaauuagacauaguagaacucugucaaauuuucagauauugucaagugguuuuauaucaaauaugcaucuucuaaugaaucuugaacauuauguuuucuugauguuugggacaaaauuacauuugaacuaucuuuguggucaugagagugugaaauauauaaugaucagugugcuuuuuuucaccuuaguuugacauauauuaucagugccacuguuucuucauguaauauuuuaaaacauacucccauugaaauaagcauaaaauuuugauacuaauuuuuccuuucugcagcuauggaaagaggugaccaguggcccuuucucucugaauuacagugguugaaaagaaggaagagagcagugaaugugaguguggcauugagccuugggugggccuauuuuacucaaugaagucaugugccuaucaccccacauuaucuaaguguaccuaaaacaguucagauuuuggggacuguuguuuaaaaaugaaaacaauaaacaaaaaacccuaugauuugagccuuaacacacugcuuuuuauugaucucuuucuguuagugauucaaacugauuacgguagucucugaacccugacgucaucuaaagaacguguuguuuuagcucuguuuucuacguguuuucugaugauaauugcagugcguuuuauuuucuauuuaaaguacagcagacuuuucuuucuauauggcuuauauagugucauauaaaacauuucuguuaauaaaaaaucuagagagaggaguuagguuuugaaauguuggcuaaucauacauauuuauauuacuuucagauuaaaaacucuguuacaccaaacuuuaaagcuguauguguuuuucagaacacaaugaauuuauuugacuauuagcaauauaacaguuucuaaauaaaaaucauguaauuguauaaucaacuacuguuauauacuucacauguauugauaaacguauaggggcuuuguaauugaaauuauguuucuggucuuuucauaauaggcuagaaagcuguaaugauggggacuguuuaguaauuacauggugaaugcuauguaacugagaauuaauuccacagcuuauacauuacaugguaauuuacuagauaacuuaaugaguaacuauaguagaaauugcacauuuuagauaauguuuugcugaguguauuuuuuuugugaaaaaaauagaccaccagccaucaaaaacuuaguuccaguuuaaauuuuccucccuuuuaugaaacucuuaugauaauuauggauacauuuauuauauauuauauaaauuauuauuagaucucuuuuagcucauucauaaagaugugguugguaauaauauguuuuacaauggcugcuguucuuucccuacaguccaccucaucaaauauaaagugaucaaugacuauguacauaaagaaaaaagagccacuauuauaauuuuccaacuaugaaaaagaaauaaaaguccaaaugaaggcuaaaauacuuacucuuaaagaauuaucuaguuaauuuagaagacuuuagacuguaauaauugccaauauuuuuuccuuugagaaauugagcaguuaagaauuagcauauuauuuuuagaauuucacucgagugaguuaauguuucuauuuaacuacauugauaucuguaucagauauaucuggaaguaauuauaacuuaugcuauucuuauuaaaugaguuuuacauagauuuucauugacguuuuaaguaaauaugaauauuuuaucacauuuuaaugugaaauugagauuuauuuauuuuaacauaauuaugcuauaauuuuucucuagaauauuuuuacauauaaaaaccauauacaacaacauggacuguuuucuauguugauaaguaaguaccuuaaugauaauaaaauacaguuauuuucuaaauacuugaauauguacccauauuuuaugaucacuuuuuaaaauuugccugaccaacuuucuucuaagguguuuauaaaguaggcagcagagaguuguucugaaauucaaagucuuaucuacaacuuaacagugagcacuagagagauuuuaugucaaucacuauucugaccauauauuuuuauuuuccguagccaucacgugguauauuugaagaaaugaaauauuuggaacuuaugauuguuaaugaucacaaaacgguaagaauauagagucaguggguuuuagaacagauagcuuacuuaagaaagaauacauuuuacuuuauaguuaaucauuauuuuuuacuuauuaaccccaagauauucagacauauuaagugacuugauuuauuugucgguguuuggagacucugaguuuuauagaauuuucacaacucuaaacuuuccuuacauuuaauaauuauaauuaauagauuuagcuaucuggcaucuuuugucuucauuuaaaauucuuauucucuacuuuucuucaucuauguauuuggucacugcuuucuaauuuuauuccgugcuuuuguccugcuaauauguuauuuuuucuuacuaguuaauuaugcuuaugguagauacaauuguaggaggcaaacauauaaaauaaagguuuaucuaaagugaauaucuuugaugacuuaucgucuuuuuuuuuuuuuuuuuugugagacggagucucgcucugucgcccagccuggaguacaguggcgcgaucucggcucacugcaagcuccgccucccggguucacgcuauucuccugccucagccucccgaguagcugggacuacaggcgcccgccacuacgcccggcuaauuuuuuguauuuuuaguagagacgggguuucaccgccuuagcgaggauggucucgaucuccugaccucgugauccgccugccucggccucccaaagugcugggauuacaggcgugagccaccgcgcccggcgacuuaucgucuuuaaauauuggaaagaugaauaaucucguguuaacuucuguggcaguaaaaugugauugaauaugucauuucaguaacacuuaaaagauauaugaaaaacauucauuguuccucauuuuccccucuugaagauacaauagaaacuccguuaacuauacuuaaccguuuccuuuauaaaauuacuugccugaagcccagaagagucuuggucaguaggcuauauacuaguacacccaauacuaguggugugcugguaaauuuuaauaccuagcucucuugauuuauaauguuugcugauaucugugguguaaauauugccaccauagcugauuucaagcuaucaaagugagaucacugaugaggaguuaggagaggauguaucuaguuggcucucgggaucugaugggagcuggcuccagcaaccacugccacacuccccagacuguuuaggccaauuguaaucucuguuguaguuaugugauugaacuuuaaaaguuguaaacucuaaggcaaaaaguacuuguuuuaucaaaacaaaguugcacuucugaaaagacuuuauauagaugagaaucuuuuaaaaaaugcauagaaaucagguauuggugacaaacuuaugaaagauuggaacaaaaauugaaauugcuuuggaauuaucuuuaagucuuuguuuuacuuuaaggaaaccaaaauuagauuaguacaugguaugauaagguugugcuucaugcuaaaaugaugugaaauucuaauuagcuggcccuacucagagaaugccuugaaacuagaaauuuaaaaaaauagugacuuaauuuauauuuaaacuuuuaaguuucuacuuuaauggauguuuuccauuaacuaucaguuuaauuguguugaauaucaauagaauaccucuuacuuuuguauacacauuuauuuucuguuccaguugccuuuaaauauauugcuugagauguuaguaagaagcaaaauuuaucagaacacauauaauuuaagagagguccuuuuugguggaaaggaaagccagauguguaggcagucauuuuagacaguaaaggcuaaaauaugaguuucugaaggacuuuaauuugcuugaaaccccaagauaguuuuuuuaucugaauuauuuuuguugauuggaacauugagauuuuuuuucccagcugauucucaaucuugagcauuguggcauguugugaaauuauggcuuuugaagccuaagcuuuuuucaacauccauuauauaaauacuuuuagaguaguagaaauaauaauuaagauauauucaaugucuuugaaugcacaaagugcauucucaaauagcuguuaaucuauagaaucuguucucaaaccuuuacuugcaauuccaaaucucuuguucuaccauaauauaucaggaaaguacaugaagcuaucaaucaaaagagcaaaucucaguaacugugcaaaauaggaaacaguuacuacuaaguguuaauuacaauuaaacaguuauaguuuuuugguaauuguuaaaacagcauauuuuuugaauuuauuuuuuaacccuucucaaugguaaacauuuaaauaaccuuauucuuaugaauaauaaaauagcauacuucuuaaaauauuauuuuauauguagaaaauuucuacacaccaugucacauguucugugauagaguuccuuauuuaggcuaucaaaucuuuuaaggguaaauuuuaauaauucauuuuauuauuguuguuaguauuauuauuauuauuguuauuauuuugagauagguucucacucugucacccaggcuggaguacagugauccaaucucaucucggcgcaaccugcgccuccgcagcucaagugauccucccauuucagccucccgaguagcugggacuauaggugcauaugaccaugccuggcuauuuuuuguauuuuuuuuuuuuguagaaacuggguuucgccauauugccuaggcugguguugagcuccuggacucaagugaucugucugcuucaaccuccgaaagugcuggaauugcuggcgugaaccaccaugccuggccuauuauuacuauuauuaaaaugggugagaaguagguaugauauggucaucaguuuuugaaacaaggaaaaagaauuguaauuuguacugauaaauuuagagggaaucgauguuuaaaaaggaaaaaaaggccgcgugugguggcucacgccuauaaucgcagcacuuugggaguccaaggcguguggaucacuugagguaaggaguucgagaccagccuggccaacauggugaaaccccauuucuacuaaaauauaaauauauauauacacacacacacauauacauacacauauacauauacaaaaaaaauuaaaaaauuagccggagguggugacauuuaccuguaaucucagcuacuugggaggcugagacaggagaauugauugaacccgggagguggagguugcacugagccaagauugcaccacugcacuccagccugggcgacagagugagacuccgucucaaaaaagaggaaagcuuuuauuuuugagugguaauaaugccuaaaauagaaauugccuaagauuucuacuauuuaaagaaauaguacuucuuggcuaauagaacuaaauauauuccuuuugcuuuaagacagaguuacauucuaauccauaauagucccaaauacguaugacauuuuauaagaauuuuuuuuuugagagcugaaaaaaauuuuuugagguaugcuuucuaugagaugaagguuguuuuuaaauuugauugccacuucaguaguauaucagaacuuacuggaucaaaguacuuaaauucacauguugaaagucaaacugaacuagaauaauuaauacauuuauuucugaauauguggggauuugcugcugggcuuuaggauaaucaucucacugagaguacucaucuuacaaucuuuauacuauacgauccagaauaguuauuuugauaauucucaccuucggguugaaaaaccaaauucuaaucuuauuuuuuuucaaaagacaguuuucuuaaggauugcauguguucaggaaggaaaagcaaccauuuuaaauaaagauuguuuuaaacugaucagaaaugugaaaguaaguuuuguuauaaauggugauugcauauuuuucuuuauaugcaaaauuaguucuaauucaugcaggaaauagaaacauucugccuacauuugcauucaagcuuaucccuuuaauucagagugauuuaacguuggcugccugaaaaaaaugcagauaucuuauuuucaauagguaucacauuaucaguggcuuuccauuagaaaagaaaaaucccucaauuugguaaaaaguaucuuaguaccuggcugguggaaccucauuugcaagccaauuauagccuugauaagagucugcaaacaugucuuugagcugcuuaaguuaaaaauaaauauuaaaaaucuuauucuaauagaaaauugguugagauuuuuuaaagugcauaaagugcaugaaaagcaaauguuuugcguacguguuuugcuacauacuuaacuaugcgucaauaaauguaaauaugugaggauaauuuaaauauuuuucaauuuaaaccucacuugguuuuccuuacuuaaaaaccacuacauuuuauauacaccuaacaaauuuugaguuuucauuaauaaucaugauuuguuaggaauauauauaaacuauuuaauaggaauuguuaacugaaccagcuuaccuccucccucaaccuagagacuagaaggauuuaaauucuagcugugugaucuugaguaaguuauuuggggauaauaaaacccaccucauagaguugugaggagcaaauauuuguuuuaggcgaaacacuuacaguuucuacuaaacccuagguguccaauuaaauggcacuucaaguuaacaaaucuaguggucauuguucuguccuugucuuacucucucagcaauauuggacacaguugauuacccucuuuuuuugaaaauuuuauuucaucucuuggcuucuaugacgugguagcucucucaccucacuggcuauuucuuccuagucuuuaaaaucugaccucuggaauuaugugagugccgcagggcuugguucagggcucuuuucucuuuguauacucucuaccuaaguaacaacuugcagccucaagucuuuaagugggaucaugacuuuaaacucguuauucccuacuuuuagcucuagccccuuaaguucugugcucauauacagaacugccuauuugauaucucuauuuuaguguugauuugaauagaacuucugaaucagaacucuuaguucccuaguccuaaacuucucuucuucuagucucucuuauuauuuuaaguggcaccacaaucccccauccauucaaguucaaaaccuaggaguuaucuuuuaauucuucucuuuccucaccuuccacauccuauacaucauccagucgugggagcucuacccucguagugguacuugaauucacuucucucuacaguuguuuagccuccauuaucucuuaccuggacuauugcaguagcuucccaacagguaucucuguuuccauucuuggcacucucuaauuuacauaacaaugacaggcaaaauaauuuuucuaaaaagaaaaucagaggauugaaaauuacaaauaugaaauaaauuuaaaacauuacauuuugauagacuuuuaaaauaccucauuuuauuaauuuuuaaaacuugaaauguuuuaaaacuugucauguuuuccgugaucauuaugcuauaaaaagaaaucucaauaaaauaacaaauuaauacucagaagcaaacuaaaauucaucuuaauagguguguaacaccacugcauuagaagaauagauaucagcuaauguuuucucuuucaauccacaauucaguggaacuagaacauuuucaucaucccagaggaacuuaauguuaauauuuuuccuuuuacucuuaaguguaucuuggaaaguuuucagcuuguggaauuugcuaggcaacuuaaaaugcugagcuaucuauagaaacuucuuuaugccaaguuuacaaaauguguuauaaugccugaauaauuucagauuaauaggauguuuuaugacccaguuauaugcacacauuacaguuuacuuuaaaagaacacaaauauagacaguuugggucagauuaugauguacaguaguggcaauaacaugaacaguaauaguaauauuauaccaacaguuauguauucaugaauacuauaauaauagcagaauauuaauuuauuuagcauuuauuauggguaaucaguguuuuuguuguuauaaaaaauaaacauuagauauguaaacauugagauauauauucuuuguuuaaaaaacauagucacagauagaaugaaaugaagggaaucugacaaaaguuauauauagggugcgaaugggcaaaggacaaauaaaagaauuuucuaauguagaaauauuuugaaucuuuaugaaagaugcauuauuuucauaauuauaauugaagguaaauuucaaagacuugugcaaaucugagucugugguuuuaaguagguuuuguuuuccuuaguguuguagaaauaauaaccucauggaccaguagagggcaugauuuuccuaugguagaccaguuuucaaauguccucuugaagacauuaagcaaagcguacuacuccuugcuaaaaacguagcccuccagaugucauuguagaauuacucuauuaauuuacuuuucuuuauuucuuaaauaaacauaaacaaucauaaacucucagcacacuucauuuuuacuuuuugucuucucuuuguuuugacuuugagcagucaaaagcaaauggcuucauuuggaggaggcauuccucugaaaggauauacuaaaugccuggcaaaugcuguccauaucauggacaguaucuaaagcacugacaaagacauuuucuugaucugugcguggccuugaauuuaaagugagacaaguggguuaagccguuuguauaagcuacaaaaugucauuucaaugaaaacaaaaggauugaauuuguagacauuaagacuaaauuuaaaacuuacuuuuuagguauaaagcuucucauaucgauuucuauagguccuuacuauuauucagaacaucguagguuuuuuuguuuuuuuuugaaaaaaauuuuguaaagacaggaucucacuguguugcuuaggcuggucucaaaucccuggccucaagcaguccuccagccuccaccugccaaaguguugggauuacaguugugagccaugcugcccagcuaacaucauguuuuagauagucagaguuuugccaccuaacagagaaguaacaccaccaaauccaguauaccacaaacuaaauuauauauuuuuaaauccauauuucuacuauuacugagauauuucugcuuuuacagcauuuugaaauuuauuauucacuuaugauuuggcagugacugguauguauuuccccccuaguauaagaagcaucgcucuucucaugcacauaccaacaacuuugcaaaguccguggucaaccuuguggauucuguaaguauccugguuuucuugaauuugugugccaagauggaaugguuuaucucuauuugcuuacuuguacuuuagguauuucuugaacaaauuuaaaaacacaauccugaagcucaucuggcuaaggaauuauaggaugguccgcuucacagaguagugcucugagaguuucagaugacugaguuauucccggaaucccaaagauacauuaguguugcuucuaaguugcgucuauacauuauugcccccagucuguggaggacaaaaacaguggagaaauagcuaccaaaaucuauuugcuauuauacuggcaaaugagacuuuuuaaagaaacaacugggcuuuucuuaaauauauggugguaacagagaagaaaaaauggauugaagcagaguauguuuggagaauauagguaauaccaaaaaaaauuuuuuuaaggacacaaauauauuuucuuaguguucccauuggugugauauuucauacuugauuucuagaugauggaaauaagugcaguccccaaauaaaacuaauuuggaagaauaaaauauguaucuccuuacaaagacuucuaacuguacaaaucuucaauauugauauguuuuccucacuuauuuugugaauuacagaaaaugcuuaagauuuucugccuuuuuccugccuuagguuagaacucuauagauaugaacauuauauauuauguuccaaugaauauuuaaguugacuagucagaaauuaaauauagaauauuacuccauauguuguaauguaaagugcuauuuugcuuagcuaaauauauuuuuaucggguauuuuauuguguguuccuucuuaaaugcgaaaaaaaccccaccauuuuuuauaaguugccaaauaucuaaaugauacuuauuuacuccaaagagcugccuucuuuucugccuuuuaagcaguccacaaaccuccaaucauguaaauauucauaacauauguauguuauguaccuggugggcacagcugcacaaaacuauaacaugaguggaugugcgucgaguaucucauauagaguuaggauagcaucucagugccaauuuacaccugguuuauuaauuuucuuuaauuucagcucuuguuuaucuucucagaggaaaaccacaagugaauguggaaaagagaaucuuaaccacaucuuuuccucugcaaaagcuguuuacuugguagcaucucugaauuagucauuucaacaugauugaauagaguuacaucaugcaaaguguaauuuuuauuuuggguuaccacauaagguucugaagcugaccacuaauuuuuaaaagacauuacauuuaacuuguuuuuguuguaaagucauuauauaauagcuucaauuugauuuaggcauaaugguguuccccuucuucaguguguucaaagaucauccauugguuuuuguuuguuuguuuguuuguuuguuuguuuguuuuucuuugagacagagucuugcucuguugcccaggcuggagugcaguggcacgaucucagcucacugcaagcuccgccucccagguucacgccauucuccugccucagccucccgaguagcugggacuacaggcgcccaccaucacacuuggcuaauuuuuuguauuuuuaguagagacgggguuucaccguguuagccaggauggucuugaucuccugacccugugaagcacccgccucggccuuccaaagugcugggauuacaggcgugagcuaccgcgccuggcccauuguuuucuuaauuaguuugaaaacagggcaaaaugacagcauucauugaaguugcuuaauugugugaauuguuuagcuacugggccaaaaauagagagagagcagaaagggaacaauuuaaauauugugggugaugccacccaguggugaggaugagaugagugauagggaucugcucuuuuuuagccucagauccuugagucucucucucucccaauguuauuuuacuuuucauauaauaugaccuccaaggguaagccagcuauauuguuuggugcuuaucuggagauuuagugauucauuccaauccagcaggaauaaauuguugcacugcgguuacucagaacugguauaucaggcuccaaccuguuaccugcuaugagauuugaaagggugauuuuacugaacgauguuuuaaauuuaugcccuggcuuuggaauccuuacugucucucccuaggacagugaauguauugcucugggaucgaaauaacccuauaggagaguugaaaccaaauugugugauuguucuuucuuuauuuuugcucuuggaaaaaagaaaggaaaagaagauucucuauaaugggcuaauuaugaccccguguucucucaccucccccuuccuguccuuccacugacucugacucacugaucgugcauguuugacccaguguuuuccuccugcaccuguccuguuguauacccucagauuuacaaggagcagcucaacaccaggguuguccugguggcuguagagaccuggacugagaaggaucagauugacaucaccaccaacccugugcagaugcuccaugaguucucaaaauaccggcagcgcauuaagcagcaugcugaugcugugcaccucaucucguacguacucauuucagccuuuaguguagucuuuggucugacauuuauccuuaucccuuuuuugguucaguuaaguuaaauaucagaaaauagugacuugaacaagauuucuguggguuccuuugucuguuagauaagaagcauggaguuaggauaucccaugcugggaugcugaugguucuguagucacaauaucuaccuuuagagcccauaacuuccauccucaagaucaacucacaaucuaggaugccugcuggcccuccagccuucauuacuggcagcgggcaugacauguggggagaagggcaaaaggguacuccuuccagccgagcugacugcuguaaagcagguuuccugaaagcuugcacauguauguuucaugaacaaaucauuugcuagguguuagucacaugggccacaccuagcuacaagagaggcuagcaaaauguaguccuuuuagaugaacuauucaguugaguuucuacuacuaaggaaaaaggguucuauacuuucuuuuuaauauaauaagcuauucucuuccccagucauggcaaagcuauuuucagauaguccucuaagguucuguccuggaaucaaaccaaccaaaccacuccuucuuuuccucccaccauuaccguugacuuccuguuuuuucagucuuuaaucagcaauuuuuaauaaucagcaauauuaauucuuuuuaaucacugcuagauauucucuacuagaaaaaagucaagagcugugucuguuuaucuugguguuuucaauuccugugcuaguacaugaugcuuaguagguacuuggugcuugcucaauugaaauuacguaacauaacaaauuuaaagguaauuaugucauaaauuuuaagguaguugaaauaaaguuuuugauuucuuggaggaggaugguuuggggguguuccauguaggaggguagacauauuuugggagaguaugaaaugaugguccaccacguugguuuucugauagcacugcuuuuucuuaaggcgggugacauuucacuauaagagaagcagucugaguuacuuuggaggugucuguucucgcacaagaggaguuggugugaaugagguaaauuuuaccaauuagaguuucaucuuugcaucuguucucuuuuuucccuauggcccaguuuacauccuuucucgugcuuguuuagaaugaugacauggcaaauguagcaugaguggcuuauguuauuaauaaauagaacccaacgugguccuuuugguucauagugacauauuuuggugucauaaugacaauuuuucguauauaucaggcaaaugcagcugaagauuggccuggagacuuuuaggccucuauagauaagauguuaagcuuuuauaagcuuauuaauccuucucugacuuuuuuuuuguuauaaugcuccucugucuauguuaaauuuaacucauuaaaaucaaaggauuucugauaucaguacuguauguuuuuuucucccuauguauauauuuucauuuucaugccuucuaccuaccuaucuguagaaugaacucaaacaccuauuuccuuaaucucauuguucagauuuuaauacuuucaguuuuauaaaggaaauucuuaauugguaacagcacccaaaaagcauaaccaauuauaucuaaacucuugucaauacugaaauauauuauaccagguuaucucaauagccuacaauuagccuggaauaauauuggaguauauuauaccagguuaucccaguugcccauuuaguagguaccucucuugacauauuuuaguaaguuaaauuuauucuuaguuugguauaaguugaauuggagcacagccuuuugugacuuguauuuuauguuucaaugugagagcuucaaauucugagagauaucacauaguaagaggggcuuucugcuucuugggcccaguuguaaagaggaggugagaaguagcauaugccaucuuaagauacugacaggcucuacuuagggaacugagaagauuugugguaacaauuaagaaauaauaacuagcuuugugcacucucucaaaugucucccacacacuuucaacucugaaaaacaguauggucuuccaauggcaguggcacaaguauuaucgcagagccuggcucaaaaccuuggaauccaaugggaaccuucuagcagaaagccaaguauguacacugaccuucuuacucauuuucaugugccauucugucuguauaaugcauguccagucaauaaauaaauauuuuucauuccagucauuauaguuuaauuguaguauaucuccuuccucuaaaauauuuagaaaauaagcaacuuaagguaauuuuuaaucuguuuagguuguaaaaauuucccuuucaaaauccauaaaaucauacccaguuucuccgggaaugagucagcucuuucucacacugcagaauguggggcugggggcagggaauacucucacacucaggguucuagcagcugagcagacguacaaggugcuagauaaagccuccaucacaagcuuagugagaucacaguuggauugggaaauagcuuagaucuagagucaaagagagcucaucuuuaaacucuaaugaaauuuacccaccuagucucaucagaaaaguuggagaaaaaggcuuugcaagggaagacccugccccagggccuuuuaagcaugggaacaggugguagaggauaggauucuccucuaguggcccaggcagguccaaaaaggagaaccaauagggccacacaucccaucaguaaaaaacauagccagugacuguuaggcgucauuuuuucguuaaucagaugagagguagauaggaagacagggcugauuuucuagugggcaaagggucuagggcucacaguaaucugaaggguccaugaaaaauguuaauuucuuuuaaaaucagaauaaaagucaacccagauuguguuuaucuuuauacaaacccagugguaaaauauaauuuuuaauacauuuuuaugacagugggcaacgaccuaaugcaauccgguggaaagagagaccaaaguguucauucauauuauucacuuaacuagaaauuagaugaaagugccuuccuauuuuuugaaaauaugagacacugggaguaaaggucucacuuaccaccccaaccucccuagagaagaaaaggaaaaaucuaccuuaauaucauucuauauuuuauauucuuuuuuucauuaaugcauaauauuguggaaaauugaaacaaauuauauuuacacaggcuucucaauucccuuuauggguacauuaagauagucaucacaagugucugguggcauuucacaaaccuccgcaaacuuccauugauuaucuugcucagaguguuugcucucccaggaaacaccuaguacacauuaaaggaaguguuuagaguuucaccaucuggcauaaacaccuuaaaaccagaaagguguaugaccagguuuaugcccuuguuuagaaaucuugaaucugggaggaggccagugcuagagucagcugagagguguuacugaguugcaugauggaauagggugagaaguagacuucauuacuaaugccugccaucguucccuccuuccuaaaauucuuuuuuuuuuuuuuuuuuuugagaaugagucucacucugucucccaggcuggagugcaguggcacgaucucggcucacugcaaccuccaccuccuggguucaugccauucuccugccucagccucccgaguagccaggacuacaggugcccaccaccacacccggcuaauuuuuuuguauuuuuaguagagaugggguuucacuguguuagccaguauggucucgaucuccugaccucaugaucugcccaccucggccucccauagugcugggauuacaggugugagccacugcgcccggccuaaaauucuuuauuucuuugugacuuguuuguuuagguagcuauuucauugguucuaaacuuugaguuuaaaaaauccauuuggaagucuaucuuugcauauaccucucucucucuauauagguauauauagauagauguauaccucucucuauauauauacguugauauauauugcucucucuaucgauauaucgauagagagagaggcauagaaaagagaaacaggaaaaaauuaaugaagagaagagcccaucacaauaucaauaugucaguuucugguaucgaaguuaaguuguaauuguuuuuaagugauuauguacacuucuguuuuagauugcucucuuucacuaaaccuuuuagcauaguguucauucaagucucuugcucauccucacuucaacucuaacaaauugaauucucuucucuaacuucgagcauucucuguuagaaaacuucagugaugauauguuguguuugugcaacagagcuuuaaaauucacagcacauagguacaccgucuagugugaaccccacaaccacucugggagauagacaaaaagguguuauucccauuuagagguagaaacacugagacccaggaaaugcuaaguuacuugccuaugggacucucucauaugacagaucuuggacuagaacucaggcugucugauuuguagaccaggguacuuuucacuaaacauuagaacuaggaaccaaauugaguugucagaguuacaaaaauaaugaagagaggcacaauauuacuucuugccagcuguuuucuuaggaauuaaccuauaauucuggaaaggauaaggaacuauugauuuaaaagaaauuuuguucuguaagacuucacauuccgugucuauuugacugacauggaauugguaauaaagaauuauuguaggaguuguaauaccaaaaaaauaugugacuuucuuuguuuccuuuuucuucuguugcuuuuauuguuuuauuggaccagaaugugacugcacagaauccugggguggcugcaucauggaggaaacaggguaaauuuucauuaugcgugcauuugauauaugccuuuugcuaaaauugcuguguagaguuagaaacaaggucucucggguauuggucuuuuaggcuaagcacaauauaaaaugaauaauuaauugucugauauuuuuaaacugaaagaucuaauuuacuuuguauuuuaauuuuuuauuuaagguuggugauaaaaguaaaauguauuaccuucuacuucuuauuaacccuuaaaggaagcacaugauuaaaggcuucuaaguuuaguggaggcauuaauuuuuuaguacacuuagauuaaaaguugguuaucuaccugaagcagucagugaaaaucaauuuagucaucaauuuacauuuuaaggaacucguaaauauauauguuuacgguaauaaaaauuaaacuuuacuguuuauaaaucaauaaagcuuuuuaaaaauuaagacagacuuauuguaucuaaaucagguagucuucuagugauagacauuugaacauucccucacuuuucuuuugugaauacuuugggaacuagagcagcuuccccagagcugcuguugcuucagugaaccaaggccuggaaauauugcccucuuucacagggaccccugccucaugggagccacugcccccagacccccuaagccauaacccacuccuaguagaggggagagguuuccucacccaugugccucuuuugcuuucuuugccaugccagacaccugcucaacacaccaaccauuucugguccuaccuccgucccucugguugccagaggcccugaccuacuuggacagagcuccuuuguuuucuuccaccagcccuccuaggaguccaacuccuggggaggagugugggcaugaagguuugcacaguaggccauuaucccugcuacuuuagaacgcauuucuagaaauagaguuuaaaacgugaaacccuuagcuuccacgguucccuauuacuccauagcuuaguaauuuauggcuuaaccaggcuuuuugaggacuacuauaagaagauaacaccuauaauauugguucuauagggagaugucuucugucuucuaaauuaaucucugaaguuuuuacaaugacucuucauaauauauauaacauauaauaucuuuaauauauuuuauauaauaaaauauauaaaauguuuuaaauaagauaaaauguuuuaaaguuaacauguauuuucucaagaauacauuucuauauauuuuucuaagagguuccuaucaacaguggcagguuucaccuacuucuguaaacuaccuucauacaucagaaugcauaaaauuauugaauuacuuccuagaauaaguggccugucacucgcaagucaagcacuguuauaaucacgcacuguauuccugaggaauaggugugcgugugugugauucaguuuaacuaaccauguguauaauauuccccuguguucugacauagagauauuauauuugauuaaguaauucacagaaaggcucauuuucuauuccugauuaauaaugaauaucaccaaauaguauuugaaauugagaauaaagagccauuauucauggaagcguaccccaauucuauugucacugugcauauacauacuaaaaacauacgugcauauacauauaugaucuaacacaccucuuuaagguuuccuuguuuaccugaaugcauuguuggccugcaugauauagucuuuaauauacuggcccucacaacucucuccuccaauguaaaaucuaguacguucaugagcuccuuuuauucagaaaacagaggcaaaaaaaaaaaaugcuugacuuuaaugagauauagcaaauaaaaauuaacaaacuuuaaaauacagccuauuugaagagguuuuguaaugagcuuuuuaaaaaacauuucaagccuggucacaaaagggcuugacugcugaggagguuguaauguagcccccaaaucuuugauuuucuuugaaauuccaucucugcaaacuccaccacagguacuuaaguggcaauuugaacauaagucccuugucaaaauuuguguagauucauuuggauucaaagugaacauuuuguucuaauuuagggguuuuaauuuucuucucugaugauugcuuuugguaaauuauuuacauaguugauucuuuguuuccucagggugucccauucucgaaaauuuucaaagugcagcauuuuggaguauagagacuuuuuacagagaggagguggagccugccuuuucaacaggccaacaaagguuaguaacuuagaaagcauacuaagaaaguauauuauuucuccaguguuuuacagugcaacagugcuggauaucagacgccugucuuggaaagcagguuucuugucaaucagauuaauauuuaguuauaaaaguccuuaucauguuaaagauugaguccuguuuaaaugaaugacaaaaccauagauucagcauucucagucucugguguuucagugcuagcuagaacucccaaauccucccuuccaaagagcaaacaauccuucaauuaaaauaucuuugagauuuucauguuaagauuuuuacccugcugcuaagagaugguggguuaaauuaagauaaaauauuauuuuaacuaauuucucugauaaaaauuccauuucuccuugacauucuuucuagggacaaguauuaguccauuuucacacugcuauaaagauacuaccucagacuggguaauuuauagacaaaagaguuuuaauugacucacauuuccacauggcuagggaggccucaggaaacuuauaaucaugguagaagguaaaggggaagcaggcaucuucuucacaagguggcaggagagagagaaagagugcgaggaagugccacaguuuaaaacuaucagcucuagugagacucacucacuaucaugaggacuguauggggaaaccgcccccaugauucagucaccuuccaccagguaggucccucccucaacaguggagaguagaacucaagaugagauuuggguggggacacagagccaaaccaugcagggccugacuaauuucuugacuuuuguuuuuuuuugagugguuuguccucuugggacauuaguuccuuaugaauaucagcgagccaaaaaaucacccaagguauuuauggauaccauaaauacacauacguguuuauaaugcauugucucuuuaccuggagagggccacauugucaauuggcaucucgucaaacuuuguguauauagugucacaaucccuuauucguguauucuuaauucagaaaacugaaaauuuucagaaguguuuuuuauguuuguggaaaacacauuugacaguaaaacuuguccuaaacugaaaauauuuauaccucauaagguaaauauucauaagucuuguugcagaaauauuaacugauuauagggugugucccaggccccucaggacuauuauauagaauaugguaaaugcaucguacuucucuaaacuucagcaaagcuggaagucucaaacucaccagcuucaaagcuuuugcauaaaucggggcuguagaccugcaguagcauguuuggaaaugaaguugcucagcaggcaaaagauaggaucaaugcuaauuagcagaugguauggaaauucuaacauggcaaauuucguauuucuuuuuaaaauacuacuucaugagucaaauauagcucauugcuaugcaaaauguuuaauacuuugcaaacugagagagcagcgaaauaauguuaaccuuuuuuuuuaaaucaguaacuaaugugguaacuaacaggauaauuuauuccuaaacccauaauuaagugacacuacguagucaggagaugguggcuugaugccugacaucuguguagaaucuuaguauggcuguggaaaaaagaaacaggacuuucaaagugaccuugcgucgugaaagucaguugccugccuuucauaacguugauuucaaugcaacagaaauccaaaagcuucaaaguguucaaaaugggugaaauaaguaauaaugaacuaaugugagcugcuggcauuuuugaauuguaauguacauggcuaauuuuacccaccuuguagcuuaggagcuaauuauaagcaucaugccugaggaaacaacucucacuuguuuggaaagguuaagguuucuagcauaugcauaaagauccaucaauggauuucugaaauugucuaugaguuaggagaaaauuauucuaauaacuuggaaaugaaauaaaaauaacuauaaaucaucuauuuuuuaaaaaguuaguaaauauggaauuaugucuuuuuaaacuacguaguacaaugguuaauaaacaacuauggaugccaguggaauaguuuauauguauguaucaaagaagugacuuuuucccccaagcguuuugaauguauguauaugcauguguuguguguguauuauuuuuacauuauaugugugcauauuuucugugcuuuaggaaucuuccccacugccauguuuuccacacuguuggagauagugacccgucucaggauggaggcagaguccuaagaaggaaagaagggggagccugguauaaagugcaggccauguucuagucagcccuucccuuuuccaguuucuccugccuccugaucaaaauaacacagagaugugcaaugcugauuuugcucauaggacuuuuccacagggggagucccacccaaguagccuggaaaccuuugcuuuucguaauaguuuugccuuccuggaaguggaaggaggaucaguucuuucucaggugaauuuaguggaaggcagcgcuuccuugagguguguucagcugcuggagauggagucaguuucucccucucauauuuagggcucagagcauuuggguuggagugugcugcuccagccuucauuuaagguguagugauuaugcccagagaaauccugccccccuccccacugccccuggaaugggaagcaggcauguuucucauaaacagucaacuaccuuuacaguugcucuauaauauaguuuaucuggcaagcaaguucauggcaccaguagacuagauuauucuagaaauuauacucuucuauugcccuaggaaugacugagagauuucuguauauccauacaugugucuuaugcuugcagacacuugagauuucuuuucagugagaaugauggucuuggauuucuagcaacauuuuuuccccuaaguuuacuugcauuuacuugauuguacauaucacauuuggcuaugacugaagcauauuuaucuuuuugacaguuuuuauggcuucucagcugucuugagacaaguuagcaaauuagauaucugugagucuuauuagcaaugcauuuuagcuccauuagcaaauaugaaaagugaucuauuccucuugacagcuugucuccaugaaaaguaacucuaaugcuagaguucaucuguggagcccacagccagagaaucccccaagagauauugccccauuucagauauauuuuuaaguacuauuaauaagugaacaguauuucccauacagucaucauuuauaagaugccacaacaacagaucaaagaagaauaucacaugauagcugauuauacggccauuguauguggcccaguugaugugcugauuuucugugauaaauugaaacauuuuucccuucugucccuaaucucuuuagcuauuugagcccacggaauguggaaauggauacguggaagcuggggaggagugugauugugguuuucaugugguagguauaagaaaccuucuauacuuacagcacagaucuuacuuggugcaaacagguauagcauuugugagaggccagcacauugauuguggucuuacugccuuucuuucucaucucucugauuagugcuuaauucaacucagaccuguuggaaucagucauguccuuauggccuugucugagcaaaccuaauagauucuucuaauuaaauucccuaccucuuaaaaauuuguagcucauauucaucucagauaaguuuuaccaaaucguaaaacauucuuuccguguuguauauuauuuuuaucuuuauaaaauagauuggguauuagaauguaguggagcuaauuggaggagaauugccugcuaaaaauuaagcuuucucggccgggcgcgguggcugacgccuguaaucccagcacuuugggaggccgaggcgggcagaucacgaggucaggagauagagaccauccuggcuaacacggugaaaccccgucuuuacuaaaaauacaaaaaauuagccgggcgcgguggcgggcgccuguagucccagcuacucgggaggcugaggcaggagaauggcaugaacccgggaggcggagguugcagugagccaagauagugccacugcaguccggccugugugaaagagcaagacuccgucucaaaaaaacaaaaaggaaaaaaaaaauaaagcuuucuauuugcuauugaaguccuuucauagaagaucuuacuuuggugacaaguauggcaggaaggaaucuauccuuguuuaaaguaauuaauucuuucccagaauauuugcuuacuguuguauaaauguucucauuuggaauaugcaugccacguguggagagaauaugaaugaccagcagguaaggcucuucgcuuacucacgugaaguguuuucucuaggaaugcuauggauuaugcuguaagaaauguucccucuccaacggggcucacugcagcgacgggcccugcuguaacaauaccucaugucuugugaguuuucugacaguuucaucuuucuuuuaauugacagauuagccagauaucucaguguguacacugagcauuuguguagcuugucacaaauuucuuggguacaguguacauauuagccuggcaguuuucuaggaucgauaaaucucaaauucugugggccgcaacauuuaucucuacuauuauucacuaccaaccaucuuauccuccaaugccucauuaggaaaauauaccuaaacugcuuccaaaagaguugcccuacuaacauagaugaaauccaaauuaaauuguugaauagaggggagacaauuucuguggucuuuuuaauaauaugaccuacuuauaacauuuuucuucaaaacuuacccuaauuuauuuuagaccugaacauaaaagcuagugcucauauuuucccauugggcuuuuaaaauccccuguaaaggcaagaaagugagauaggaaaguaacauaugaaugcacacucauauguguauauacaugguuuguguguguguguggacagacacagucuuccaucuacagagaccaccaguuauuuuugaaaacucauuuuaaucuucccuuuucucauauauauaaccucuaauauuucuuauaaccauagaauuacauaauuuuaugauuuuguuucaauauuaggggguacuaugcauuaugguauuuagaaguuucuagcuuauuucuccuugcuucauguccccaaccagauuauaaauugcuugagggcaaugggcucuuuccuucaccuuuuacccacacccuccucaaauaaaaugcuuuguauacaaaaggcauucccuggcauuacuaaagguaauucguaugaauuuauuaaaauuugauugucuguguuuagcaaaagaaaguuuaauaucuaugcuaauagguaauucagugaagguuggguauauaugugaauucuucagagagaucuuaaauguuuauauuauaguguuuugcuauuuugucuuaagccaaaccagaauuucuucuuuaggugauuuccgucacauuguuuucugaaaauaguacucugaaacaguggguuuugaaaucugaacauuuaaagcuuugguugaugauucaucuuuaguguagaggguagcaucugggucuuguuucuauucugcaauaggauauucugucuugcuaauucuuaaaaagaguuugguguuaguuaugcgagaguauaggcauugucggugagucuaagaauguuauaauaacucugaaauauuauguaaugcuaacucuuaauauugaauuuugauuugcaguuucagccacgaggguaugaaugccgggaugcugugaacgagugugauauuacugaauauuguacuggagacucuggucagguauggcgcacugaguuuuugguaauacauuuuacuuguacagguugaguauuccuuaccacagugcuuggggccagaaguguuucagauuuaagauuuuuuggauuuuggaauauuugcauauucauaaugagauaucuuggggaugggacucaagucugaccaugaaagucauggauguuucauauacacuuuauacacaucgccugaagguaauuuuauguaauauuuuaaguaauuuugugcauuaaacaaaguuucuguacauugaaccauugaacccucagaaagcaaagauaucacuaucucagccacccauguggacaaucagugguuguuuggcaucaccaucauuccugacucugaaucuguaugcuaccaauaggcaauuacuuucuuguacuuauucacaccuaauuacuuaacaguaaaaaaaaaaaaauuggacaugcauuaagacauugaaaaaauaauauguucaccaagcagcacaguaacaucacccagauaacuguaucagcuguugaaaaauagcaacaaugaaaauggcaggcuuucagucaccacuuaugaugccguguuuuaaaccuuugaaaagguuacuguaggauguauuuuacuuuuuuuuuuuuuaagaaacaucagaagcaguagagggaccaggaaguggguccucuacggauaagggggcauucugcuggauggcuuuuuaaaauguuuccuccagagucaucugccucauuaacagaguuuuugcuuagaagucucucuuugauuuuauuagguuggugcaaaaguaauugcgguuuuugccauugcuuuugauggcaaaaucaauaauuacuuuugcaccaaccaaauauaaacuggcaugauuucuuguuaugaaugcacacuggcucucguucuucacaaagcccgucacacacuuucaccauauguccagaggcacuucugcaguguuaacaacgucaucuucaucaucaugucaacguucaaaaaguuucagauuuuggagcauuucugaucuuagauuuuuggauuagggaagcucccucaaccuggcucaaccuguacauauuuuaaagcuuucaguauagauugcacaugugaauaugcuuuguuuuauguuuuauuuugcuugguuuucugguuauuucuagcucuuuaccauaccuuuauuuuaggaaaguuuggugugguuuucuuuuuuuuuuuuuuggcaggaggggccuaaaucuuuuuuucuuccuaauuucuccuucauaauuaguuaucuuuauaugauuuauacccaacuaauugaguuuucuuuucugguccuuauaucuuaaacaguacacucacauugaugaagcacuaaugugcuguuuucaaacauuuuaaagccacgaaacuauuuauuagacaaaauuuggauggaugcccaauguagaaaauaaggaauaagcagcacuacucugguuaaagugggauugggagcagaaguccaccuuucuuaauucuccauugccgugucugucccacagauguagcccuggcuucauggccuaugugguuuggcaugaucuucuucccauuaagcuuauugccacauaauuaauauugcccucuaaaauuccuucuuuacauaauguuuauguuuuuaauuuaccuauuuuauguguuuaauuuauacauauuaugucuuuauuugucauucaaaugaguauuuguugagggccuacuguguuaagcacugcuguaaaugcugggacauggccuugcucuuguggaaccuacauucugcuggguauagaaaggcaaguaaauaaaaaaucagauggugguaaguacaaagcauaaaauaaggcaaaguggaaagaguauaggguaggaugugauagauagggugaucaaauauuucuuucuggaggacauggcauggaagcagagacacaaauaagaaggagcuugucaguaaauagugaguacagaagcuuaacuucuccaugaaauggaaugaaagcaaggauagcuggagaauaguagaaacaaaaaggaagucaagaaucagggcagguagggacauguaggccauggaaagaauuuuagauuucauucuaccuucauuuuaauucugacauuauuuuaaaagcauuuccccauacuguuacacaguuuuuauaguuaauucuuuucacgauuguaugagagucugucauguggauuuaucaguugauuuauacccaguauggguauuuagauuuuggcaguuuauuauuaguaguauagaagugaacaucuuugugcauuuuuaaaagaguguuucuuguucaggguuagcuccucaggacaagcuccuaaaaaugggguuaccuguugcuaggcauugugcuuuccaagaggcucccaauagaguacacuuggcagucaaaauaucacuuuuauuauugaaaauggccaaguugaaggcuguagcuuaaugugagggcuaaaaguuaucuuuaagaucccaguucaggcuauagcaacagguuacugacaaaauuggguccagaaggacaauguauggcacggggagcaauggaaaaugcaugguuuauguggguaggcuugcuuauaaaagaauggcagaacuguggcggaaugccuaguucuucuucccaagcuuaucauuggucagucacuccaccucccaaugauggaagugaguaaggaguaggggagcugggguuacacugaguuccuuaaccagaagaaaaaaugaggagagagaaagaaggguuccuaaguaacauuuuuguaaagguguugauauauauuauuugaaauucaauucagauggacccucuuaaagaaaugguacagugaaauauguucaggccguguuuucaugauuuuuaugcauaucuguuucuuacauuucaauauauaaauagguuuuuuugcaauuuucuguaauauaaugacaaaguaugagaauuguagguucuguguuuaaugacguguauugacaauacugauacacuguuucagaguuauauuuuuagcuuuguagaauacuacuguuuuuauguuuaccauauaugguuuuaaaaacuucuguguauucagcccuuuuagagguauaguuuuuucauuucaaucuuuaacucuuuaagugccauagaauuuacuagaaauaagauuuuuaugaugagaacucuuuguuuaaccuaauauucuauugucuaaguaaaacauuuuuucuuuuuauagcaugugucuaagcugaaaauuauacuguuaaauuaauuucucaguacauauuagaauagaauauuuuugcuaauauuuuucuagcaugaucaggaugaaccuaaaauagaaguagagggaguuaaaaccccccaaaauucuucuuuuucuccuuaagaaauaaugagcuuugaauuuaauuaauacuacuaauaauuaagaaaauggaaucucuacaacucugagaaucaguauuuacaggcaacauuaugacuuuaucucuuuuaccucauaauguguuuuucuuaauuuuuauauuagcauuuacugaugccucagagcuacuuauuaaacuuacgguuuauaauagaauaaacaauacuuacguaauuaagagaaauccuugacaaacaauacugguggauguaauacagauauuugaaagauagcagaaauaggagaaauguuuuuuguuagugcuaugaaauaugucaucuaaguggguaguauaacauaauuuaaaauaaacacuucuaaaugcuauugcacuauugaagccugccugccucaagugaaccauccuguauagcauaauguacaaggaagguucuggaaugacauuuagagacugaauccaaugcuccacucauaagcagaauaaagugcacagauuuaugguuuuccuguuuuaaauguccccagagaacauaguacauucccuaauuucccucguuaaacauucccaugauaagcaacugucuuuuauuagccuaaacuaaaaccaaauagauuagaaaucucacauguggcuaugccaauuuagaauaagggcauuuuuucuuuuuuuuuuuucuuuuauuauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccccccaccccacaacaguccccagagucugauguuccccuuccuguguccaugugaucucauuguucaguucccaccuaugagugagaauaugcaguguuugguuuuuuguucuugcgauaguuuacugagaaugaugauuuccaguuucauccaugucccuacaaaggacaugaacucaucauuuuucauggcugcauaguauuccaugguguauaugugccacauuuucuuaauccagucuaucauuguuggacauuuggguugguuccaagucuuugcuauugugaauagugccacaauaaacauacgugugcaugugucuuuauagcagcaugauuuauaguccuuuggguauauacccaguaaugggauggcuuggucaaaugguauuucuaguucuagaucccugaggaaucaccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauugugguuuugauuugcauuucucugauggccagugaugaugagcauuuuuucauguguuuuuuggcugcacaagguuuuuuucuaacugaaacaucacaaaaguaaaaucugauaaauuaauuuuagauccugaugugcuuuuucuaauagcaauauugcuuuugcauuacuguugacugugguuguguuaguuuuauuuauuuuuuaacauuacaaaucuauuuauuuauuuuuccauaaguguuugggguacaggugguauuugguuacaugaguagguucuuuaguggugauuugugagauuuuggugcauccaucacccgagcaguauacacugcaccauauuuguagucuuuuaucccucaccccccuccccaauuccccccaaguccccaaaguccauuguaucauuaucaugucuuugcgucacuacuuagcuaccacauaucagcgagaacauaugaugcuugguuuuccauuccugagugacaucacuuagaauaauagucuccacucucauccaggucacugcaaaugcuguaaauccauuccuuuuuaugacuauguagcauuccaucauauauauauauauguauguauguacauacacacacacuacaguuucuuuauccacucauugauugaugggcauuuggguugguugauggucauuuggggugguuccaugauuuugcaguugugaauugugcuacuauaaacaucugugcgcaaguaucuuuuuugaauaaugacgucuuuuccucgggguagauacccaguagugggauuccuggaucaaauagaucuauuuuuagcuguuuaaggaaucuccacacuguuuuccauaguggcgguacuaguuuacauucccaccagcaguguagaaguguucccuguucacugcauccacgccagugucuacuguuuuuuuauuuuuuuauuauggccauucuugcaggaguaaggugguauugcauugugauuuugauuugcauuucccugaucauuagugauguugagcaucuuuucauauguuuguuggccauuuguauaucuucuuuugagaauugucuauccuuagcccacuuuuugaugggauuguuuuuuuucuuacugauuuguuugaguucauuguagauucuggauauuauuucuuuguuagaugcauagauuaugaagauuuucucccauucuuuggguugucucuuuacucugcugacuuuuccuuuugccaugcaaaaguucuuuaguuuaauuaggucccaacuauuuaucuuuguuuuuauugcauuuccuuuuggguucuuggucaugaaaucuuugccuauaagccaaugucuagaaggguuuuucaauguuuucuucuagaauuuuuauaguuucaggucuuagguuuaaguccuuaauccaucuugaguugauuuuucuuuaaggugagagaugaagauccaguuucauucuccuacauguggcuagccauuuaucccagcaccauuuauugaaaaggguguccuuuuccccacuuuauguuuuguuugcuuuaucaaagaucaguuggcuguaaguauuuggguuuauuucuggguucuauaugccauuggucuauaugccuauuuuuauaccagugccaugcuguuuuggugacuauggccuuacaguauaguuugaaaucagguaaugcaaugccuccagauuuguucuuuugcuuagucuugcuuuggcuaugugggcucuuuuuugguuccauauuaguuuuagaauuguuuuugcuaauucugugaagaaugauggugguauucugauggggauuguguugaauuuguagauugcuuuuggcaguaugcucgucuucaaauauugauucuacccaucugugagcaugggauguauuuccauuuguuugugucauccaugauuucuuucagcaguguuuuaguauagagguuuuuugacccuuuguuagguauauuccuaaguauuuuuuuuuuuugcagcuauuguaaaagggguugaguucuugauuugauucucugauugaucgcuguugguguauagaagagcuacugauuuguuuacauuaaucuuguaucuggaaacuuugcugaauucuuuuaucaguucuaggagcuuucuagaggaguccuuaggguuuucaagguaaacaaucauaucaucagcaaacagugacagucugacuuccucuuuacugacuuggaugcccuuucuuucuuucucuugucugauugcucuggcuaggacuuucaguacuauguugaagaagaguggugagagugggcauccuugucuuguuccaauucucagagggaaugcuuucaacuuuuccccauucaguauuaugcuggcuguggguuugucacagauggcuuuuauuacauugagguaugucccuuguaugccgauuuugcugagaguuuuaaugauaaagggaugcuggauuuugucaaaugcuuuuucugcaccuauugagaugaucaugugauuuuuguuuuuaauucuguuuaugugguguauugcauuuauuagcuuguguauguuaaaccauuccugcaucccugguacgaaacccacuugaucaugguggauuaucuuuuugauauguuguuggauucaguuagcuaguauuuugcuaaggauuuuagcaucuguguucaucaaggauaucgguguguaguuuucuuuuuugguaauguccuuuccugguuuugguauuagguugaugcuggcuucauagaaugaauuagggaggauuccuucuuucucuaucuuguggaauagugucauaaggauugguaccaauucuuugaaugucugguagaauucugcuguaaauccaucugguccuagaccuuuuuuggcugguaauuuuuaaauuaucauuucaaucucacugcuuguuauuggucuauucaggguaucuaauucuuccugauuuaagcuaggaggguuucauuuuuccaggaauuuauccaucccuucuagauuuucuaguguauguguguaaagguguucauaguagcuugaaugaucuuuugauuucaguggugucaguuguaauaucuccuguuucauuucuuagugagguuuuuuuggauuuucucucuucuuuucuugguuaaucuugcuaauggucuaucaauuuuauuuaucuuuucaaagaaccagcuuuuuguuucauuuaucuuauguauuuuguuguuguuguuguuauuucaauuucauuuaguucugugcugaucucggcuguuuucuuucuuccgcuggguuuagguuugguuuguucuuguuugucuaguuccuugagguaugaccucagauugucugucugugcucuuucagaccuuuugauguaggcauuuagggcuaugaacuuuccuguuagcaccaccuuugcuguaucccagagguuuugauagguuguggcaucauugucauucaguucgaagaauguuuuaauuuccaucuugguuuuguuuuugacccaaugcucauucagcagguuauuuaauuuccacguauuugcaugguuuugaagguuccuuuuggagucaauuuccaguuuuauuccacugugaucugagagagugcuugauguaauuucaguuuucuuaaauuuauugaggcuuguuuuauggccuaucauauggucuaucuuggagaaaguuccaugcacuguugaauagaauguguauucugcaguuguuggaugaaauguucuguauauaucuguuaaguccauuuguuccaagguaugguguaaauccauuguuucuuuguugacuuucugucuugaugaccugucuagugcugucaguggaguauugaagucccccacuauuauuguguugcugucuauguccuuucucuuccuuccuuccuuccuuucuuuuuuuuugagauggaguuucgcucuuguugcccaggcuggagugcaguggugcgaucucggcucacugcaaccucugccucccagguucaagugauucuccugccucagccucccaaguagcugggauuacaggcaggugccaccaugccuggcuaauuuuuguauuuuuaguagagacagaguuucacuauguuggucaggcuggucucgaauucuugaccccaggugauccgcccgccuuggccucccaaagugcugggauuacaggcgugagccaccacgcccggccaacauuucuuaggucauuaguaauuguuugguaagugugguagcuccaguguuaggugcauauauguuuaggauugugauauuuuccuguuggacaaggccuuuuaccauuauauacugucccucuuugucucuuagccacuguugcuuuaaaguuuguuuugucugauauaagaauagcuacuccugcuugcuuuugguguccauuugcuuggaaugccuuuuccaccccuuuacuuuaaguuuaugugaguguuuaugugucaggugagucuccugaaggcagcagaugguuggugaguucuuauccauucugugcuucuguaucuuuuaaguggaacauuuaggccauuacauucaauguuaguguugaaaugugagguaccauugcuuucaucaugcucuuuguugccugugugcuuugguuuuguuuuuuuguuuuugcuuucuaacuuguauuuuuguuuuauagauccugugugauuuaugcuuuaaagagguucuguuuugauguguuuccaggauuuguuucaagauuuagagcuccuuuuagcaguucuuguaguggugguuugguaguggaaaauucucucagcauuuguuugucugaaaacgauuguaucuuucuuucauauaugaugcuuacuuuggcugaauacaaaauucuuggcuaauaacuguuugaggaggcugaagauagguccccaaucccuuuuagcuuguagaguuucugcugagaaaucugcuguuaauaugauagguuuuccuuuauaguuuaccuggugcuucugucucacagcucuaaagauucuuuccuuugucuuaacucuggauaaccugaugacaaugugccuaggugaucuuuuugcaaugaauuucucagguguucuuugugcuuccuguauuuucaugucuaggucucucacaaggccaaggaaguuugccucgauuauucccucgaauauguuuuccaagcuuuuagaauucucuuccuccggccgggcacaguggcucaugcuuguaaucccagcacuuugggaggccaaggcgggcggaucacgaggucaggagaucgagaccauccuggcugacgcagugaaaccccgucucuacuaaaaauacaaaaaauuagccgggcgugguaacgagcgccuauagucccagcuacucaggaggcugaggcaggagaauggcgugaacccgggaggcggagguugcagugagccgagauagugccacugcacucuggccugggcgaaagagcgagacuccgucucaaaaaaaaaaaaaaaagaauucucuucuuccucagguacaccaauuauucuuugguuugauuguuuaacauaucaaaccuucuuggagguuuuguucauauuuucuuauucuuuuuucuuuuucuuuguuggaugggguuaauucgaagacuuugucuuugaacucuuaauuucuuucuucuacuuguucauuucuauugcugagacuuuccagagcauuucacauucuaaaaauguguccaaaguuuccugaauuuuugaucguuuuuucuuuaaguuacuauuuccaugaauauuucucccuucuuccaucauuuuuuggauuuccuugcuuuuggcuuugccuuucucuggucucucccugauuagcuuuauaacuaaccuccugaaauucuuuuucagguaaaucaggaauuucuucuugguuuggaucccuugcuggugaacuagugugauuuuuugggggguguugaagagccuuguuuugucauauuaccagaguugguuuuuuugguuccuucucauuuggguaggcucugucagagggaaggucuaggggugaaggcuguuguucagauucuuuugucccacggguguucccuugauguaguacucucccccuuuuccuauggguauggcuuccugugagcugaaccacagugauuguugucucccuucugugucuagccauccagugagucuacccggcuccaggcugguacuggggguugucugcacagaguucuguuaugugaacugucugcgagucucucagcuguggauaccagugccuguucuguuggagguggcagaggguguaauggacuccaugaggguccuuagcuuugguggucuaaugaucuauuuuugugcugguuggccuccugccacaaggucgugcuuuccagaaagcaucagcuguaguaguguggagagggaccgguagugggcagggcccuagaacucccaagauuauaugcccuuugucuuccacuauaaucagcucuucaguuugugugggagcugggugaggccugugacuccuggcuucccccacuuuccugacaaccugcaugacucagcagaggcagccauaauccuccuagguagagaccugggagucucacccccaucccccacagcaaccacagcaagacccacccaaggagagucugagcucagacacgccuaguccuguccuuacccgauggucccagcuucaagaaaaaagggcuuuaguucuuccccggccugugaagucugcacacccgauuggugcccucccccaaguuauggccaggaggcuucucgcccaguucaaauuguuaaaaaguucagcuagagaauuccuucucccuguggaguuuuacccccugcuccucuggccaccuucccguuggaucccuauggugcuaggcaggaaugggcugcucggggacccagugaacucucagggccuuuuuguugcuuccucuaccccuguauuuggcuuggcucucuagcuugacucaguuccagguaaagucggaaacuuuuccugcaaacagaccuucagcuucuccagcggggguguguguucccacuuccacaauuggggcacucacaguauuugggugucuccuggguccugcaggagcagucugcuuccuucagagggucuguagguccucuugggauugcuaguuuguucuugcaguccaucuggagcuaaaauucacagugcaggccuccgcaugcugcccuguccggagcugcaaucuaguccugccuccuguccgccaugaucccgaucacugguugcauaagguuaagagugagugaaugauuaaugauaguugauuaaugagauaaugauugcauuuugaguggcucuggauggauuaaagaaaccacagggauuucugcucuuguguaguuguguauuucugcuuuuuacugcugaucccuugaauacucaccagauugaaaagcuguggcgaaugaaacauuuaugagagucaguuauucuuuagaaagguguagaaccaaagcauuugccuuggaauguuuguuaggaaauuacugcuucuuaggaaugcuaaauuaguucuguuaucuuucuguggugaacuugauaaauggcucaauaugugcagcauagaauaacauagucguaucugguuauugagucauucauuuauuuucucugugagcucacaguacuugcacaccugccacaugccugguguuguuguagguacuagggcagcaguaaggaacaaaacauagaauccugcuugcauggagcucacauuaugauggggcaacaaugaacaaacaaguaaguaaaacuuaugaauugucaguuggugauaagugcuuuggaaaagaaaaaaaaacaaagaaaaaaacuuguagacuucucuaaaaauaaauaaauaaauaaaaagcccuuaaagcccuuauccuaaauuggcacagccccagagagugccagcauuggaggggcugcagcuuugaagagcauagguucuauaaaggccucuuugggaugaugauauuugagcaaagcucuaacaaaggugagggaaugagccaugccgaaauccagagcgacaacgggaaagcaaaggcaaaggcuguggguggcagcaugacugguguguccacguggacucacaucagccaugggugaacagaaaaugaugucacagagaugacggggugagaaaguauaggagcagaucauguugagcuuggaaggucauugaguaagcugggaaacagaagaucgaugugauuugguauuuaccuuuuuaaagagaucacucugauagcaauguaaacucuaaggugacuaggauagaagcaagggacucaggugggaggcuauuacaguaauccaggugagagguggugguggcuuggacagggugugagcaguggagguggagaaaaggggucagauuggaauuauauuuugaagauagaacuagcaggauuuauggacagacuagauggaggaagagugagagaggaggggaauagaagaugacuauggccuuuggcuugaacaauuggaaggauggaacaucauuuacugagaaggugaagacugagggaggaccucagugcacacugcuguuucuuauuuauuugccaugccugcauauuuuuuucuuuuuguauuuguuuuaaacucuguagcagggccuuugacuugaucuuuuuccauucucuuaaauguagucaauaaaauguacagagaguaacuuuggggggaaaugaaguauuucuuuaaaaaaugauuugauaaauagaccuauaaaaagaaauaaccaucacaucacagacuguucuaguaacaugucugcaguuugaagaggucagaacuauuaauauaauggagauauagcacuuacuuuguguugaaaggcagaguauuucuucuguuucacuaaaguagccuauagguaaaaugucaugaugucaaaugcagauuugacauuuucagagagcugagcaacuucuuguaaauuaguuucuugaaugugaccguucuauguaccaagcugauucauuuccuucauuguccauuuuaaucucuucuacuuuuaacucuguaggcaagugaaugugacuuguuauucugguccaucucaccauaaacagaggaaacauauaaaaugcaugcacuguguggcccuuacuuacuuauuuuaccaauaauaggauaaauaauuugaauuaauaacguauuuaaggaguugcauguguuuuucucaauguuucuaguuauauauauccaccaugcuugcauuauauauaguauguacauuaucugaagguaccuagcaugcugaauauuaacuaaaaagauaauauuuugcagugcccaccaaaucuucauaagcaagacggauaugcaugcaaucaaaaucagguaugcugggcuauaaauuuuaaguguaauuuaaaaaggauucauuggaaaguuuuuuuuuccuuuuuugauaaauauuaauauaacuuugaagggaauuuuacucaaguaaauuauuauagugggauucuaauuuagaguugcuucauguuaugccaaauauuaaauauauuuaccucuggugacaaauuguccagauuaagagaaaaaaaaaaagaauguaauggcugaagaacugggagucucauuuauugaguugugaccaucuuucaguaauuucagccugccuggugugugaaagaaaauaugacaaucugucaugaguuuuuuuuccccugaagccauauuauaaccuacaggugaguaucaugaugucaaaugcagauuugauguuuccuaaccauccauacacaaaagaagcuaaaaaucauuuuggugucucucacagaaauguaccaauuuuuguuugcuguaaaauuucaaauuguagauguuuaguuuacauuuagagagcuguacaaugaguucuguuuagaguuuuaaaguuuuaacucuuauucuugagauauuugugauccuuacuggucacuauaaaaauauuaggguaugaaaugaaaaaacuuuauccaagugaaccagaaggagacauuguaguaaaaacauuggggaagacaaacugacucugugugccucacaugugugcuccuguccccagggccgcugcuacaauggcgagugcaagaccagagacaaccagugucaguacaucuggggaacaaguaggucgcaccuccuugcuuggcgguuacacauaccauuuucucuuaauaguguucuucucugccagucuugcugagagagaugcacagcuuggagugauguuuuaaaaaaaucuagaaaggaugagaauaaagagaacugugaaucuuagucacaaaaacuauagaaaacaacugcuuaaguuggguacuugucagaacugagcagugccauuuaauggcuguggcucucagagaagggguguugcauucauuugcaaagauuggguugaguacagugugauuauccagccacuugugugauuuauuuuguaccuugguuuuaacauuugacccccuuuuuuuccauuaacacacacacaaguuagcuuucugguuuuuaccgcaggaaaauaccagacuuauuuuuuaaauuuugucauuuacugucucacuucaaagugaagagaugcauguacuuccugagaugcagauagguacauggcugugauucuuaguacauuccguaaaaguucacgugcauauccucuuccugacauuuacagugccucuccaauaauaucaguucaugagggccagacggggggaagaaugagaaaugcgucugccuuucuagccaaggcuggguucaccccaaaggaaaagaaagcacacagaaugagaacagggcucuggcaugagugauuuuagaguuuggcaaauaucauuuauuugacugauuuacauucagugcuuuaguuuugacagagaaaagauaauagacauauuuguauuuugaaagguuuaauuaucaaaacucaggugccaacauaaaaucucaauaggcuacgacuuuauaauuaucuccuaauauugauauaaaacaagauuaagaauguuaguuuccugugugucagucacuucaccaauuccugcugauaaucauucgcaccuuccauccucaaacucaccaacaaggauuggagagaaauuuauuucucaggcuaaaaacaguguuguuuuggagcuuuuuuguauuagcuugcaagagccaauuguuaaauuuucaggaauuuuggaagcccauggauaucacauugagugugaaaucagccauggagaauuuauaccauggaaacuugcaaaugcuacaaaucaggauguucuuuuuccuugcucuggagaaucggguguuaaacacuuacuggcacacuacugguuauggauaacaaagaaaaugaaaauuaauuuucuucucuugccuaucuccaaaagaggcugcagggucugacaaguucugcuaugaaaagcugaauacagaaggcacugagaagggaaacugcgggaaggauggagaccgguggauucagugcagcaaacagugaguggucagcucuaagggcauagucacuggacuuggaagcccuucuuaugcaagugcaaaaugagcacaaaauaaaugcuaaugauuuuuuucuaaguguucaccauuccaaaauuuaaaguauuuauuuuuaauagguauuauuauaucuagaggcaaauggcuauagauuaaacuguuacuaugcuacagauucaugccauuuucacaaaauucagaaaauuucucaggugccacauuuuacuucauuuuuguucugacgagauacuuugccagagcauuacaaauuaauacuagcuuuuaauuuucuacuuuuacuagaauauauggccuaugaguguaguaguauacauguaguuuaaaugcaaacuauauagaccguauauauuuuugcgaccaacgugaaaucuuacuguguuuuuuaucauuucacaaguguaguaacauuugauuuaaucagauaucuaauaucuacaccagagauuuuuuuucccuuccaaaaagcaucuaguuaguacauauuaaagccaucuuuacucaggaaaugagaugcuuucagagcacauugauauuucuuucucccuuucuuuuuuuuuucgagacugagucucgcuuuaucacccaggcuggaguacaguggcaugaucucagcucacugcgaccuccaccuccuggguucaaaugauucucgugccucaaccuccugaguagcugggauuacaggcaucugccaccaugcccggcuacuuuuuguauuuuuaguagagauaggguuucaccauguuggccaggcugguauugaacuccuggccucaagugauccgcccuccucagccucucaaagugcugggauuaugggcgugagucaccacguccagccugauauuuauuugauuaguugaggaaaguuagaauucucauuaauuagguuauuaagguuaauugaauuacuguggaacaauggaaucauuaaggaauagcccaaaccucuuuccuuuuccuucuaaagcaaugaaaauucuccuaauuuugaagcagagcaagaauuuaagggaagcuuuauucucaguuaaugaucucugcuauauuuuacaaaacuuugcauuuccauuuagucuuugaugauggaugaggccacaguaggcaacaaaucuuugacuauaauuuuuaaaaaauuaaaccaaaauaauagagaacagagcuucuuaucugaugucucauaagugaagcacagauguuccaagguguugauccucaguccucgaggugucaggggauaggagcaaggggagccugaaguagucaaaauccaugggauuggacaucuugaauuugauuagcuuuauucauucacuccauguccuagagaaucugauuaucucucugugucucaugaccucaaaaaguuugagaggcauuggauuagauuauuguaaaggauagcuuuugaguaucugguaauagaauacccaauccccaauaaguuaagggaaauuaauguguuugaaacuugaaaaaaucaugaaauauaugaccagacacgauggcuuaugccuguaaucccagcacuuagggaggcugaggcgaguggaucgcuugaguccaggaguucaagaccagucuggacaacauagugaguccucaucucuauuuuuuuuuuaaguugugaaauguauaaacauaaaaauaaauaacaaauaaauauacauuuuaccaaauaauuaugaagugaacucccaugucacuccuacaugggucaagaaauaaaacauugcagcaucccagaaauagugcagauaccuucauccugacuuuuguggcagucacuuucuugcuuuucuuuagaguuuuacugccuguuuucaucccuaaugcuucauguauuauuuuguauuuugcuucucaaguccagcauuuuaagaguuuucugugguguguauagcugucuguuguucauuuuuauuauuuauuuguuucacuuuuauaaaugcacaaaugaaugaauauacuauacuuuaguucuccauucuguguugaugaacauuuaguuuguuuucauuuuuuggcuguuaggaaccaugcugcuaugaauauucuuguauauguaaccuagugcacauuuguaccucuuucuguaaggccuguacauaaguagaaaauuugcuaagucauaggggaucuuaucauuguuaccaaauaaugucagacuguuuucuaaaauggcugaacuaguaaauucuaccaucaguauuauguauauaagaauuuuauuguaccauauuucaccaacacuugguauuaucagacuuuuugcuuuuaucuguucuggugggugugaccugcuauauuagcaugguuuuaauuugcauuuccccagauuacaaguggaaucuagcacauuuuuguacauuuguuggacauggauuuccuuuuuuugugaugugccacuucaauucuuugcccauuuuuuaggagucauuguuuacuuaacagauagacuggagguagagguccucauggugcaugaauuuaacaaggucaccaaagacccagauaauuucugccccuccauccuguaacccuuagcauguugauuuuuuguccuuaugcuuugugaacucaugauuguaaaguggauacaaaagcuacacauucaaagguaggaaguaaggauaggagcaaaaggucuucucccugucagucucuaaccuuuuauccagaaaacaaaauccucccagccacucccuagccagcuucuccucacaucuucacagcccaggggccacuuuuaacucuaggaagacgagaagggggaauggauaggaaagugggcgucgagaaugggaguaccaagaauagaugagacagcagucaugauccaccuuucagggcugggcacuuugcuguuccaaacaaaacugugauccucuuagcaaagaaggaggagguuaucaccuaccaaugauauaugaucaaauguuuuuguuuagaaagaaagauaauauuuuaaaaauuugaaucaauguggaccgaaucguuuugauuuuuugagcuugauuccuccugucuggucuguuuguuuucuuuacacauguucagugauguguucuguggauucuuacucuguaccaaucuuacucgagcuccacguauuggucaacuucagggugagaucauuccaacuuccuucuaccaucaaggccgggugauugacugcagguaacauauuaaauauuagaagaccuaauaagccaugagaauuacaaauuucacaaaaugaaauuucaaaaaaaucagaaaucaaagauuuuucuaguuuuuacaagaggaaaguuaauuuagauuuuauuaucaccuuucauauugacagucacuuaaaaagaaacaaaguuguauauugacuugcagcuuacauuugcucaaaauuauacuaguuaguaguaauauggccuucuuugucaucauaauuuuaggaguagaauuaugguguucauucuaacccauuauuaaaguuuuaagcauuagaguaugccacuauuuugaacacuguguguguauuuauuuugugacugaaaagaaaaagaauuuaagcuauaguuuaugaaguguaugucugguuuggaagauggcuuaacaaauaccuaaucauauauagaaaauauuuauuaaaauaguauguauaccgauaagcaaacauuugauauccaguugucugugaguacaaggcauguagauaugaggcuuauuuuuguuuagucggggagucauauuauauuccaaauagguauuguucccuucaaaguaguuauaauucgaagauacuauucucuuacucaaugguauuguuguugcucaaaacacuuuugggcuucccccugcagaauugccuucagcgucugcaaacuuuuacuuuuaguauccuuagaguaccauaucuucaccuuaagugagguaauauaagauuugggauuauccaaaaguaauuuuaguaaauucauuggguacuaaauuggcuaaugcugucucagucaaaugguuacuuuuuuuuuucuugcuuuuaaauggcucugaagacaauucuaacagggucuuaguaagaucccuccuggaauaaauuuguagucucuaaagcuaguuacuuugacguauacaagcuuuauuugaauguguguuuucaugccuuuagauaaaauagccuuguuaaauuauauuguuguauauacuaaacuagcauauuuguuaaauauucagcaagauauucuauuagugacuauagcauuaucauucaaauucaaauuauaccuaacuuugaaauuuuagaaguaagcacuaaaacacaugaaauaaucuuaugaaaccacugucauauauguggucugucauugacugaaauuuuuuacacaaugguaaguacuugccuaucugaacguaucuaaacauagaaaagucauacugccccuuuucuauguuuagauacguuuagauaggcaaguacuuaccauuguguuauaauugcccacaguuugcaguacaguauaauaugcuauacagaaguguagcccaggagcaauagacuagaccaucuagcaguguagguguauaguaggcuauaccauccaaguuuguguaagcucauucuaugacauuugcacaaagacaaaauugacuaaugacacaauucuuagaauauuauccccaucauuaagcuaggcaugucuguaaauaucaauagaaaauaacugauuuguuuauguuuuucaauuauggauaaucagaucuucugaaguaagaauaauaauuuucaaaauauuuuucauuugcuguuuuuguucaucgucugcuuuuuucuaccaugcuacaucugaaagccuuggagagcuaaugauauauuugcuucuuuuguucucauauagauacuucucuccuuuagucuuaauguugggucuugaaaacacgugaagauuuagaauauacuuugugcaaaugacauuuuucuuguugauguguacuguaauaaugauaaugaaagaguguuucuuuuucaugcucuuuuauuaaggaaagguagggaaaggggaagaagaagaggaguaagaaaaugcuaggagaaauccacauccacugacagccucuucgguuuugugaagagcaagccucauucauggaaugauguucuaaguguggugcaaauaguuauauggguaucuuucuuguuuuaguggugcccauguaguuuuagaugaugauacggaugugggcuauguagaagauggaacgccauguggcccgucuaugauguguuuagaucggaagugccuacaaauucaagcccuaaauaugagcagcuguccacucgauuccaaggguaaagucuguucgggccaugggguaaguagguaucaaugugacagcuggaaccuucauggucuggcauggucacagugacuggacuuuaauuucagccauucuccuagccaacauggugaaacaccaucucuacuaaaaaugcaaaaaauagcugggcgugguggugggcaccuguagucccagcuacucaggaggcuuuugcagaagaaucgcuugaacccaggaggcagagguugcagugagccgagauugagccacugcacuccagccuggcgacagagcgagacuccaucucaacaacaacaacaacaaaaaaggccaaauucagccuuguuaaucacaaucaugguauuagaauauuucagauuaaaaagcuuccuuguuugauuuuaucaucucugaauguguuucucagggagauaaggguuuaaacacuccugucucuaguuugcucauuguuauuuauuuccucuagauuacaguuccauuccagcaugcuggugggucccuggagaaacagggaggagacagagaucacucugggguccucagcuuggcugacugagaaaagaggguuaccaaggacuagggguguggggguguggugggggggaauccuuguugggcagggaaagugccaccaagugaguuugguguuggacgugguaacggugaggucauacaaggcacuggugauuuaugucuccuggccuuuuaucuccagcagugcuuuugagcccacugucuauuaauuuauugaaguaaguguauauguuuuuaaaguggguuccuagaaacaguuacuucugaacaaaguagaaaaaaguaucuuaucagacauuuguauacuuauguaauaucaugauucaauuuaauuuaagaauaacaugaauaauucaauuuaagaauaauaauaaauaauaagauaaauaauugaagaauuucuuccuuuuacucuuuuucuuuaauuaaugggaaaaaauguuacacaauuugaucuaugcauuauuaccuugugucuagugaucaagaccaugggaaacuuuaaaaagaaauuccaaauagcuuuuaaagcuuccucccugcccccgugucucuuuuacauuuaucacuauuauucuacaaaauacagugaaaaugccauaucuguuccuuuuucuucacagguguguaguaaugaagccaccugcauuugugauuucaccugggcagggacagauugcaguauccgggauccaguuaggaaccuucacccccccaaggaugaaggacccaaggguuugugugauuuugguuucaauucauggaauacugaauucguugacacuguuccaaugcaccaguauaacauucuaauugacuuaagaggagacacauaagaauaucuguuuuugccuuuaaaguauauaauuuauguuacugccaaauuaaggauucugauauaucauauuuuuaaaauguguuugaauuacuucuuagucuagaacugagauugggaagaaguaaauauacacauuuucuuuaauacaguauucuuuuucucuuuaaaccuuauucucuuucuguagucacaaauuauuuugcaguucgucuaagcuaugccauuuuucuaauagaucaaaucuuuuuggcugacaugaggcucugguuacuuuucaauguuggaaucucuccggaaggaaguugucaccuuacaagcucuuuuugaacauucuuuugacuaggaaggaguuggaauucuucauagaacuuucauucuucaaagaaaaugugagagaucuggaccuuuguuuuaaucagucauuaagaggagagaaauuagaauuuugggauuagaaagagacucaggggccaccuaggaccacucucuauuuucgcagaugagaaggcccagacccugaggucaggucacuuacuauagucacccagguagugagagacaaggccaggaucaggaccuaaguccuaagugccugaucucagacucuuguucucuucccauccauuauaucaucuuuuuuuuuuuuuuuuuuuuuuuuuugagacaggaucuugcucugucacccagguaagaguguaguggcacaaucauggcucacugaagccucaaacugcaaggcccaagaauccugccaccaugccuggcuaauuuuuuauuuuuuguagagacaaggugucacuauguuguccaggcuggucuugaacuccuggccucaagugauccucccgccuuggccucucaaaguucugggauuauaggugugaaccacugcacccgccccucuuacaucaucuuuuuuuuuuuuuuuuuuugagacagaguccgacucugucgaccaggcuggagugcagcggugugaucuuggcucaucguaaccucugcugccuggguucaagagauucuccugccucagccuccugaguagcugggauuacaggcaccugccacugcgccuggcuaauuuuuguauuuuuaguggagaugggguuucaucaucuuggccaggcuggucuugaacucaugaccucauaauccacccaccuuggcugggauuacaggugugagcuaccgcgccuggccucuuacaucaucuuauaauguagucuguguuaucaggaguaugguaaucauuuuucauuauucucccgauucucaaccccucauacaauuuucaaagaucuagaaaacccaucagucacaaacaggccuacuacagcaucuguuacauuguaccuaagaaaccaaggaaauacuagaaccaguuuuuauauacagggaugacguuguacaucagcuucuuuaucaugguacugcuaacaguuuuuuuguaacugccgugcuuuucucugacagguaggaaaaugcauauaggauuaguaccauuuagaucagcuuaguuuuggaugaaaguuuauugaaacucucugaacuucaguauaguuuauaugggaaaagaugauuucagaugcagaugaagcucuguaguccucaauuccugaagagauuuaggcugauucaggcgcaugugaauuguucaguaauaguggguguguuaaaacacauuuuaugcauuugcuuaauaugcccaugauauuaaaauucuguaagaaucauaaucacacccucacagucuauuucuguucuccuucuucuauuucuaaaagggaacguauuccacuuuuacacuuagucuuuuguuacuuuaaaacuagaacaaaaaauucuuggauccaccuucugaaguuagauuuagagaagauuuaagcucuaacaagagaagccaagguucauucuuuccaaauuuucucuccacaguguuucugugauuuuuuuuuuaagaucuagaugcuauuuccucaagugauguauaaagaugccucaacggaugagcagagcuaaauuuacuuagacucugccuuuuuuucuuuaaguagaguaggggguuauuaauugucugguucuguaauaucuauucccuguuccuucacccacccaugccuaaaaaucuuuggaggcauuaaguaaagaaagucacauucuagagaaagaguacucacagcugccuuuuguuuuguuuugcuuuacucucuccauuuaaugugguaguaucccacacuaccuuuaaaaaaaaauaacuuuuuugauccuucaaguaauacauacuuauuguagaaaaauuugaaaauacggaaaauauuaaaacucagaggugcucaagauaagccuuauugggccuggcucagugguucgcgccuguaaucccaagacuuugggaggccgagggcagguggaucaucugaggucaggaguucgagaccagccuggccaacauggugaaaccccaucccuacuaaaaauacaaaaauuagccagacacgauggcacaugccuauaaucccagcuacuugggaggcugaggcacgagaauugcuugaacccaggagacagagguugcagugagccaagaucgugccacuguacuccagccugggugauagagugagacacugagcccccuacucaucccccaaaaaagaggccaggcacgguggcuuacaccuguuaucccagcacuuugggaggcccaggcaggcggaucaccuggggucaggaguuugagaccagccuggccaacauggugaaaacccaucucuacuaaaaauacaaaaauuagccgggcaugguggugcgugccuguaguaccagauacuggggaggcugagguaggagaaucgcuugaacccaggagguggagguuacagugagccgagaucgugccauuguacuccagccuggguaacagagcgagauuccaucucaaaaaaaaaaaaaaaaagagauaagcauucugguaugcuucuuuccuguugcauuuuucuuuuuccauuuuuaaugaagacaauggagucauugcaaaguuaucuauugguucuaaaauuauuaaaaaccuuaugaaucucuaauaauuuugauuaaauugaaaaugucauuaaaugaaauaaaugaccuaguuauuuuuauaaauauuuacauuuccagaaaauucaagcaauuuuaguacaaguaaauaauagcuuuuaucuguaauagcuaucuauaucuuuuuaaccucuauuuaaaaaaucuauuaauauacugguaaaacagaaacuaaaaaauuuuaaaacucuguuguagauuuuauuauuuuguuuuugauugucagguuaaaagaagauuccaagugagaaauuaugugcuuuucguuuuauucaguuagcaaauauuuauugacugucuacuauuuaaaagauagcguaugcuuggcacacagacacuccauaaauauuacacucuucucuuuugaaauaugcaaaggaaaugagauggugcaugcuagugccacuuuucaguuuauccauauucauuuguuuuguugccuugccgacgaguaauagguaauggacucaaguuauuaaaacaaucaguguuuuacuuacuguaggcucagcagugugugagacacuaagauuuuucucaaaaaaugcauguuguggccgggcacgguggcucacgccuguaaucccagcacuuugggaggccaaggcgggcggaucacaaggucaggagaucgagaccauccuggcuaacacagugaagccucgucucuacuaaaaauacaaaaaaauuaguugggcgugguggcaggcaccuguagucccagcuacucgggaggcugaggcaggagaauggcgugaaccugggaggcagagcuugcagugagcugagaucgcgacacugcacuccaaccugggcaacagagugagacacugucucaggaaaaaaaaccaaaaacugcauguuguaucuuuuuucucaugauccaacugguuugguuggcaccugccugauugagcacaguguuugggcccuccccaaaugcuugccauuuauaaugggcaccacccacaguggccaaucauauccauagaugaagguuuucuguauaggugcaguaagaguauuaaaaauacuuaguuuuauuuaauuucaaugugcuuccauuauauagagaaaaaaauucaagaaacauaaugaaaauauggccuuuuuaaaaaucaugaacaugggcauaaaagauaaauuguacccaacugcccuuuggaucaagaccaaauuaguaaaaaugaaggcgaauucuaugacuccgucuucacugauuugagaaugucagaaaugaacugauguguuuuguguauuucuuuuauuuuaacuauaaguuccuggaagaauaggaaauucaaccucuccugugugaggacugaaagcauaccugaaagcauugccacuguagucacccuguacuuacuacaguuguccacuauggacccauaauuuaaggcaugcuagauuauucacgccaacuucucaaaccaaacuauugaaagacaagaaauaagaucucaaagcacaaaccaugugagcaaggauuuuuuaaaaaagauuuuugucacauuauuuauuuuuucuacguuguucauuucacaugcaaaaacccuuucuuaaguuuauuuuuaauuuuuuauauuuuuuaagccuaguccuucucucaacuuguuuccacugaaaucauuauagaaaauuauuuugcuuuguucuacaaggacagaauguauuuuaacucuguuuaaaagaccuagaauucucuccuguuacagggagacccacaucaaguaccccaauuauugucuguauguagacacauucucaaggugcuuacuauagaauacaguggaacuuuucucauuugauaguuuacaucaccauuguaagaaggaagagaaacugggacauagguaauguuuucagugauauguaugggcagauauuccugggaagcuuuggucagaccuuuucaucacaaccacacucaucaaaucagaaaugaaaagggccuuagaaagaauucagucuagaccccuuguuuuacaaaugaagaaacuaaguuaguuuucaggguuaacaaagagugagaggcagagccaauaauauaacauaaucaccuuaucuugagccaaaugcuuuuuucuguuauuccauacuccuguuuugaaguugaauagugaggcuaggcacaguggcucacgccugugaucccaacacuuuaggaagcugaggugggcaaauugccugagcccaggaguuccagaccagccugagcaacauggaaaaaccccgucuauauaaaaaaauaaaaaaauuagccaguugugguggcaugugcccauagucccagcuacuugggaggcugaagugggaggaucaccuaaucccaugaggcagagguugcagugagccaagaucacaccacugcacuccagccugagcaagagaguaagacccuucucaaaaaaaaaaaaaaaaagcugaauauuaaguuauucugcuaguucucauagcacaauaguaaacagaaagugaaacaauaaccagguaguaaucaagcuuauuaacugauccauuauugucagugaugcuuuuuauggaauuagauaagaaaggaaguauuauauuauuaucauuuaguauuuuuaaaauaauaguuuugaagucuuauuuucugagguauuaaccuugaggaguauuuaguguuuacauuuaccuuuugcaauauauccuuuuggugacugucuucgucagugcacaaaucuuugauuuuauaguuuagaugauuagauaugagaaguuauccuuaucauauaugauuaugcucauguauaauuaugugcuaccuggauauuuuucucaaauaacaauggccuuaucaauaacccaaggauauaucaaguuuaaaaauuuuuuaauaacugaauuuauuuuguuucaguucagaaaaacccuauuuucauugacagcauaaacugaaauauauucuuacaugaaaucauuuauuuugcauccuuuuagacauuuguccauguaucuaaaaaugaacuuguuuuuuucuuuuauggaaaacaguaaggagaucugauuguauguauaauguauugaaauauggagcuacauaccaauauuauacacuaguauauaaagaguuuauuuaguauuuacuuuucuugucuugaaugguaguggaauaauaaaucccugaagaaagcacuuugguccauggaauacaaaugaugacuuugaugccuccugccugugaaguaucaaaagauacaggauuuuaacccccuuuggaaucacuugggggaaauaaugcaucuucuuauuugagaaacucucuaaaaauaaggaaaaaaacccacucaauuucaaaacagcacauuuucaaaaugucugaagcaugacaugucuauaaaggaauucuacauauaaaauagaaaaucuuaagaaaaggagaaaauuuauaguuuuugauauuuuauacuuaccaaaaauucugucuuuuagcacaaguaaaccuagguagcagggaccaagacugaaaauaauaauaaaccaacaaguaauggaaauaagcaaguaaacaaaaaugaaaacauucugcuagguaauaaacagauuccacaaacacauuauacugaaaaguaaguguaucaaagaguuagggagcaaaguuaaguuccuaauaaaaggauuguguugucagcuagaagcuuuaagcguuccaucuccagguuugguaggaugagaaggaaaauaagauauaucaucguguguccagcauaguuccuugaacaaaaaaaaagguauuuaguagguaaugaaugaauuaaugaauaaauuacagaauagauaaauuaguguagaaguagaauuuuuuucaaugagaugauaaauucuuuguagcuaugaaaagcagcugcaaccuuuguuuucaaauauguccccuauaaaaauccacccacccgugagcuacucaguuaauuuaugucaaggugaugcacaaguuccuacuugccaaaacaaaguucagcacucucuaaaggaagagaacaaaagcaaagcagaaucgacaaaaagaaaaucuucacaucuuuaagagacaaccauguucaguacaaugacaaagaaucaaauggcacuuuacauguauuugcaggauacugugucacucaaaguaaugggagggagagagaacagggaggguagggaugcuuuugaaaaagcuuuuuuucccacuuuuaacuugcuuuagcguuaagaguacuuaccagcuaauaauguggaggaaauuauucuuucucauuggagauuacagaauauaucuauucaucuugaauacccacuugaagccucuguagaaaugucucguccuccgguuguauuucuaaaaccuacaugauuuugucuuguuucugcagugagaaauuacauccauagcaaagacaaaagucuuuuuaaauuauuuuuauuuaucuuucauauaguucuuacaauuucuaaaaaauuaacacucauuuaguaucacaauuuaugggagaggguuuuuuguauuuuuaagcauauguggcuuauauaaaaauugcagaagucauaggacugucauguauugcagcucugagaaccaaugccugaaacuuaagccaaaaaaaaaaaaaaaaaguuaugaccaggcacgguggccucaugccuguaaucccagcacuuugggaggccgaggcaggcagaccacgaggucaggaguucgagaccagccuggccaauauggugaaacccugucucuaacuaaaaauacaaaaauuagccgggugugguggugcgcaccuguagucccagcuacuugggagggugaggcagaagaauugcuugaacccgggaggcagagguugcagugagcugagaucaugccacugcacuccagccugggcgacagagcgagacuccaucucaaaaaaaagaaaaaagaaaaaaaaguuauaaaauaauguauaucaguuaauuuaguauucugaaagcaaggguuuucuaaggucuuuuuaaaaaugaggcuucauauuuugaauaccuuucagucccaguguuugccuccauaacuugaaaaucggaguaguucaggugguuuugaguucuaauguauugucauaguggggaaacauugcugccaccuucuguguuggucuucuucccuuagccuucaacacucucgggggacuuuucuguucucuguuguguccccaucuuuuuguuuguuuguuuuuuaagaaaccagguugugcuuagucaaugauaaaacuagaauuucucccucacauuauuaucuugugauaagauaaagcaguauacaguuaauuaacaggguuagaaauccaagauucuuucucuuccucugggaaaauauuuagcuaaaaaugucagugagcccaauuguaagccuuaaaaaaugguggcuuugagucguggaucuuuguuucguuucacugucucagagcacacaauacaugugaagggcagccuuguugaagcuaaucucuguuuucaugggaaagguaauuugaagccaguccuuuugauuccuauagaaauaugaaauaaaguguauguauguccacacacuugugugcacacaggcacagacacacaacugcaaacaaugugucuuccaacuuuaacaccaaacuucauuuugccuuuguagcgggaaccuuggggaccuccacucauuccaggcccauuuuccaggauuggaaagcuguacacagagaagcagugacauaaaguuauucagauucucacucugauagucaucuaccacuugguggucugaagcaauuaauacgguuucccagagacccuaacuuucuauaaguuuauccacuugagacuacuaauaaacaaaaaacaaaaugucuaaauacuaugacagaaauccaaauauugcagacuuaucugaaauacgcuuuucaauaacuucccagguaaacauguauuuacuuuuaaagcuauucugucuugaauuuguaaggaucuuugcaaaacugaaugauauauucugaauuuugaaaagauguagcuucuuaggcauauuuuacaguuugagaauuuuauaaacaauuacuaaugguucauuacuuuuguaauuaaaauacagauuugcuguuaugcaauuuaaauuacuuuuuaauuuuaccucacaucugguaggaacuauaacaaauugaauuauuuauguauuuauaaguacguauaagauaauuauguuuuuuaaaaguagggugugcagaauuugaagguaaauucacaguuauccucaaauaucuucaauguguauguagaucuuaauuucaaaucuuauagcaaaaaaauucaauauuuagccaacuuucaaagcauguccugaauagauuauuuuguauguuagugaaauuaguauguaauuuccuuuguuaaaaaaucuccauuuucccuccacacagugaauauggccacaagcaggcuaauaggggccguggccggcaccauucuggcccugggggugauuuuuggaggcacaggguggggaauagaguaagcauccuugccaguuucagaguguuucuguguggugccugaugugugaggcgaugccuguaccugacuccaugucucguccuguugaccguguuuccugugguagugcaccuuguggugugacuuggauguugcuuguguccugugguuuucuugugucauguagaaccuucuccugucuggaacaauguggggcauaacauaacacugggugugcuuccgauaucuucauaauuaaggcaauagucccaacacuuccauugcuccuccacuuuguagaaguaauuuuaaaauacagacuuuuuuuuaaaccauuuauuggcaaaaaugcuuuuauauguguguuuucuuaggauucuuguaauaaaguuaaucugugccagucaaauaaauuuacauauauaacuagcaauuaucaacaguuauaggaccuuuuaaagguaauaaaaaugauagcuacuaauguuuucuucauuuauuuagaaugauauaggaggcugcagcuuaauuuuuuaaaaagaagauauuuagcauacugccuuccuauuuuuccuauaaaauagguuaauaauucaaaauugaagucuacauaaauauuuggaagcaaggagcauuaagaaugaaaaaauauuuaauccaaaccuguauaaccauaagugaacagcugcaaaucaccugguggguucgucuuaaaaguagccaggguguaaauaaauauauugugugccacuugcccauuaagcugucacagaaauacaguucuccugaugcuuugauuuagggugcucuguacuugauccacauccucagaauagcugucaguucuccagggcacauugcuuccugagauugcuaaucuguagauuaaaauauuaucaugauuuuuuucuucucucucuaauuagaaaaagaauauuuaagaauggcagacauaacccuuuacacagucuuuucugucuacuguggugguggugguaacacuucaaaguggcccaggaaugaauuacuaguaucuucaggaaucacuagauaucuuugacucacccaucccaaaucaugggcuuauugugaauaucagauauguuuuucuauagucccauuaguuagaacaaaugggugcuccucuuacacacuggaauugggagacccggggaccaaaauagcauuaagagggaagcagguucauaguucacaccuuguguugaagaugacaugagccuucuuucuccuggauucaaggacuuugaccagacuuagaucuuccaacucacaucucaucucuauggacugugaagcugguuagcacaggggaagcuagaaauacuagaaaagagauuuuguuucuccuuguguauuagaaaacaaagaccauaacagggauaaaaauauuuagagacaaaaacuuuguccuguaaaauuuccccuuggaucuguugacuggauuguauacagaagaaacauuccuuuuucagggccagcuccaugcaugcauuuaugugaaauuccuccuugacaaaugguaguuuucugaaaaucaucccaaaugcauuuuuuaacauuauacauuggcuguaacuuugguguccuuaaauguacuaauugaaaggaugaauuuuaauaauccuuccuugaagucuuagagauagguaaaaaucaaagaggccuuucuuguaaaacauaguccuuguuaucagcauuuguuuucaucaaucauuuccaguuuuguucguuugugacuauuucuaauugugacagguaagucuguguaaguguauguauauuuuuucuaaagauagauuuguuauuauuccugguuuaugagcacuaguuuucucuuagcuuacugauuuuuuuccccaucaaauuccaaguuuuagcauaauugcucaagaaauauaguuuuuuaaaaaauaauguaguacaauauagauugucucaacauuucuuaguuuaauugauagaguaauguucauucagucacuaagaauuccauggacaguuuuuuuuuuaauuucuccuuaguuuauaagucaggaaucauuuuucaugaauuauguguugauucuaauccuagccuguuuucugaagcggacgaagugcaaaucauauccaaagcauagaguauguacaugguuauauauuuuuuuaauauuuguuuugaaauuugauucucuguugaauuguggggaggaaauacauguaaguagaauaaaguuucucuaaaacagaaguuagcaaacuucuguaaaaggccagaugguaaauaguuuuagcuuucagccuacaggguugucuguaacaacuucucaacaaugcugucuuagcaugaaagcagccauaaacaauauguaaaugaaugugcauggcuauguuccgauaaaacuuuuuugcaaaagcagacaguggggcuagauuuggucugugggcuccaguuuccugacccuugacuuauaggauauguuuuagggucagacaaaucuguguucacaucuugccgcuaucacucacaaacuucuagaagccuguuuccucauccauuaaacaaggauagucauaguucccaccucauacgauuuuuguaaagaucaaaagagauacuauaugucaaguguucaguacuguguccagcacauaguaagugcacaauacgguagcuguuuaaacuauuuuuauggcucucauuauuauuauuauuauuauugguguaucucuaaaggcaacugagauucguucucuagacggucagugguuagucuuaagagcaugucacaagcccaggagccuaaagagaccugcaccccgagacuguauugcagcuguccucuaccugcccaccaagcacuggauggucuccgaauaaaaacacauuaugcaugcaauuugugugcugccaaaaguggcauccauuuauguacacaguugagggcacugaugugagcagaaaagagaauuuuuuacacagaaaugaauguuuacacaaaacucaaggauuuucgggaaacuagcaacauuggcuuugugauuccuggagcagggauagauaggacugaaaguauuuuguuguuaggggacacuguaccugcauguuagcauccugaaggaugggauauguaaaguaauuauuauacuagguuuaacguugcuuagauuuuaaaaugcuaagcuuaaggagaggagugagcgaguggacaggaguuacuaggauauggauuagcucuuacccuuagcaauugauagaaaugccaccuugucuuuucuuucuuacuguccuuuggcucucugcuuuuuuauaucucuaagccugaaaguucuguuaguaacaaugggaacuuuaaagcuauucucaguugaaucuaaggaaucuuuuuaccauuuccccaaaauuacccaaaugagauuuaugcuuccuuauaucuugccuuuggaaccccauuuuggucuuuaccacuguaaggauagugaagaaguguaucuuugagagcaaggcuucaaaagucagaucuguauugacuuccuucugacugcuaaguuuuaacuguuuccaaguggggaauuaaaaaguuagcauucagaccacuuuuaggugcuuuuuggaagggcauuguagcagaauguguuuccuuuccuccaugcccccauuugugagucagauggagcuugucugaaugcgaugguguucucucugugcuuuuacuuauuugauacaugauacugggagaggggaagagaagaaggauguguaaagacagcaaguggggccuauuugcuucaaauucugugaaaggugaauuuaauggaacuuaauugucaauggugcagaaacuuuagauuuaaaggcauauaaauccaagcaacgcucaccguagcaucuaaaaugcaauuaagcuaaguaaauaaaggcaauuuaaauguuuagccgucuuuuacacaggauauuuacuuccugaaacugcuuaacugccuuucccuugugguaacgaaagugguugguucauaugacucucuucccaugauccuuugucacagguccuagugccaccaaucucauaauaggcuccaucgcuggugccauccugguagcagcuauuguccuugggggcacaggcuggggauuuaaguaagcaacgccgcaugucuucuucucaguggcucuggcauuucucuuuucugcuuacauaaccaaguuuugaguuccugcuacaagagcuuagguucugucagucaaacugcaaaaaauaagucuuuuuauucagaaauggguuagaaaugaagaaacacggacccucaacugucauuuucaggcaaguggaaauguagaaggaauucauauacacugauuuuuaaggagaacaacgaaguucuuugguagaagacaguccagcuuguaagagcaggcacucugagauacauucauuucuacacaggaaaucgaggaaaccauguaguuggaaauaaguggauguaaauugcuuguaucuguuuaaaacuuguuuguaguccacugauauuuugaaauuuucacaaccuaaguaauuaugcaaucauuacuuguauuuuucauauguaacauaguauauguagcuuugugauuugaaaagcuuuauaguuuaaugaaaacagauuuuaaaaguauuuguauaauccucgaccaacugaauugguuuuaaaucagaauuugaaaaauguggcuuugugacacuuaguauuuucuaaucaaggacuaaauauugaccugacagguaggccugguguguuuucauagugaccuuuuaguuuggauugcacacugcuuacugaacuaagauuguuuaaauagacacacuggguauucacaaauaaacuucaauugugaucaaaauuuuuaaagcugauuuauccaggcuggcuauuucuacacuccagaaucauuggauaauugcuuuuuauaccuuuucaugcuauagugaguugaugauuaugauuuguagguaagcccuccugugccuccugugauaaauuuucagccagauucacagaaacaaauuuaagugggaaauaagaccauuacccaaauucaaaacccacuuugccugcaucugguuacucaaaagaggaagcuuuugcccugaacuaucugaauaauugccuuaauuauaaacuuuauauguuuuauauuugggauuuugaauucaauauguuucagccaguuaaaguguuauuuuuagaagcugauuaaagaaaccaaagaugauuuaaauacauucaacauuuucugcuaauuuguuaucauauuaagauuuauugaguaagucuacaguuuuggagugccuuuaacuugaaauaguauuauaaaauuauacgucuuuucucucgguauauuuguagaguugaacuuguuuaguaauguagucuuggcaucaguguguuuucaaaaacacacucauaaaauggacaacucauauuuaaauuuauuguuuugguauuaauaaaauauugcccacauagugagucacgcauguggcaucuaguaagaaauauguuuucguuugggcggaccuaauucaagcaaaacuuuucuuaguguuccacugcuacaaaaaagucauugaacauuauaguacugccauacucuuauuauuuuauaaugcuuccuugaacuuuuucauuaguaugccucaagaaaaauaaaucuggaucaugcccaggcuuaugccucauuuggcguuaagaaaucccgguuucaaaggccuggaaaacagucuauuacacgucuuugccgucuagccauaugcaaugccaaauuuaucauugcaguguuucgagagaagagcacacuauucuguagcaggaccucaaaacaguggccuggccuagcucacagcuugaauugcauguuucuuuggggaaaaauggaaaagccuuuaucacuguguauauaaguggauuaggcccuguaaagauucuuuauaucugagagagagagagaucucguuaucacaagaacagaaaacaaaaggugggggaucagcacuuagugagaugagaaacagccuuugcugacugcugccugguuguugcuguguagggaccuguacugcugagcugagucaaagccccuuccugugcccuguaacucugauaaucacuuucagggagaacuguguagaaagacacacaauagggugaaguauuucaugccccgaagcaaagaaaacgaugaagacuaagaauaauuccagaacauguaacuucaggaguuuaaauuuggagaaugugcuacuccugggugacuguugguugcuacaugaggaccuuaauuugcuuuagauuuuaguaguaacugugugguuuguguucagcuuuaaauaacacuucuaccuuguaauaaaaggcuuuuggugcugaaugauaauguuuagauuuucccaccacuuggacaguucuggagauuacuagucuggagauaauucguaaguauaauuauuugcuauuugaacugaaagccuuuggguuugaguucaauguaaauguuuaaaaagaaauuccuuuagaaucagaaguugaaaauaguuuguacaaaagauuguucuaaaugcugcuauugggaaucccuccugauaccagguuuuuauuucuagaagaaaaguugguaagguaaccugaacaauuugagggcaugucaacuuuuugauuaaaggaaaauacaguaacuacucagggaaaauacuauauuuuccuaaugucacauuucuuuagguguacuagugaguaguuuagauguagaaguaucauacuauacgugaccugcccaaguauaaaugagaaauacagcuaugcucuaagcccugaccuugucugccauucuuuaaaguucuuuccuuaaacuauuauuuccucugaaauaggugguaaaaagcaugaaaaugugugcauguaugugaaugugugcacauuugugugugugaagugauaauaaagauguaucaagauuauuauaaucugaaaauaauacugauuuaaauuacauacuuccuuuuaguagauuaguugagucagaccgcuuugguuaaugcaagcaagacuuccacaagcaagguuguggauuuccugaagaauuuuuaaauguuuuauuugguagauuuuuaaaaaauauugucacauauuguguaauguuauggguaguaacuuugcuuaauuucuuuuucuuuuuuuuugagacagaguuuugcuuuuauugcccaggcuggagugcaguggcaugaucucaguucaccgcaaccuccgccucccagguucaggcgauucuccugccucagccuccugagcagcugggauuacaggcaugcgccaccacgcccagcuaauuuuguauuuuuagcagagaugggguuucuccacguuggccaggcaggucuggaacuuccaaccucaggugauccgccagacucggccucccaaaguguugggauuacaggcaugagccacugugcccagccaacuuugcuuaauuucauacuccagaaguaugagguuacuaaggguaugauuagucguagagucccagguauugagggucuuaggaauuucucuaugaaauccugugaaaaacgaacauaggcauguggcacaccaauuugcucuacuucuauaucugcauuuauuuucauucaccccaugcuccuguucuuccccaucacccacacacaagaauaaaguuaugagcuguggugcagaggauugcaaaccucuguccuaguugacucauggagacucaugacaccuacccaacauuaaaugaugauacugcuugauucgacuguuagagcuguugcuuuuacuggacauuagaaaaagcaggaccauuuuaguagcaucuucccuaaagcuuaggaaaggugaaaaguauaugaaaagagaauuucauaucuccauuuaaaagugaacaggauugucuucagcaccuuaggcguugcuauuuaucugauauucccuaaauuugaauguaggguuuuacaugcacauuaguaggugauggugguaggaaaagagaaauucuaggugaugguaggaaaagaaaugaagguaauagugacaugguuuguugaaaauugaaaucaaaaggacuacaggaugaacacugagcuuuuccagugauaccguaacaccucagucuguagaaccucaucaccacgucuuacucucccgcuacuugcccuguccaugggauucaguggcaaaguggauuucaucaguggccauacuggccuggcauagcuacuccuuacauuaaaaguguuaauuuaauauuaauaagucuguguaauuaucauacgugauuccuucucucugagaaguuauuuguguuaaaagcucuucugagccugacucuggauuuaagagauucugucuggccuacguuccauuuuauuggacauguuaaagaaaaggcuguuuauguacucacacaaaaugaaaaagagcuauaucuagacuauuaccagcaaaguuaagaguuaucugaagcugggcaugguggcucaugccuguaaucccaggcugagguggacagaucgccugaggacaggaguucgagaccagacuggccaacauggugaaacccugucucuacuaaaaauacaaaaauuaaccgggcaugguggugcacgccuguaaucccagcuacucgggaggcagagacagaaucccuugaacccgggagacggagguugcagugagccgagacugcgccauugcacuccagccugggcaacaagaacaaaacucugucucaaaaaaaaaaagaguuaucugaaugucaagucagauaaaauuugaaaggaacuuaauauuguuaauuauauuuucucaaaagaguaaacaccauuuuuugugggggccuuuugauuuuuauugaauuaggaaauugaauuaaauuuggcuagucuuuccacgaggaggauaaccagacugcuguuuuuuugaauuccaugacuguaucccaguucaaaaugagaagccugauucccuuaaugccugggacuccuggguuaggcacuuucucuuucaugguaccaggcuggccaggaagaucggugcauuucccugccccagcgccccagggaagugagcucaguguaugguggccuaggagggguugggcuagggacacuucgucagggggugacucagcauagaaugauaagaaugugcuaaccauggauaaauauaugcccuugaaagaagaacuaaaggcuuuacggcucugagacgguuauuguuacugaaagagucuugcuuuaauuuuguguagauguuauguguauaauguauauuguagacaaaaguccagauuauuucagaaguaguaaaaauggaugaaagcugugaaaauguaagcuuuauggauuaugcuaguguuuuauaaugauccagaaauaccuuacagguuaugagaaaguuaauuaccuucagaauccuagugagcggaggguauucagaggaaaccguuaugaagaaagucagcaaggaccugcccgcaguaguuguacuuucacauuaaaauugaacugaaagaauauuuuuuucauagagaaaauucagaccguucucaacauacagugacugugaugguuuuacaauuuaugugugaggcaccuucacaguccgcuugccacaggaguguucaucucuguccucaucgcaguguggccucccuuguagaggagcucacuuucccccugcugggacaucaguggaagagcuaagguccuggaaugccccauugguguucagaguccauuuucauccagaaagauacaguucugcaggauggcucagccucucugucuggccugggaacccagugauccuguagagcaauauuucugcaaaaaggugcaaccuaagcuucaaaaaccagcuuuuaaaaagagcacaagcuuuuggacaccagcgguugucugugugccaggcugaaauggaauuuccuaucuccauuuaaaaguggacugcauugcuguuacgaccuuggacauggcuacuuaucggucauucccgaauuugaauaaaggaauuuagaugugggcaacaugcacagugcuagcuugguuugcccuuuccucuacauuuggauuuacugaggaaauuuaguuuaacauuuaucuugaguucuagcaauacauagcucacaagauuggggccucuuguccuucagggucauuucacaaggucaggcagucucuguuuuuccucccugacucacagaguauggcuccuuaaaccucuaccuuccagggauaugaacauagguggcagauggagacccugugcucugcagcaaacuaacuugguggaggaugcauuaugggauacuugccuuuugguuucacauugguuucuugggcagcaucagcagugcccgcuuucaagaauguugacuuaaaagagggcugggugggaaugaugaagaaaaguaaacagcauuguugcagauaguguuggcugcaaugguuaccugcuaggccaaugagucacacacuuaggucacucaugaagacguuuuaauguaaacuuuaaaaagaaaagacaaguuuucuuuaaagacuuuuauguugauauuucaaaagagaagcaucaaagugaccaucuugggaaaaauaagaacuuugcaggaugccuuuauaccuauuuugagcuuugguauuguuuuuauuuugaauuacuugugggggaggaggaauauaucgcaauggcuuugauacuuagggccuguaaggguauccagcuggcccucagucggugggcaggggagugagggcuuuggggacuccucagucuccaguuuugcaugaugccucgguggcaguagcguugcacccgcccaguaugcagacuaaaugcaugagccccuugcuugaugccccacauaaagccagaccauggggagguugcaaccaacuuuuacuguugccuuguagugucuugcugguucuuucuuuucucuuuaaacauaggagccacuuuuuaggagacuggacacugugagcaaagcauuuuaacuugccgauuuucaacuaagcuaaauucugcauuugcuuaacuaaccugaaccuguguccacucuccuuugaguguacugucuuacugugcacucuguuuuucaacuuucuagauauaaaaaaugcuuguucuauaguggaguaagagcucacacacccaaggcagcaagauaacugaaaaaagcgaggcuuuuuugccaccuugguaaaggccaguucacugcuauagaacugcuauaagccugaagggaaguagcuaugagacuuuccauuuuucuuaguucucccaauaggcuccuucauggaagaggccuuccuguaauaauuuucaccuaaugaauuagcagugugauuauuucugaaauaagagacaaauugggccgcagagucuuccugugauuuaaaauaaacaacccaaaguuuuguuuggucuucaccaaaggacauacucuaggggguauguugugaagacauucaaaaacauuagcuguucugucuuucaauuucaaguuauuuuggagacugccuccaugugaguuaauuacuuugcucuggaacuagcauuauugucauuaucaucaccauucugucaucaucaucugauuaauauuguggauuuucccccucugcuugcaucuucuuuugacucacucuggaagaaaugucaagaagagaagguucgauccuacucagcaaggccccaucugaaucagcugcgcuggauggacaccgccuugcacuguuggauucuggguaugacauacucgcagcaguguuacuggaacuauuaaguuuguaaacaaaaccuuugggugguaaugacuacggagcuaaaguuggggugacaaggaugggguaaaagaaaacugucucuuuuggaaauaaugucaaagaacaccuuucaccaccugucaguaaacgggggagggggcaaaagaccaugcuauaaaaagaacuguuccagaaucuuuuuuuucccuaauggacgaaggaacaacacacacacaaaaauuaaaugcaauaaaggaaucauuaaaaaaaauaguaaaugauuuuuuuucccucagccugcuggcacuuaauaucuucuaaaugauuuggcaugauuuuuuuuucuuuacuaccgaugacaaacuccaguggcaugaagaucuaauuuucaaaaggguaaaaacugcauggcauauauacaacaagcuagcaagccaauucucagcaaaaccugcaacagaauuccuaaagugaagaugacagaugaacacaaagaagcugccugggccucuucacuuaaacauguccccacaccccauccucucggagccccacuucuuaccccccaccucccacccucuauaauccccacuccccauuggagaccaggccagggcagaacuccacggaccuugcucuuguugauucacuuuccccauuguguuuucuccuggacugagcauccuuuggaaaugggagcuggaauuugaacaaugaugcuauuguauaguucuuuuauaaauguaaauauggaaauaagagauuuugacacaucauuuucacuugucuguauugagauauuuuccuuguaaagguucucuguaaacuugaguugauuuuuugcuccccaucuuuuuuguuucuugucucucuuucucugucucuguccuucucucuuguaacguguuauacaaugacucuugggcuugcuuaaaaagacagauauagccacagaugcagggaguuugggcacaaaacacgugcaguuuaaaguuggugugcguuaaaccaaaaauaaaaggggggacauaaacaacaaaauaacccauaucaaagacacaaaauuauguaaauggaaauauauguacuaaguuucgaaaauuuuuugaugucauuauaaaccuauguaaauaauguaagaaaguagacacccuuucagauuaaucacaaaagugccaagcucaugauuuugguuuucgguuuugacaauuuucuuucccugucuuuaaugugaaaggaggauaaacuuaaagccuuaaauaaaaaaauuuuuuuaaauguuaaaagcuuggaaaaaauuaagcuuuccauuuuauuuguauuuguuagugucaauauuucauccaugcucauuuuccugccucaaaauauauaugguagaacccuauuggaaaagugguaaugggaauagaaggagcaguuaccuuuguauccgcauuguuaaaauaggcuuuuaugcugugcugugcuuucaagaaaccuuguuugaccucuggcauuuuacugaucaguggaccguugcacuggauuauaaugggauucuacuauauacaaauccacauuguucuucucccuccagccagauuugcagauguaaucugggcuuuccaagucccucugaguuuccuucacuuuuacugauuuuuuucuucuaaauauggucaagauagcuucugucacauguuaaguaaauaagcugaagaaauuuggucccggcuuuguuuuaauguacaaaccgguaugugaucacuucagugagcaucccucuauagaugggcuuuaguaaagacugucccaaagagccccuacuucucuaaugcccccccccuuuuuuuuuuaggaaaagaacaugcaguuuuacucaucacuucuucaugacaccaaauccauugcuagguuuagcuccuggucccuuuucagcaagauucauguuauccgucuuacaacuuugauuuuggaaaguauuauguccuaaaaaugcacugcuuaacacagugggguuuuuuucccccgaggugucuuuaacuggggaaguaccacaaacauagagcagagacuuuaauuucuauauucuacaauagaccaucaccaaacaucuuaucauguuguugcuuucugaguaauaggugcuacgcagguaggcgggcuuucucuaggacuagguguacguuuauuuuguaauaacagggcuaucuacaaggccucucagccuuacuccuggcuucauaggacacagguagcaucccucuagucauuggcaauggcucuuucagcucggaggaagcuuggaggaaacucagauuacuugguaucuuuuccuguugcugcauugcuuaguguuuccuuguugcuggguccuacucucuaguagauacuaaacugcugugaaguacaccauacacauuucacuaagauuccagagccaccuuggugacauaacagaaacaaaaucauguugguuacaaaacaaauuaaaucucuauuguuaacuuuuaagcauuucacaaacaacauuguaaaugugcgauguuacguuuuaaaucagaccacagugguccccaaauauuauguacauauggcaaaugucaguguaacuuuuuguuacacuggcaauuucauagguaaucgaaccuaugcuccaauguuaaauuauuuguguauauguaaaauacacaagcuuuaagcuauguguguaugaauaugaaaguuaaugcaaccauaucaauuguaaaaauggauuauaauuauuuuugaugguauuagguuauguaguuucaaacucuuugcuguauuuuguuuugcaccugccauucauuugcuaauuuuuguggcguggagauucuuuuuuauuaauuugagcucacagcacaaguguaucacuguuuaauguuacccaacaagaguuaguguuaagugaugaucaaguucccauuucaccugcucuacuuuugcugcauuaauuaaugacacccggaugaggagacgugcgcuaacuucauugcucaucugggauagugcaugagcccauugaauuagagcugcuccuacuagauaacugagcaguacacauaagugcauguuaugaaacaugaaucacauagagcaguggaguuuuaccaaguggugugugugguuuuuguuuuuuacuaugcaaagaugggaaaugcacaaacuuuucaaagacuagugucugaagaacuuuacaaacaauacuugaacccuuucuuuaaaguuaucccaucauguuuuauagucauuguugcuuccauuguuaguuuccauuuucaagugcuuuguaauuuuuuaagugcacuaccugaaauuuuguuugaaauuaauaaauucauucguaucuuguuggcugccuaugaauggagauucaguagucauuguaugcaucuuuaagucaaauguguauuaaaacuuucguuaacguagaauguuguagcuuuaugcuuuaaucauuucuuuuaaacccccuuuucuguuuccucuuguagugcugauuaaauggccaugugccugauaucaucagaguuuuagcauggauccaaaggcuuacugaaaauuuaagcagucaguggcacaaaauaaaaucucugauuaaugauaaauauaugccugauuacgauucaguuuuauuggauucauuggaauuuuuugcuucuuauaaaucagaaaaaacccuaccuuaggaucgcuuagagauuuuuuuuuuuuaguaucucccuucugaguuuuaagaguggauggcuaguaauaacauccacacuuuggaccugguaccaaauuuguaaucaagcaacaaagaaaguagaaggaaaucugguuauauaaauuguauuauaaaaaacauucuaaggaaggcauuucuuca

SEQ ID NO: 12724 - RNA, 178216 nt, Homo sapiens
ugaagaaaugccuuccuuagaauguuuuuuauaauacaauuuauauaaccagauuuccuucuacuuucuuuguugcuugauuacaaauuugguaccagguccaaaguguggauguuauuacuagccauccacucuuaaaacucagaagggagauacuaaaaaaaaaaaaucucuaagcgauccuaagguaggguuuuuucugauuuauaagaagcaaaaaauuccaaugaauccaauaaaacugaaucguaaucaggcauauauuuaucauuaaucagagauuuuauuuugugccacugacugcuuaaauuuucaguaagccuuuggauccaugcuaaaacucugaugauaucaggcacauggccauuuaaucagcacuacaagaggaaacagaaaaggggguuuaaaagaaaugauuaaagcauaaagcuacaacauucuacguuaacgaaaguuuuaauacacauuugacuuaaagaugcauacaaugacuacugaaucuccauucauaggcagccaacaagauacgaaugaauuuauuaauuucaaacaaaauuucagguagugcacuuaaaaaauuacaaagcacuugaaaauggaaacuaacaauggaagcaacaaugacuauaaaacaugaugggauaacuuuaaagaaaggguucaaguauuguuuguaaaguucuucagacacuagucuuugaaaaguuugugcauuucccaucuuugcauaguaaaaaacaaaaaccacacacaccacuugguaaaacuccacugcucuaugugauucauguuucauaacaugcacuuauguguacugcucaguuaucuaguaggagcagcucuaauucaaugggcucaugcacuaucccagaugagcaaugaaguuagcgcacgucuccucauccgggugucauuaauuaaugcagcaaaaguagagcaggugaaaugggaacuugaucaucacuuaacacuaacucuuguuggguaacauuaaacagugauacacuugugcugugagcucaaauuaauaaaaaagaaucuccacgccacaaaaauuagcaaaugaauggcaggugcaaaacaaaauacagcaaagaguuugaaacuacauaaccuaauaccaucaaaaauaauuauaauccauuuuuacaauugauaugguugcauuaacuuucauauucauacacacauagcuuaaagcuuguguauuuuacauauacacaaauaauuuaacauuggagcauagguucgauuaccuaugaaauugccaguguaacaaaaaguuacacugacauuugccauauguacauaauauuuggggaccacuguggucugauuuaaaacguaacaucgcacauuuacaauguuguuugugaaaugcuuaaaaguuaacaauagagauuuaauuuguuuuguaaccaacaugauuuuguuucuguuaugucaccaagguggcucuggaaucuuagugaaauguguaugguguacuucacagcaguuuaguaucuacuagagaguaggacccagcaacaaggaaacacuaagcaaugcagcaacaggaaaagauaccaaguaaucugaguuuccuccaagcuuccuccgagcugaaagagccauugccaaugacuagagggaugcuaccuguguccuaugaagccaggaguaaggcugagaggccuuguagauagcccuguuauuacaaaauaaacguacaccuaguccuagagaaagcccgccuaccugcguagcaccuauuacucagaaagcaacaacaugauaagauguuuggugauggucuauuguagaauauagaaauuaaagucucugcucuauguuugugguacuuccccaguuaaagacaccucgggggaaaaaaaccccacuguguuaagcagugcauuuuuaggacauaauacuuuccaaaaucaaaguuguaagacggauaacaugaaucuugcugaaaagggaccaggagcuaaaccuagcaauggauuuggugucaugaagaagugaugaguaaaacugcauguucuuuuccuaaaaaaaaaagggggggggcauuagagaaguaggggcucuuugggacagucuuuacuaaagcccaucuauagagggaugcucacugaagugaucacauaccgguuuguacauuaaaacaaagccgggaccaaauuucuucagcuuauuuacuuaacaugugacagaagcuaucuugaccauauuuagaagaaaaaaaucaguaaaagugaaggaaacucagagggacuuggaaagcccagauuacaucugcaaaucuggcuggagggagaagaacaauguggauuuguauauaguagaaucccauuauaauccagugcaacgguccacugaucaguaaaaugccagaggucaaacaagguuucuugaaagcacagcacagcauaaaagccuauuuuaacaaugcggauacaaagguaacugcuccuucuauucccauuaccacuuuuccaauaggguucuaccauauauauuuugaggcaggaaaaugagcauggaugaaauauugacacuaacaaauacaaauaaaauggaaagcuuaauuuuuuccaagcuuuuaacauuuaaaaaaauuuuuuuauuuaaggcuuuaaguuuauccuccuuucacauuaaagacagggaaagaaaauugucaaaaccgaaaaccaaaaucaugagcuuggcacuuuugugauuaaucugaaagggugucuacuuucuuacauuauuuacauagguuuauaaugacaucaaaaaauuuucgaaacuuaguacauauauuuccauuuacauaauuuugugucuuugauauggguuauuuuguuguuuauguccccccuuuuauuuuugguuuaacgcacaccaacuuuaaacugcacguguuuugugcccaaacucccugcaucuguggcuauaucugucuuuuuaagcaagcccaagagucauuguauaacacguuacaagagagaaggacagagacagagaaagagagacaagaaacaaaaaagauggggagcaaaaaaucaacucaaguuuacagagaaccuuuacaaggaaaauaucucaauacagacaagugaaaaugaugugucaaaaucucuuauuuccauauuuacauuuauaaaagaacuauacaauagcaucauuguucaaauuccagcucccauuuccaaaggaugcucaguccaggagaaaacacaauggggaaagugaaucaacaagagcaagguccguggaguucugcccuggccuggucuccaauggggaguggggauuauagagggugggaggugggggguaagaaguggggcuccgagaggaugggguguggggacauguuuaagugaagaggcccaggcagcuucuuuguguucaucugucaucuucacuuuaggaauucuguugcagguuuugcugagaauuggcuugcuagcuuguuguauauaugccaugcaguuuuuacccuuuugaaaauuagaucuucaugccacuggaguuugucaucgguaguaaagaaaaaaaaaucaugccaaaucauuuagaagauauuaagugccagcaggcugagggaaaaaaaaucauuuacuauuuuuuuuaaugauuccuuuauugcauuuaauuuuuguguguguguuguuccuucguccauuagggaaaaaaaagauucuggaacaguucuuuuuauagcauggucuuuugcccccucccccguuuacugacagguggugaaagguguucuuugacauuauuuccaaaagagacaguuuucuuuuaccccauccuugucaccccaacuuuagcuccguagucauuaccacccaaagguuuuguuuacaaacuuaauaguuccaguaacacugcugcgaguaugucauacccagaauccaacagugcaaggcgguguccauccagcgcagcugauucagauggggccuugcugaguaggaucgaaccuucucuucuugacauuucuuccagagugagucaaaagaagaugcaagcagagggggaaaauccacaauauuaaucagaugaugaugacagaauggugaugauaaugacaauaaugcuaguuccagagcaaaguaauuaacucacauggaggcagucuccaaaauaacuugaaauugaaagacagaacagcuaauguuuuugaaugucuucacaacauacccccuagaguauguccuuuggugaagaccaaacaaaacuuuggguuguuuauuuuaaaucacaggaagacucugcggcccaauuugucucuuauuucagaaauaaucacacugcuaauucauuaggugaaaauuauuacaggaaggccucuuccaugaaggagccuauugggagaacuaagaaaaauggaaagucucauagcuacuucccuucaggcuuauagcaguucuauagcagugaacuggccuuuaccaagguggcaaaaaagccucgcuuuuuucaguuaucuugcugccuugggugugugagcucuuacuccacuauagaacaagcauuuuuuauaucuagaaaguugaaaaacagagugcacaguaagacaguacacucaaaggagaguggacacagguucagguuaguuaagcaaaugcagaauuuagcuuaguugaaaaucggcaaguuaaaaugcuuugcucacaguguccagucuccuaaaaaguggcuccuauguuuaaagagaaaagaaagaaccagcaagacacuacaaggcaacaguaaaaguugguugcaaccuccccauggucuggcuuuauguggggcaucaagcaaggggcucaugcauuuagucugcauacugggcgggugcaacgcuacugccaccgaggcaucaugcaaaacuggagacugaggaguccccaaagcccucacuccccugcccaccgacugagggccagcuggauacccuuacaggcccuaaguaucaaagccauugcgauauauuccuccucccccacaaguaauucaaaauaaaaacaauaccaaagcucaaaauagguauaaaggcauccugcaaaguucuuauuuuucccaagauggucacuuugaugcuucucuuuugaaauaucaacauaaaagucuuuaaagaaaacuugucuuuucuuuuuaaaguuuacauuaaaacgucuucaugagugaccuaagugugugacucauuggccuagcagguaaccauugcagccaacacuaucugcaacaaugcuguuuacuuuucuucaucauucccacccagcccucuuuuaagucaacauucuugaaagcgggcacugcugaugcugcccaagaaaccaaugugaaaccaaaaggcaaguaucccauaaugcauccuccaccaaguuaguuugcugcagagcacagggucuccaucugccaccuauguucauaucccuggaagguagagguuuaaggagccauacucugugagucagggaggaaaaacagagacugccugaccuugugaaaugacccugaaggacaagaggccccaaucuugugagcuauguauugcuagaacucaagauaaauguuaaacuaaauuuccucaguaaauccaaauguagaggaaagggcaaaccaagcuagcacugugcauguugcccacaucuaaauuccuuuauucaaauucgggaaugaccgauaaguagccauguccaaggucguaacagcaaugcaguccacuuuuaaauggagauaggaaauuccauuucagccuggcacacagacaaccgcugguguccaaaagcuugugcucuuuuuaaaagcugguuuuugaagcuuagguugcaccuuuuugcagaaauauugcucuacaggaucacuggguucccaggccagacagagaggcugagccauccugcagaacuguaucuuucuggaugaaaauggacucugaacaccaauggggcauuccaggaccuuagcucuuccacugaugucccagcagggggaaagugagcuccucuacaagggaggccacacugcgaugaggacagagaugaacacuccuguggcaagcggacugugaaggugccucacacauaaauuguaaaaccaucacagucacuguauguugagaacggucugaauuuucucuaugaaaaaaauauucuuucaguucaauuuuaaugugaaaguacaacuacugcgggcagguccuugcugacuuucuucauaacgguuuccucugaauacccuccgcucacuaggauucugaagguaauuaacuuucucauaaccuguaagguauuucuggaucauuauaaaacacuagcauaauccauaaagcuuacauuuucacagcuuucauccauuuuuacuacuucugaaauaaucuggacuuuugucuacaauauacauuauacacauaacaucuacacaaaauuaaagcaagacucuuucaguaacaauaaccgucucagagccguaaagccuuuaguucuucuuucaagggcauauauuuauccaugguuagcacauucuuaucauucuaugcugagucacccccugacgaagugucccuagcccaaccccuccuaggccaccauacacugagcucacuucccuggggcgcuggggcagggaaaugcaccgaucuuccuggccagccugguaccaugaaagagaaagugccuaacccaggagucccaggcauuaagggaaucaggcuucucauuuugaacugggauacagucauggaauucaaaaaaacagcagucugguuauccuccucguggaaagacuagccaaauuuaauucaauuuccuaauucaauaaaaaucaaaaggcccccacaaaaaaugguguuuacucuuuugagaaaauauaauuaacaauauuaaguuccuuucaaauuuuaucugacuugacauucagauaacucuuuuuuuuuuugagacagaguuuuguucuuguugcccaggcuggagugcaauggcgcagucucggcucacugcaaccuccgucucccggguucaagggauucugucucugccucccgaguagcugggauuacaggcgugcaccaccaugcccgguuaauuuuuguauuuuuaguagagacaggguuucaccauguuggccagucuggucucgaacuccuguccucaggcgaucuguccaccucagccugggauuacaggcaugagccaccaugcccagcuucagauaacucuuaacuuugcugguaauagucuagauauagcucuuuuucauuuugugugaguacauaaacagccuuuucuuuaacauguccaauaaaauggaacguaggccagacagaaucucuuaaauccagagucaggcucagaagagcuuuuaacacaaauaacuucucagagagaaggaaucacguaugauaauuacacagacuuauuaauauuaaauuaacacuuuuaauguaaggaguagcuaugccaggccaguauggccacugaugaaauccacuuugccacugaaucccauggacagggcaaguagcgggagaguaagacguggugaugagguucuacagacugagguguuacgguaucacuggaaaagcucaguguucauccuguaguccuuuugauuucaauuuucaacaaaccaugucacuauuaccuucauuucuuuuccuaccaucaccuagaauuucucuuuuccuaccaccaucaccuacuaaugugcauguaaaacccuacauucaaauuuagggaauaucagauaaauagcaacgccuaaggugcugaagacaauccuguucacuuuuaaauggagauaugaaauucucuuuucauauacuuuucaccuuuccuaagcuuuagggaagaugcuacuaaaaugguccugcuuuuucuaauguccaguaaaagcaacagcucuaacagucgaaucaagcaguaucaucauuuaauguuggguaggugucaugagucuccaugagucaacuaggacagagguuugcaauccucugcaccacagcucauaacuuuauucuugugugugggugauggggaagaacaggagcauggggugaaugaaaauaaaugcagauauagaaguagagcaaauuggugugccacaugccuauguucguuuuucacaggauuucauagagaaauuccuaagacccucaauaccugggacucuacgacuaaucauacccuuaguaaccucauacuucuggaguaugaaauuaagcaaaguuggcugggcacaguggcucaugccuguaaucccaacacuuugggaggccgagucuggcggaucaccugagguuggaaguuccagaccugccuggccaacguggagaaaccccaucucugcuaaaaauacaaaauuagcugggcgugguggcgcaugccuguaaucccagcugcucaggaggcugaggcaggagaaucgccugaaccugggaggcggagguugcggugaacugagaucaugccacugcacuccagccugggcaauaaaagcaaaacucugucucaaaaaaaaagaaaaagaaauuaagcaaaguuacuacccauaacauuacacaauaugugacaauauuuuuuaaaaaucuaccaaauaaaacauuuaaaaauucuucaggaaauccacaaccuugcuuguggaagucuugcuugcauuaaccaaagcggucugacucaacuaaucuacuaaaaggaaguauguaauuuaaaucaguauuauuuucagauuauaauaaucuugauacaucuuuauuaucacuucacacacacaaaugugcacacauucacauacaugcacacauuuucaugcuuuuuaccaccuauuucagaggaaauaauaguuuaaggaaagaacuuuaaagaauggcagacaaggucagggcuuagagcauagcuguauuucucauuuauacuugggcaggucacguauaguaugauacuucuacaucuaaacuacucacuaguacaccuaaagaaaugugacauuaggaaaauauaguauuuucccugaguaguuacuguauuuuccuuuaaucaaaaaguugacaugcccucaaauuguucagguuaccuuaccaacuuuucuucuagaaauaaaaaccugguaucaggagggauucccaauagcagcauuuagaacaaucuuuuguacaaacuauuuucaacuucugauucuaaaggaauuucuuuuuaaacauuuacauugaacucaaacccaaaggcuuucaguucaaauagcaaauaauuauacuuacgaauuaucuccagacuaguaaucuccagaacuguccaaguggugggaaaaucuaaacauuaucauucagcaccaaaagccuuuuauuacaagguagaaguguuauuuaaagcugaacacaaaccacacaguuacuacuaaaaucuaaagcaaauuaagguccucauguagcaaccaacagucacccaggaguagcacauucuccaaauuuaaacuccugaaguuacauguucuggaauuauucuuagucuucaucguuuucuuugcuucggggcaugaaauacuucacccuauugugugucuuucuacacaguucucccugaaagugauuaucagaguuacagggcacaggaaggggcuuugacucagcucagcaguacaggucccuacacagcaacaaccaggcagcagucagcaaaggcuguuucucaucucacuaagugcugaucccccaccuuuuguuuucuguucuugugauaacgagaucucucucucucucagauauaaagaaucuuuacagggccuaauccacuuauauacacagugauaaaggcuuuuccauuuuuccccaaagaaacaugcaauucaagcugugagcuaggccaggccacuguuuugagguccugcuacagaauagugugcucuucucucgaaacacugcaaugauaaauuuggcauugcauauggcuagacggcaaagacguguaauagacuguuuuccaggccuuugaaaccgggauuucuuaacgccaaaugaggcauaagccugggcaugauccagauuuauuuuucuugaggcauacuaaugaaaaaguucaaggaagcauuauaaaauaauaagaguauggcaguacuauaauguucaaugacuuuuuuguagcaguggaacacuaagaaaaguuuugcuugaauuagguccgcccaaacgaaaacauauuucuuacuagaugccacaugcgugacucacuaugugggcaauauuuuauuaauaccaaaacaauaaauuuaaauaugaguuguccauuuuaugaguguguuuuugaaaacacacugaugccaagacuacauuacuaaacaaguucaacucuacaaauauaccgagagaaaagacguauaauuuuauaauacuauuucaaguuaaaggcacuccaaaacuguagacuuacucaauaaaucuuaauaugauaacaaauuagcagaaaauguugaauguauuuaaaucaucuuugguuucuuuaaucagcuucuaaaaauaacacuuuaacuggcugaaacauauugaauucaaaaucccaaauauaaaacauauaaaguuuauaauuaaggcaauuauucagauaguucagggcaaaagcuuccucuuuugaguaaccagaugcaggcaaaguggguuuugaauuuggguaauggucuuauuucccacuuaaauuuguuucugugaaucuggcugaaaauuuaucacaggaggcacaggagggcuuaccuacaaaucauaaucaucaacucacuauagcaugaaaagguauaaaaagcaauuauccaaugauucuggaguguagaaauagccagccuggauaaaucagcuuuaaaaauuuugaucacaauugaaguuuauuugugaauacccagugugucuauuuaaacaaucuuaguucaguaagcagugugcaauccaaacuaaaaggucacuaugaaaacacaccaggccuaccugucaggucaauauuuaguccuugauuagaaaauacuaagugucacaaagccacauuuuucaaauucugauuuaaaaccaauucaguuggucgaggauuauacaaauacuuuuaaaaucuguuuucauuaaacuauaaagcuuuucaaaucacaaagcuacauauacuauguuacauaugaaaaauacaaguaaugauugcauaauuacuuagguugugaaaauuucaaaauaucaguggacuacaaacaaguuuuaaacagauacaagcaauuuacauccacuuauuuccaacuacaugguuuccucgauuuccuguguagaaaugaauguaucucagagugccugcucuuacaagcuggacugucuucuaccaaagaacuucguuguucuccuuaaaaaucaguguauaugaauuccuucuacauuuccacuugccugaaaaugacaguugaggguccguguuucuucauuucuaacccauuucugaauaaaaagacuuauuuuuugcaguuugacugacagaaccuaagcucuuguagcaggaacucaaaacuugguuauguaagcagaaaagagaaaugccagagccacugagaagaagacaugcggcguugcuuacuuaaauccccagccugugcccccaaggacaauagcugcuaccaggauggcaccagcgauggagccuauuaugagauugguggcacuaggaccugugacaaaggaucaugggaagagagucauaugaaccaaccacuuucguuaccacaagggaaaggcaguuaagcaguuucaggaaguaaauauccuguguaaaagacggcuaaacauuuaaauugccuuuauuuacuuagcuuaauugcauuuuagaugcuacggugagcguugcuuggauuuauaugccuuuaaaucuaaaguuucugcaccauugacaauuaaguuccauuaaauucaccuuucacagaauuugaagcaaauaggccccacuugcugucuuuacacauccuucuucucuuccccucucccaguaucauguaucaaauaaguaaaagcacagagagaacaccaucgcauucagacaagcuccaucugacucacaaaugggggcauggaggaaaggaaacacauucugcuacaaugcccuuccaaaaagcaccuaaaaguggucugaaugcuaacuuuuuaauuccccacuuggaaacaguuaaaacuuagcagucagaaggaagucaauacagaucugacuuuugaagccuugcucucaaagauacacuucuucacuauccuuacagugguaaagaccaaaaugggguuccaaaggcaagauauaaggaagcauaaaucucauuuggguaauuuuggggaaaugguaaaaagauuccuuagauucaacugagaauagcuuuaaaguucccauuguuacuaacagaacuuucaggcuuagagauauaaaaaagcagagagccaaaggacaguaagaaagaaaagacaagguggcauuucuaucaauugcuaaggguaagagcuaauccauauccuaguaacuccuguccacucgcucacuccucuccuuaagcuuagcauuuuaaaaucuaagcaacguuaaaccuaguauaauaauuacuuuacauaucccauccuucaggaugcuaacaugcagguacaguguccccuaacaacaaaauacuuucaguccuaucuaucccugcuccaggaaucacaaagccaauguugcuaguuucccgaaaauccuugaguuuuguguaaacauucauuucuguguaaaaaauucucuuuucugcucacaucagugcccucaacuguguacauaaauggaugccacuuuuggcagcacacaaauugcaugcauaauguguuuuuauucggagaccauccagugcuuggugggcagguagaggacagcugcaauacagucucggggugcaggucucuuuaggcuccugggcuugugacaugcucuuaagacuaaccacugaccgucuagagaacgaaucucaguugccuuuagagauacaccaauaauaauaauaauaauaaugagagccauaaaaauaguuuaaacagcuaccguauugugcacuuacuaugugcuggacacaguacugaacacuugacauauaguaucucuuuugaucuuuacaaaaaucguaugaggugggaacuaugacuauccuuguuuaauggaugaggaaacaggcuucuagaaguuugugagugauagcggcaagaugugaacacagauuugucugacccuaaaacauauccuauaagucaagggucaggaaacuggagcccacagaccaaaucuagccccacugucugcuuuugcaaaaaaguuuuaucggaacauagccaugcacauucauuuacauauuguuuauggcugcuuucaugcuaagacagcauuguugagaaguuguuacagacaacccuguaggcugaaagcuaaaacuauuuaccaucuggccuuuuacagaaguuugcuaacuucuguuuuagagaaacuuuauucuacuuacauguauuuccuccccacaauucaacagagaaucaaauuucaaaacaaauauuaaaaaaauauauaaccauguacauacucuaugcuuuggauaugauuugcacuucguccgcuucagaaaacaggcuaggauuagaaucaacacauaauucaugaaaaaugauuccugacuuauaaacuaaggagaaauuaaaaaaaaaacuguccauggaauucuuagugacugaaugaacauuacucuaucaauuaaacuaagaaauguugagacaaucuauauuguacuacauuauuuuuuaaaaaacuauauuucuugagcaauuaugcuaaaacuuggaauuugauggggaaaaaaaucaguaagcuaagagaaaacuagugcucauaaaccaggaauaauaacaaaucuaucuuuagaaaaaauauacauacacuuacacagacuuaccugucacaauuagaaauagucacaaacgaacaaaacuggaaaugauugaugaaaacaaaugcugauaacaaggacuauguuuuacaagaaaggccucuuugauuuuuaccuaucucuaagacuucaaggaaggauuauuaaaauucauccuuucaauuaguacauuuaaggacaccaaaguuacagccaauguauaauguuaaaaaaugcauuugggaugauuuucagaaaacuaccauuugucaaggaggaauuucacauaaaugcaugcauggagcuggcccugaaaaaggaauguuucuucuguauacaauccagucaacagauccaaggggaaauuuuacaggacaaaguuuuugucucuaaauauuuuuaucccuguuauggucuuuguuuucuaauacacaaggagaaacaaaaucucuuuucuaguauuucuagcuuccccugugcuaaccagcuucacaguccauagagaugagaugugaguuggaagaucuaagucuggucaaaguccuugaauccaggagaaagaaggcucaugucaucuucaacacaaggugugaacuaugaaccugcuucccucuuaaugcuauuuugguccccgggucucccaauuccaguguguaagaggagcacccauuuguucuaacuaaugggacuauagaaaaacauaucugauauucacaauaagcccaugauuugggaugggugagucaaagauaucuagugauuccugaagauacuaguaauucauuccugggccacuuugaaguguuaccaccaccaccacaguagacagaaaagacuguguaaaggguuaugucugccauucuuaaauauucuuuuucuaauuagagagagaagaaaaaaaucaugauaauauuuuaaucuacagauuagcaaucucaggaagcaaugugcccuggagaacugacagcuauucugaggauguggaucaaguacagagcacccuaaaucaaagcaucaggagaacuguauuucugugacagcuuaaugggcaaguggcacacaauauauuuauuuacacccuggcuacuuuuaagacgaacccaccaggugauuugcagcuguucacuuaugguuauacagguuuggauuaaauauuuuuucauucuuaaugcuccuugcuuccaaauauuuauguagacuucaauuuugaauuauuaaccuauuuuauaggaaaaauaggaaggcaguaugcuaaauaucuucuuuuuaaaaaauuaagcugcagccuccuauaucauucuaaauaaaugaagaaaacauuaguagcuaucauuuuuauuaccuuuaaaagguccuauaacuguugauaauugcuaguuauauauguaaauuuauuugacuggcacagauuaacuuuauuacaagaauccuaagaaaacacacauauaaaagcauuuuugccaauaaaugguuuaaaaaaaagucuguauuuuaaaauuacuucuacaaaguggaggagcaauggaaguguugggacuauugccuuaauuaugaagauaucggaagcacacccaguguuauguuaugccccacauuguuccagacaggagaagguucuacaugacacaagaaaaccacaggacacaagcaacauccaagucacaccacaaggugcacuaccacaggaaacacggucaacaggacgagacauggagucagguacaggcaucgccucacacaucaggcaccacacagaaacacucugaaacuggcaaggaugcuuacucuauuccccacccugugccuccaaaaaucacccccagggccagaauggugccggccacggccccuauuagccugcuuguggccauauucacuguguggagggaaaauggagauuuuuuaacaaaggaaauuacauacuaauuucacuaacauacaaaauaaucuauucaggacaugcuuugaaaguuggcuaaauauugaauuuuuuugcuauaagauuugaaauuaagaucuacauacacauugaagauauuugaggauaacugugaauuuaccuucaaauucugcacacccuacuuuuaaaaaacauaauuaucuuauacguacuuauaaauacauaaauaauucaauuuguuauaguuccuaccagaugugagguaaaauuaaaaaguaauuuaaauugcauaacagcaaaucuguauuuuaauuacaaaaguaaugaaccauuaguaauuguuuauaaaauucucaaacuguaaaauaugccuaagaagcuacaucuuuucaaaauucagaauauaucauucaguuuugcaaagauccuuacaaauucaagacagaauagcuuuaaaaguaaauacauguuuaccugggaaguuauugaaaagcguauuucagauaagucugcaauauuuggauuucugucauaguauuuagacauuuuguuuuuuguuuauuaguagucucaaguggauaaacuuauagaaaguuagggucucugggaaaccguauuaauugcuucagaccaccaagugguagaugacuaucagagugagaaucugaauaacuuuaugucacugcuucucuguguacagcuuuccaauccuggaaaaugggccuggaaugaguggagguccccaagguucccgcuacaaaggcaaaaugaaguuugguguuaaaguuggaagacacauuguuugcaguugugugucugugccugugugcacacaaguguguggacauacauacacuuuauuucauauuucuauaggaaucaaaaggacuggcuucaaauuaccuuucccaugaaaacagagauuagcuucaacaaggcugcccuucacauguauugugugcucugagacagugaaacgaaacaaagauccacgacucaaagccaccauuuuuuaaggcuuacaauugggcucacugacauuuuuagcuaaauauuuucccagaggaagagaaagaaucuuggauuucuaacccuguuaauuaacuguauacugcuuuaucuuaucacaagauaauaaugugagggagaaauucuaguuuuaucauugacuaagcacaaccugguuucuuaaaaaacaaacaaacaaaaagauggggacacaacagagaacagaaaagucccccgagaguguugaaggcuaagggaagaagaccaacacagaagguggcagcaauguuuccccacuaugacaauacauuagaacucaaaaccaccugaacuacuccgauuuucaaguuauggaggcaaacacugggacugaaagguauucaaaauaugaagccucauuuuuaaaaagaccuuagaaaacccuugcuuucagaauacuaaauuaacugauauacauuauuuuauaacuuuuuuuucuuuuuucuuuuuuuugagauggagucucgcucugucgcccaggcuggagugcaguggcaugaucucagcucacugcaaccucugccucccggguucaagcaauucuucugccucacccucccaaguagcugggacuacaggugcgcaccaccacacccggcuaauuuuuguauuuuuaguuagagacaggguuucaccauauuggccaggcuggucucgaacuccugaccucguggucugccugccucggccucccaaagugcugggauuacaggcaugaggccaccgugccuggucauaacuuuuuuuuuuuuuuuuuggcuuaaguuucaggcauugguucucagagcugcaauacaugacaguccuaugacuucugcaauuuuuauauaagccacauaugcuuaaaaauacaaaaaacccucucccauaaauugugauacuaaaugaguguuaauuuuuuagaaauuguaagaacuauaugaaagauaaauaaaaauaauuuaaaaagacuuuugucuuugcuauggauguaauuucucacugcagaaacaagacaaaaucauguagguuuuagaaauacaaccggaggacgagacauuucuacagaggcuucaaguggguauucaagaugaauagauauauucuguaaucuccaaugagaaagaauaauuuccuccacauuauuagcugguaaguacucuuaacgcuaaagcaaguuaaaagugggaaaaaaagcuuuuucaaaagcaucccuacccucccuguucucucucccucccauuacuuugagugacacaguauccugcaaauacauguaaagugccauuugauucuuugucauuguacugaacaugguugucucuuaaagaugugaagauuuucuuuuugucgauucugcuuugcuuuuguucucuuccuuuagagagugcugaacuuuguuuuggcaaguaggaacuugugcaucaccuugacauaaauuaacugaguagcucacggguggguggauuuuuauaggggacauauuugaaaacaaagguugcagcugcuuuucauagcuacaaagaauuuaucaucucauugaaaaaaauucuacuucuacacuaauuuaucuauucuguaauuuauucauuaauucauucauuaccuacuaaauaccuuuuuuuuuguucaaggaacuaugcuggacacacgaugauauaucuuauuuuccuucucauccuaccaaaccuggagauggaacgcuuaaagcuucuagcugacaacacaauccuuuuauuaggaacuuaacuuugcucccuaacucuuugauacacuuacuuuucaguauaauguguuuguggaaucuguuuauuaccuagcagaauguuuucauuuuuguuuacuugcuuauuuccauuacuuguugguuuauuauuauuuucagucuuggucccugcuaccuagguuuacuugugcuaaaagacagaauuuuugguaaguauaaaauaucaaaaacuauaaauuuucuccuuuucuuaagauuuucuauuuuauauguagaauuccuuuauagacaugucaugcuucagacauuuugaaaaugugcuguuuugaaauugaguggguuuuuuuccuuauuuuuagagaguuucucaaauaagaagaugcauuauuucccccaagugauuccaaaggggguuaaaauccuguaucuuuugauacuucacaggcaggaggcaucaaagucaucauuuguauuccauggaccaaagugcuuucuucagggauuuauuauuccacuaccauucaagacaagaaaaguaaauacuaaauaaacucuuuauauacuaguguauaauauugguauguagcuccauauuucaauacauuauacauacaaucagaucuccuuacuguuuuccauaaaagaaaaaaacaaguucauuuuuagauacauggacaaaugucuaaaaggaugcaaaauaaaugauuucauguaagaauauauuucaguuuaugcugucaaugaaaauaggguuuuucugaacugaaacaaaauaaauucaguuauuaaaaaauuuuuaaacuugauauauccuuggguuauugauaaggccauuguuauuugagaaaaauauccagguagcacauaauuauacaugagcauaaucauauaugauaaggauaacuucucauaucuaaucaucuaaacuauaaaaucaaagauuugugcacugacgaagacagucaccaaaaggauauauugcaaaagguaaauguaaacacuaaauacuccucaagguuaauaccucagaaaauaagacuucaaaacuauuauuuuaaaaauacuaaaugauaauaauauaauacuuccuuucuuaucuaauuccauaaaaagcaucacugacaauaauggaucaguuaauaagcuugauuacuaccugguuauuguuucacuuucuguuuacuauugugcuaugagaacuagcagaauaacuuaauauucagcuuuuuuuuuuuuuuuuugagaagggucuuacucucuugcucaggcuggagugcaguggugugaucuuggcucacugcaaccucugccucaugggauuaggugauccucccacuucagccucccaaguagcugggacuaugggcacaugccaccacaacuggcuaauuuuuuuauuuuuuuauauagacgggguuuuuccauguugcucaggcuggucuggaacuccugggcucaggcaauuugcccaccucagcuuccuaaaguguugggaucacaggcgugagccacugugccuagccucacuauucaacuucaaaacaggaguauggaauaacagaaaaaagcauuuggcucaagauaaggugauuauguuauauuauuggcucugccucucacucuuuguuaacccugaaaacuaacuuaguuucuucauuuguaaaacaaggggucuagacugaauucuuucuaaggcccuuuucauuucugauuugaugagugugguugugaugaaaaggucugaccaaagcuucccaggaauaucugcccauacauaucacugaaaacauuaccuaugucccaguuucucuuccuucuuacaauggugauguaaacuaucaaaugagaaaaguuccacuguauucuauaguaagcaccuugagaaugugucuacauacagacaauaauugggguacuugaugugggucucccuguaacaggagagaauucuaggucuuuuaaacagaguuaaaauacauucuguccuuguagaacaaagcaaaauaauuuucuauaaugauuucaguggaaacaaguugagagaaggacuaggcuuaaaaaauauaaaaaauuaaaaauaaacuuaagaaaggguuuuugcaugugaaaugaacaacguagaaaaaauaaauaaugugacaaaaaucuuuuuuaaaaaauccuugcucacaugguuugugcuuugagaucuuauuucuugucuuucaauaguuugguuugagaaguuggcgugaauaaucuagcaugccuuaaauuauggguccauaguggacaacuguaguaaguacagggugacuacaguggcaaugcuuucagguaugcuuucaguccucacacaggagagguugaauuuccuauucuuccaggaacuuauaguuaaaauaaaagaaauacacaaaacacaucaguucauuucugacauucucaaaucagugaagacggagucauagaauucgccuucauuuuuacuaauuuggucuugauccaaagggcaguuggguacaauuuaucuuuuaugcccauguucaugauuuuuaaaaaggccauauuuucauuauguuucuugaauuuuuuucucuauauaauggaagcacauugaaauuaaauaaaacuaaguauuuuuaauacucuuacugcaccuauacagaaaaccuucaucuauggauaugauuggccacuguggguggugcccauuauaaauggcaagcauuuggggagggcccaaacacugugcucaaucaggcaggugccaaccaaaccaguuggaucaugagaaaaaagauacaacaugcaguuuuugguuuuuuuuccugagacagugucucacucuguugcccagguuggagugcagugucgcgaucucagcucacugcaagcucugccucccagguucacgccauucuccugccucagccucccgaguagcugggacuacaggugccugccaccacgcccaacuaauuuuuuuguauuuuuaguagagacgaggcuucacuguguuagccaggauggucucgaucuccugaccuugugauccgcccgccuuggccucccaaagugcugggauuacaggcgugagccaccgugcccggccacaacaugcauuuuuugagaaaaaucuuagugucucacacacugcugagccuacaguaaguaaaacacugauuguuuuaauaacuugaguccauuaccuauuacucgucggcaaggcaacaaaacaaaugaauauggauaaacugaaaaguggcacuagcaugcaccaucucauuuccuuugcauauuucaaaagagaagaguguaauauuuauggagugucugugugccaagcauacgcuaucuuuuaaauaguagacagucaauaaauauuugcuaacugaauaaaacgaaaagcacauaauuucucacuuggaaucuucuuuuaaccugacaaucaaaaacaaaauaauaaaaucuacaacagaguuuuaaaauuuuuuaguuucuguuuuaccaguauauuaauagauuuuuuaaauagagguuaaaaagauauagauagcuauuacagauaaaagcuauuauuuacuuguacuaaaauugcuugaauuuucuggaaauguaaauauuuauaaaaauaacuaggucauuuauuucauuuaaugacauuuucaauuuaaucaaaauuauuagagauucauaagguuuuuaauaauuuuagaaccaauagauaacuuugcaaugacuccauugucuucauuaaaaauggaaaaagaaaaaugcaacaggaaagaagcauaccagaaugcuuaucucuuuuuuuuuuuuuuuuugagauggaaucucgcucuguuacccaggcuggaguacaauggcacgaucucggcucacuguaaccuccaccuccuggguucaagcgauucuccuaccucagccuccccaguaucugguacuacaggcacgcaccaccaugcccggcuaauuuuuguauuuuuaguagagauggguuuucaccauguuggccaggcuggucucaaacuccugaccccaggugauccgccugccugggccucccaaagugcugggauaacagguguaagccaccgugccuggccucuuuuuugggggaugaguagggggcucagugucucacucuaucacccaggcuggaguacaguggcacgaucuuggcucacugcaaccucugucuccuggguucaagcaauucucgugccucagccucccaaguagcugggauuauaggcaugugccaucgugucuggcuaauuuuuguauuuuuaguagggaugggguuucaccauguuggccaggcuggucucgaacuccugaccucagaugauccaccugcccucggccucccaaagucuugggauuacaggcgcgaaccacugagccaggcccaauaaggcuuaucuugagcaccucugaguuuuaauauuuuccguauuuucaaauuuuucuacaauaaguauguauuacuugaaggaucaaaaaaguuauuuuuuuuuaaagguagugugggauacuaccacauuaaauggagagaguaaagcaaaacaaaacaaaaggcagcugugaguacucuuucucuagaaugugacuuucuuuacuuaaugccuccaaagauuuuuaggcaugggugggugaaggaacagggaauagauauuacagaaccagacaauuaauaacccccuacucuacuuaaagaaaaaaaggcagagucuaaguaaauuuagcucugcucauccguugaggcaucuuuauacaucacuugaggaaauagcaucuagaucuuaaaaaaaaaaucacagaaacacuguggagagaaaauuuggaaagaaugaaccuuggcuucucuuguuagagcuuaaaucuucucuaaaucuaacuucagaagguggauccaagaauuuuuuguucuaguuuuaaaguaacaaaagacuaaguguaaaaguggaauacguucccuuuuagaaauagaagaaggagaacagaaauagacugugagggugugauuaugauucuuacagaauuuuaauaucaugggcauauuaagcaaaugcauaaaauguguuuuaacacacccacuauuacugaacaauucacaugcgccugaaucagccuaaaucucuucaggaauugaggacuacagagcuucaucugcaucugaaaucaucuuuucccauauaaacuauacugaaguucagagaguuucaauaaacuuucauccaaaacuaagcugaucuaaaugguacuaauccuauaugcauuuuccuaccugucagagaaaagcacggcaguuacaaaaaaacuguuagcaguaccaugauaaagaagcugauguacaacgucaucccuguauauaaaaacugguucuaguauuuccuugguuucuuagguacaauguaacagaugcuguaguaggccuguuugugacugauggguuuucuagaucuuugaaaauuguaugagggguugagaaucgggagaauaaugaaaaaugauuaccauacuccugauaacacagacuacauuauaagaugauguaagaggccaggcgcgguagcucacaccuguaaucccagccaagguggguggauuaugaggucaugaguucaagaccagccuggccaagaugaugaaaccccaucuccacuaaaaauacaaaaauuagccaggcgcaguggcaggugccuguaaucccagcuacucaggaggcugaggcaggagaaucucuugaacccaggcagcagagguuacgaugagccaagaucacaccgcugcacuccagccuggucgacagagucggacucugucucaaaaaaaaaaaaaaaaaaagaugauguaagaggggcgggugcagugguucacaccuauaaucccagaacuuugagaggccaaggcgggaggaucacuugaggccaggaguucaagaccagccuggacaacauagugacaccuugucucuacaaaaaauaaaaaauuagccaggcaugguggcaggauucuugggccuugcaguuugaggcuucagugagccaugauugugccacuacacucuuaccugggugacagagcaagauccugucucaaaaaaaaaaaaaaaaaaaaaaaaaagaugauauaauggaugggaagagaacaagagucugagaucaggcacuuaggacuuagguccugauccuggccuugucucucacuaccugggugacuauaguaagugaccugaccucagggucugggccuucucaucugcgaaaauagagagugguccuagguggccccugagucucuuucuaaucccaaaauucuaauuucucuccucuuaaugacugauuaaaacaaagguccagaucucucacauuuucuuugaagaaugaaaguucuaugaagaauuccaacuccuuccuagucaaaagaauguucaaaaagagcuuguaaggugacaacuuccuuccggagagauuccaacauugaaaaguaaccagagccucaugucagccaaaaagauuugaucuauuagaaaaauggcauagcuuagacgaacugcaaaauaauuugugacuacagaaagagaauaagguuuaaagagaaaaagaauacuguauuaaagaaaauguguauauuuacuucuucccaaucucaguucuagacuaagaaguaauucaaacacauuuuaaaaauaugauauaucagaauccuuaauuuggcaguaacauaaauuauauacuuuaaaggcaaaaacagauauucuuaugugucuccucuuaagucaauuagaauguuauacuggugcauuggaacagugucaacgaauucaguauuccaugaauugaaaccaaaaucacacaaacccuuggguccuucauccuugggggggugaagguuccuaacuggaucccggauacugcaaucugucccugcccaggugaaaucacaaaugcagguggcuucauuacuacacaccugugaagaaaaaggaacagauauggcauuuucacuguauuuuguagaauaauagugauaaauguaaaagagacacgggggcagggaggaagcuuuaaaagcuauuuggaauuucuuuuuaaaguuucccauggucuugaucacuagacacaagguaauaaugcauagaucaaauuguguaacauuuuuucccauuaauuaaagaaaaagaguaaaaggaagaaauucuucaauuauuuaucuuauuauuuauuauuauucuuaaauugaauuauucauguuauucuuaaauuaaauugaaucaugauauuacauaaguauacaaaugucugauaagauacuuuuuucuacuuuguucagaaguaacuguuucuaggaacccacuuuaaaaacauauacacuuacuucaauaaauuaauagacagugggcucaaaagcacugcuggagauaaaaggccaggagacauaaaucaccagugccuuguaugaccucaccguuaccacguccaacaccaaacucacuugguggcacuuucccugcccaacaaggauucccccccaccacacccccacaccccuaguccuugguaacccucuuuucucagucagccaagcugaggaccccagagugaucucugucuccucccuguuucuccagggacccaccagcaugcuggaauggaacuguaaucuagaggaaauaaauaacaaugagcaaacuagagacaggaguguuuaaacccuuaucucccugagaaacacauucagagaugauaaaaucaaacaaggaagcuuuuuaaucugaaauauucuaauaccaugauugugauuaacaaggcugaauuuggccuuuuuuguuguuguuguuguugagauggagucucgcucugucgccaggcuggagugcaguggcucaaucucggcucacugcaaccucugccuccuggguucaagcgauucuucugcaaaagccuccugaguagcugggacuacaggugcccaccaccacgcccagcuauuuuuugcauuuuuaguagagaugguguuucaccauguuggcuaggagaauggcugaaauuaaaguccagucacugugaccaugccagaccaugaagguuccagcugucacauugauaccuacuuaccccauggcccgaacagacuuuacccuuggaaucgaguggacagcugcucauauuuagggcuugaauuuguaggcacuuccgaucuaaacacaucauagacgggccacauggcguuccaucuucuacauagcccacauccguaucaucaucuaaaacuacaugggcaccacuaaaacaagaaagauacccauauaacuauuugcaccacacuuagaacaucauuccaugaaugaggcuugcucuucacaaaaccgaagaggcugucaguggauguggauuucuccuagcauuuucuuacuccucuucuucuuccccuuucccuaccuuuccuuaauaaaagagcaugaaaaagaaacacucuuucauuaucauuauuacaguacacaucaacaagaaaaaugucauuugcacaaaguauauucuaaaucuucacguguuuucaagacccaacauuaagacuaaaggagagaaguaucuauaugagaacaaaagaagcaaauauaucauuagcucuccaaggcuuucagauguagcaugguagaaaaaagcagacgaugaacaaaaacagcaaaugaaaaauauuuugaaaauuauuauucuuacuucagaagaucugauuauccauaauugaaaaacauaaacaaaucaguuauuuucuauugauauuuacagacaugccuagcuuaaugauggggauaauauucuaagaauugugucauuagucaauuuugucuuugugcaaaugucauagaaugagcuuacacaaacuuggaugguauagccuacuauacaccuacacugcuagauggucuagucuauugcuccugggcuacacuucuguauagcauauuauacuguacugcaaacugugggcaauuauaacacaaugguaaguacuugccuaucuaaacguaucuaaacauagaaaaggggcaguaugacuuuucuauguuuagauacguucagauaggcaaguacuuaccauuguguaaaaaauuucagucaaugacagaccacauauaugacagugguuucauaagauuauuucauguguuuuagugcuuacuucuaaaauuucaaaguuagguauaauuugaauuugaaugauaaugcuauagucacuaauagaauaucuugcugaauauuuaacaaauaugcuaguuuaguauauacaacaauauaauuuaacaaggcuauuuuaucuaaaggcaugaaaacacacauucaaauaaagcuuguauacgucaaaguaacuagcuuuagagacuacaaauuuauuccaggagggaucuuacuaagacccuguuagaauugucuucagagccauuuaaaagcaagaaaaaaaaaaguaaccauuugacugagacagcauuagccaauuuaguacccaaugaauuuacuaaaauuacuuuuggauaaucccaaaucuuauauuaccucacuuaaggugaagauaugguacucuaaggauacuaaaaguaaaaguuugcagacgcugaaggcaauucugcagggggaagcccaaaaguguuuugagcaacaacaauaccauugaguaagagaauaguaucuucgaauuauaacuacuuugaagggaacaauaccuauuuggaauauaauaugacuccccgacuaaacaaaaauaagccucauaucuacaugccuuguacucacagacaacuggauaucaaauguuugcuuaucgguauacauacuauuuuaauaaauauuuucuauauaugauuagguauuuguuaagccaucuuccaaaccagacauacacuucauaaacuauagcuuaaauucuuuuucuuuucagucacaaaauaaauacacacacaguguucaaaauaguggcauacucuaaugcuuaaaacuuuaauaauggguuagaaugaacaccauaauucuacuccuaaaauuaugaugacaaagaaggccauauuacuacuaacuaguauaauuuugagcaaauguaagcugcaagucaauauacaacuuuguuucuuuuuaagugacugucaauaugaaaggugauaauaaaaucuaaauuaacuuuccucuuguaaaaacuagaaaaaucuuugauuucugauuuuuuugaaauuucauuuugugaaauuuguaauucucauggcuuauuaggucuucuaauauuuaauauguuaccugcagucaaucacccggccuugaugguagaaggaaguuggaaugaucucacccugaaguugaccaauacguggagcucgaguaagauugguacagaguaagaauccacagaacacaucacugaacauguguaaagaaaacaaacagaccagacaggaggaaucaagcucaaaaaaucaaaacgauucgguccacauugauucaaauuuuuaaaauauuaucuuucuuucuaaacaaaaacauuugaucauauaucauugguaggugauaaccuccuccuucuuugcuaagaggaucacaguuuuguuuggaacagcaaagugcccagcccugaaagguggaucaugacugcugucucaucuauucuugguacucccauucucgacgcccacuuuccuauccauucccccuucucgucuuccuagaguuaaaaguggccccugggcugugaagaugugaggagaagcuggcuagggaguggcugggaggauuuuguuuucuggauaaaagguuagagacugacagggagaagaccuuuugcuccuauccuuacuuccuaccuuugaauguguagcuuuuguauccacuuuacaaucaugaguucacaaagcauaaggacaaaaaaucaacaugcuaaggguuacaggauggaggggcagaaauuaucugggucuuuggugaccuuguuaaauucaugcaccaugaggaccucuaccuccagucuaucuguuaaguaaacaaugacuccuaaaaaaugggcaaagaauugaaguggcacaucacaaaaaaaggaaauccauguccaacaaauguacaaaaaugugcuagauuccacuuguaaucuggggaaaugcaaauuaaaaccaugcuaauauagcaggucacacccaccagaacagauaaaagcaaaaagucugauaauaccaaguguuggugaaauaugguacaauaaaauucuuauauacauaauacugaugguagaauuuacuaguucagccauuuuagaaaacagucugacauuauuugguaacaaugauaagauccccuaugacuuagcaaauuuucuacuuauguacaggccuuacagaaagagguacaaaugugcacuagguuacauauacaagaauauucauagcagcaugguuccuaacagccaaaaaaugaaaacaaacuaaauguucaucaacacagaauggagaacuaaaguauaguauauucauucauuugugcauuuauaaaagugaaacaaauaaauaauaaaaaugaacaacagacagcuauacacaccacagaaaacucuuaaaaugcuggacuugagaagcaaaauacaaaauaauacaugaagcauuagggaugaaaacaggcaguaaaacucuaaagaaaagcaagaaagugacugccacaaaagucaggaugaagguaucugcacuauuucugggaugcugcaauguuuuauuucuugacccauguaggagugacaugggaguucacuucauaauuauuugguaaaauguauauuuauuuguuauuuauuuuuauguuuauacauuucacaacuuaaaaaaaaaauagagaugaggacucacuauguuguccagacuggucuugaacuccuggacucaagcgauccacucgccucagccucccuaagugcugggauuacaggcauaagccaucgugucuggucauauauuucaugauuuuuucaaguuucaaacacauuaauuucccuuaacuuauuggggauuggguauucuauuaccagauacucaaaagcuauccuuuacaauaaucuaauccaaugccucucaaacuuuuugaggucaugagacacagagagauaaucagauucucuaggacauggagugaaugaauaaagcuaaucaaauucaagauguccaaucccauggauuuugacuacuucaggcuccccuugcuccuauccccugacaccucgaggacugaggaucaacaccuuggaacaucugugcuucacuuaugagacaucagauaagaagcucuguucucuauuauuuugguuuaauuuuuuaaaaauuauagucaaagauuuguugccuacuguggccucauccaucaucaaagacuaaauggaaaugcaaaguuuuguaaaauauagcagagaucauuaacugagaauaaagcuucccuuaaauucuugcucugcuucaaaauuaggagaauuuucauugcuuuagaaggaaaaggaaagagguuugggcuauuccuuaaugauuccauuguuccacaguaauucaauuaaccuuaauaaccuaauuaaugagaauucuaacuuuccucaacuaaucaaauaaauaucaggcuggacguggugacucacgcccauaaucccagcacuuugagaggcugaggagggcggaucacuugaggccaggaguucaauaccagccuggccaacauggugaaacccuaucucuacuaaaaauacaaaaaguagccgggcaugguggcagaugccuguaaucccagcuacucaggagguugaggcacgagaaucauuugaacccaggagguggaggucgcagugagcugagaucaugccacuguacuccagccugggugauaaagcgagacucagucucgaaaaaaaaaagaaagggagaaagaaauaucaaugugcucugaaagcaucucauuuccugaguaaagauggcuuuaauauguacuaacuagaugcuuuuuggaagggaaaaaaaaucucugguguagauauuagauaucugauuaaaucaaauguuacuacacuugugaaaugauaaaaaacacaguaagauuucacguuggucgcaaaaauauauacggucuauauaguuugcauuuaaacuacauguauacuacuacacucauaggccauauauucuaguaaaaguagaaaauuaaaagcuaguauuaauuuguaaugcucuggcaaaguaucucgucagaacaaaaaugaaguaaaauguggcaccugagaaauuuucugaauuuugugaaaauggcaugaaucuguagcauaguaacaguuuaaucuauagccauuugccucuagauauaauaauaccuauuaaaaauaaauacuuuaaauuuuggaauggugaacacuuagaaaaaaaucauuagcauuuauuuugugcucauuuugcacuugcauaagaagggcuuccaaguccagugacuaugcccuuagagcugaccacucacuguuugcugcacugaauccaccggucuccauccuucccgcaguuucccuucucagugccuucuguauucagcuuuucauagcagaacuugucagacccugcagccucuuuuggagauaggcaagagaagaaaauuaauuuucauuuucuuuguuauccauaaccaguagugugccaguaaguguuuaacacccgauucuccagagcaaggaaaaagaacauccugauuuguagcauuugcaaguuuccaugguauaaauucuccauggcugauuucacacucaaugugauauccaugggcuuccaaaauuccugaaaauuuaacaauuggcucuugcaagcuaauacaaaaaagcuccaaaacaacacuguuuuuagccugagaaauaaauuucucuccaauccuuguuggugaguuugaggauggaaggugcgaaugauuaucagcaggaauuggugaagugacugacacacaggaaacuaacauucuuaaucuuguuuuauaucaauauuaggagauaauuauaaagucguagccuauugagauuuuauguuggcaccugaguuuugauaauuaaaccuuucaaaauacaaauaugucuauuaucuuuucucugucaaaacuaaagcacugaauguaaaucagucaaauaaaugauauuugccaaacucuaaaaucacucaugccagagcccuguucucauucugugugcuuucuuuuccuuuggggugaacccagccuuggcuagaaaggcagacgcauuucucauucuuccccccgucuggcccucaugaacugauauuauuggagaggcacuguaaaugucaggaagaggauaugcacgugaacuuuuacggaauguacuaagaaucacagccauguaccuaucugcaucucaggaaguacaugcaucucuucacuuugaagugagacaguaaaugacaaaauuuaaaaaauaagucugguauuuuccugcgguaaaaaccagaaagcuaacuuguguguguguuaauggaaaaaaagggggucaaauguuaaaaccaagguacaaaauaaaucacacaaguggcuggauaaucacacuguacucaacccaaucuuugcaaaugaaugcaacaccccuucucugagagccacagccauuaaauggcacugcucaguucugacaaguacccaacuuaagcaguuguuuucuauaguuuuugugacuaagauucacaguucucuuuauucucauccuuucuagauuuuuuuaaaacaucacuccaagcugugcaucucucucagcaagacuggcagagaagaacacuauuaagagaaaaugguauguguaaccgccaagcaaggaggugcgaccuacuuguuccccagauguacugacacugguugucucuggucuugcacucgccauuguagcagcggcccuggggacaggagcacacaugugaggcacacagagucaguuugucuuccccaauguuuuuacuacaaugucuccuucugguucacuuggauaaaguuuuuucauuucauacccuaauauuuuuauagugaccaguaaggaucacaaauaucucaagaauaagaguuaaaacuuuaaaacucuaaacagaacucauuguacagcucucuaaauguaaacuaaacaucuacaauuugaaauuuuacagcaaacaaaaauugguacauuucugugagagacaccaaaaugauuuuuagcuucuuuuguguauggaugguuaggaaacaucaaaucugcauuugacaucaugauacucaccuguagguuauaauauggcuucaggggaaaaaaaacucaugacagauugucauauuuucuuucacacaccaggcaggcugaaauuacugaaagauggucacaacucaauaaaugagacucccaguucuucagccauuacauucuuuuuuuuuuucucuuaaucuggacaauuugucaccagagguaaauauauuuaauauuuggcauaacaugaagcaacucuaaauuagaaucccacuauaauaauuuacuugaguaaaauucccuucaaaguuauauuaauauuuaucaaaaaaggaaaaaaaaacuuuccaaugaauccuuuuuaaauuacacuuaaaauuuauagcccagcauaccugauuuugauugcaugcauauccgucuugcuuaugaagauuuggugggcacugcaaaauauuaucuuuuuaguuaauauucagcaugcuagguaccuucagauaauguacauacuauauauaaugcaagcaugguggauauauauaacuagaaacauugagaaaaacacaugcaacuccuuaaauacguuauuaauucaaauuauuuauccuauuauugguaaaauaaguaaguaagggccacacagugcaugcauuuuauauguuuccucuguuuauggugagauggaccagaauaacaagucacauucacuugccuacagaguuaaaaguagaagagauuaaaauggacaaugaaggaaaugaaucagcuugguacauagaacggucacauucaagaaacuaauuuacaagaaguugcucagcucucugaaaaugucaaaucugcauuugacaucaugacauuuuaccuauaggcuacuuuagugaaacagaagaaauacucugccuuucaacacaaaguaagugcuauaucuccauuauauuaauaguucugaccucuucaaacugcagacauguuacuagaacagucugugaugugaugguuauuucuuuuuauaggucuauuuaucaaaucauuuuuuaaagaaauacuucauuuccccccaaaguuacucucuguacauuuuauugacuacauuuaagagaauggaaaaagaucaagucaaaggcccugcuacagaguuuaaaacaaauacaaaaagaaaaaaauaugcaggcauggcaaauaaauaagaaacagcagugugcacugagguccucccucagucuucaccuucucaguaaaugauguuccauccuuccaauuguucaagccaaaggccauagucaucuucuauuccccuccucucucacucuuccuccaucuagucuguccauaaauccugcuaguucuaucuucaaaauauaauuccaaucugaccccuuuucuccaccuccacugcucacacccuguccaagccaccaccaccucucaccuggauuacuguaauagccucccaccugagucccuugcuucuauccuagucaccuuagaguuuacauugcuaucagagugaucucuuuaaaaagguaaauaccaaaucacaucgaucuucuguuucccagcuuacucaaugaccuuccaagcucaacaugaucugcuccuauacuuucucaccccgucaucucugugacaucauuuucuguucacccauggcugaugugaguccacguggacacaccagucaugcugccacccacagccuuugccuuugcuuucccguugucgcucuggauuucggcauggcucauucccucaccuuuguuagagcuuugcucaaauaucaucaucccaaagaggccuuuauagaaccuaugcucuucaaagcugcagccccuccaaugcuggcacucucuggggcugugccaauuuaggauaagggcuuuaagggcuuuuuauuuauuuauuuauuuuuagagaagucuacaaguuuuuuucuuuguuuuuuuuucuuuuccaaagcacuuaucaccaacugacaauucauaaguuuuacuuacuuguuuguucauuguugccccaucauaaugugagcuccaugcaagcaggauucuauguuuuguuccuuacugcugcccuaguaccuacaacaacaccaggcauguggcaggugugcaaguacugugagcucacagagaaaauaaaugaaugacucaauaaccagauacgacuauguuauucuaugcugcacauauugagccauuuaucaaguucaccacagaaagauaacagaacuaauuuagcauuccuaagaagcaguaauuuccuaacaaacauuccaaggcaaaugcuuugguucuacaccuuucuaaagaauaacugacucucauaaauguuucauucgccacagcuuuucaaucuggugaguauucaagggaucagcaguaaaaagcagaaauacacaacuacacaagagcagaaaucccugugguuucuuuaauccauccagagccacucaaaaugcaaucauuaucucauuaaucaacuaucauuaaucauucacucacucuuaaccuuaugcaaccagugaucgggaucauggcggacaggaggcaggacuagauugcagcuccggacagggcagcaugcggaggccugcacugugaauuuuagcuccagauggacugcaagaacaaacuagcaaucccaagaggaccuacagacccucugaaggaagcagacugcuccugcaggacccaggagacacccaaauacugugagugccccaauuguggaagugggaacacacacccccgcuggagaagcugaaggucuguuugcaggaaaaguuuccgacuuuaccuggaacugagucaagcuagagagccaagccaaauacagggguagaggaagcaacaaaaaggcccugagaguucacuggguccccgagcagcccauuccugccuagcaccauagggauccaacgggaagguggccagaggagcaggggguaaaacuccacagggagaaggaauucucuagcugaacuuuuuaacaauuugaacugggcgagaagccuccuggccauaacuugggggagggcaccaaucgggugugcagacuucacaggccggggaagaacuaaagcccuuuuuucuugaagcugggaccaucggguaaggacaggacuaggcgugucugagcucagacucuccuugggugggucuugcugugguugcugugggggaugggggugagacucccaggucucuaccuaggaggauuauggcugccucugcugagucaugcagguugucaggaaagugggggaagccaggagucacaggccucacccagcucccacacaaacugaagagcugauuauaguggaagacaaagggcauauaaucuugggaguucuagggcccugcccacuaccggucccucuccacacuacuacagcugaugcuuucuggaaagcacgaccuuguggcaggaggccaaccagcacaaaaauagaucauuagaccaccaaagcuaaggacccucauggaguccauuacacccucugccaccuccaacagaacaggcacugguauccacagcugagagacucgcagacaguucacauaacagaacucugugcagacaacccccaguaccagccuggagccggguagacucacuggauggcuagacacagaagggagacaacaaucacugugguucagcucacaggaagccauacccauaggaaaagggggagaguacuacaucaagggaacacccgugggacaaaagaaucugaacaacagccuucaccccuagaccuucccucugacagagccuacccaaaugagaaggaaccaaaaaaaccaacucugguaauaugacaaaacaaggcucuucaacaccccccaaaaaaucacacuaguucaccagcaagggauccaaaccaagaagaaauuccugauuuaccugaaaaagaauuucaggagguuaguuauaaagcuaaucagggagagaccagagaaaggcaaagccaaaagcaaggaaauccaaaaaaugauggaagaagggagaaauauucauggaaauaguaacuuaaagaaaaaacgaucaaaaauucaggaaacuuuggacacauuuuuagaaugugaaaugcucuggaaagucucagcaauagaaaugaacaaguagaagaaagaaauuaagaguucaaagacaaagucuucgaauuaaccccauccaacaaagaaaaagaaaaaagaauaagaaaauaugaacaaaaccuccaagaagguuugauauguuaaacaaucaaaccaaagaauaauugguguaccugaggaagaagagaauucuuuuuuuuuuuuuuuugagacggagucucgcucuuucgcccaggccagagugcaguggcacuaucucggcucacugcaaccuccgccucccggguucacgccauucuccugccucagccuccugaguagcugggacuauaggcgcucguuaccacgcccggcuaauuuuuuguauuuuuaguagagacgggguuucacugcgucagccaggauggucucgaucuccugaccucgugauccgcccgccuuggccucccaaagugcugggauuacaagcaugagccacugugcccggccggaggaagagaauucuaaaagcuuggaaaacauauucgagggaauaaucgaggcaaacuuccuuggccuugugagagaccuagacaugaaaauacaggaagcacaaagaacaccugagaaauucauugcaaaaagaucaccuaggcacauugucaucagguuauccagaguuaagacaaaggaaagaaucuuuagagcugugagacagaagcaccagguaaacuauaaaggaaaaccuaucauauuaacagcagauuucucagcagaaacucuacaagcuaaaagggauuggggaccuaucuucagccuccucaaacaguuauuagccaagaauuuuguauucagccaaaguaagcaucauauaugaaagaaagauacaaucguuuucagacaaacaaaugcugagagaauuuuccacuaccaaaccaccacuacaagaacugcuaaaaggagcucuaaaucuugaaacaaauccuggaaacacaucaaaacagaaccucuuuaaagcauaaaucacacaggaucuauaaaacaaaaauacaaguuagaaagcaaaaacaaaaaaacaaaaccaaagcacacaggcaacaaagagcaugaugaaagcaaugguaccucacauuucaacacuaacauugaauguaauggccuaaauguuccacuuaaaagauacagaagcacagaauggauaagaacucaccaaccaucugcugccuucaggagacucaccugacacauaaacacucacauaaacuuaaaguaaagggguggaaaaggcauuccaagcaaauggacaccaaaagcaagcaggaguagcuauucuuauaucagacaaaacaaacuuuaaagcaacaguggcuaagagacaaagagggacaguauauaaugguaaaaggccuuguccaacaggaaaauaucacaauccuaaacauauaugcaccuaacacuggagcuaccacacuuaccaaacaauuacuaaugaccuaagaaauguuggccgggcgugguggcucacgccuguaaucccagcacuuugggaggccaaggcgggcggaucaccuggggucaagaauucgagaccagccugaccaacauagugaaacucugucucuacuaaaaauacaaaaauuagccaggcaugguggcaccugccuguaaucccagcuacuugggaggcugaggcaggagaaucacuugaaccugggaggcagagguugcagugagccgagaucgcaccacugcacuccagccugggcaacaagagcgaaacuccaucucaaaaaaaaagaaaggaaggaaggaaggaagagaaaggacauagacagcaacacaauaauagugggggacuucaauacuccacugacagcacuagacaggucaucaagacagaaagucaacaaagaaacaauggauuuacaccauaccuuggaacaaauggacuuaacagauauauacagaacauuucauccaacaacugcagaauacacauucuauucaacagugcauggaacuuucuccaagauagaccauaugauaggccauaaaacaagccucaauaaauuuaagaaaacugaaauuacaucaagcacucucucagaucacaguggaauaaaacuggaaauugacuccaaaaggaaccuucaaaaccaugcaaauacguggaaauuaaauaaccugcugaaugagcauugggucaaaaacaaaaccaagauggaaauuaaaacauucuucgaacugaaugacaaugaugccacaaccuaucaaaaccucugggauacagcaaagguggugcuaacaggaaaguucauagcccuaaaugccuacaucaaaaggucugaaagagcacagacagacaaucugaggucauaccucaaggaacuagacaaacaagaacaaaccaaaccuaaacccagcggaagaaagaaaacagccgagaucagcacagaacuaaaugaaauugaaauaacaacaacaacaacaaaauacauaagauaaaugaaacaaaaagcugguucuuugaaaagauaaauaaaauugauagaccauuagcaagauuaaccaagaaaagaagagagaaaauccaaaaaaaccucacuaagaaaugaaacaggagauauuacaacugacaccacugaaaucaaaagaucauucaagcuacuaugaacaccuuuacacacauacacuagaaaaucuagaagggauggauaaauuccuggaaaaaugaaacccuccuagcuuaaaucaggaagaauuagauacccugaauagaccaauaacaagcagugagauugaaaugauaauuuaaaaauuaccagccaaaaaaggucuaggaccagauggauuuacagcagaauucuaccagacauucaaagaauugguaccaauccuuaugacacuauuccacaagauagagaaagaaggaauccucccuaauucauucuaugaagccagcaucaaccuaauaccaaaaccaggaaaggacauuaccaaaaaagaaaacuacacaccgauauccuugaugaacacagaugcuaaaauccuuagcaaaauacuagcuaacugaauccaacaacauaucaaaaagauaauccaccaugaucaaguggguuucguaccagggaugcaggaaugguuuaacauacacaagcuaauaaaugcaauacaccacauaaacagaauuaaaaacaaaaaucacaugaucaucucaauaggugcagaaaaagcauuugacaaaauccagcaucccuuuaucauuaaaacucucagcaaaaucggcauacaagggacauaccucaauguaauaaaagccaucugugacaaacccacagccagcauaauacugaauggggaaaaguugaaagcauucccucugagaauuggaacaagacaaggaugcccacucucaccacucuucuucaacauaguacugaaaguccuagccagagcaaucagacaagagaaagaaagaaagggcauccaagucaguaaagaggaagucagacugucacuguuugcugaugauaugauuguuuaccuugaaaacccuaaggacuccucuagaaagcuccuagaacugauaaaagaauucagcaaaguuuccagauacaagauuaauguaaacaaaucaguagcucuucuauacaccaacagcgaucaaucagagaaucaaaucaagaacucaaccccuuuuacaauagcugcaaaaaaaaaaaauacuuaggaauauaccuaacaaagggucaaaaaaccucuauacuaaaacacugcugaaagaaaucauggaugacacaaacaaauggaaauacaucccaugcucacagauggguagaaucaauauuugaagacgagcauacugccaaaagcaaucuacaaauucaacacaauccccaucagaauaccaccaucauucuucacagaauuagcaaaaacaauucuaaaacuaauauggaaccaaaaaagagcccacauagccaaagcaagacuaagcaaaagaacaaaucuggaggcauugcauuaccugauuucaaacuauacuguaaggccauagucaccaaaacagcauggcacugguauaaaaauaggcauauagaccaauggcauauagaacccagaaauaaacccaaauacuuacagccaacugaucuuugauaaagcaaacaaaacauaaaguggggaaaaggacacccuuuucaauaaauggugcugggauaaauggcuagccacauguaggagaaugaaacuggaucuucaucucucaccuuaaagaaaaaucaacucaagauggauuaaggacuuaaaccuaagaccugaaacuauaaaaauucuagaagaaaacauugaaaaacccuucuagacauuggcuuauaggcaaagauuucaugaccaagaacccaaaaggaaaugcaauaaaaacaaagauaaauaguugggaccuaauuaaacuaaagaacuuuugcauggcaaaaggaaaagucagcagaguaaagagacaacccaaagaaugggagaaaaucuucauaaucuaugcaucuaacaaagaaauaauauccagaaucuacaaugaacucaaacaaaucaguaagaaaaaaaacaaucccaucaaaaagugggcuaaggauagacaauucucaaaagaagauauacaaauggccaacaaacauaugaaaagaugcucaacaucacuaaugaucagggaaaugcaaaucaaaaucacaaugcaauaccaccuuacuccugcaagaauggccauaauaaaaaaauaaaaaaacaguagacacuggcguggaugcagugaacagggaacacuucuacacugcuggugggaauguaaacuaguaccgccacuauggaaaacaguguggagauuccuuaaacagcuaaaaauagaucuauuugauccaggaaucccacuacuggguaucuaccccgaggaaaagacgucauuauucaaaaaagauacuugcgcacagauguuuauaguagcacaauucacaacugcaaaaucauggaaccaccccaaaugaccaucaaccaacccaaaugcccaucaaucaaugaguggauaaagaaacuguaguguguguguauguacauacauacauauauauauauaugauggaaugcuacauagucauaaaaaggaauggauuuacagcauuugcagugaccuggaugagaguggagacuauuauucuaagugaugucacucaggaauggaaaaccaagcaucauauguucucgcugauaugugguagcuaaguagugacgcaaagacaugauaaugauacaauggacuuuggggacuuggggggaauuggggaggggggugagggauaaaagacuacaaauauggugcaguguauacugcucgggugauggaugcaccaaaaucucacaaaucaccacuaaagaaccuacucauguaaccaaauaccaccuguaccccaaacacuuauggaaaaauaaauaaauagauuuguaauguuaaaaaauaaauaaaacuaacacaaccacagucaacaguaaugcaaaagcaauauugcuauuagaaaaagcacaucaggaucuaaaauuaauuuaucagauuuuacuuuugugauguuucaguuagaaaaaaaccuugugcagccaaaaaacacaugaaaaaaugcucaucaucacuggccaucagagaaaugcaaaucaaaaccacaaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggugauuccucagggaucuagaacuagaaauaccauuugaccaagccaucccauuacuggguauauacccaaaggacuauaaaucaugcugcuauaaagacacaugcacacguauguuuauuguggcacuauucacaauagcaaagacuuggaaccaacccaaauguccaacaaugauagacuggauuaagaaaauguggcacauauacaccauggaauacuaugcagccaugaaaaaugaugaguucauguccuuuguagggacauggaugaaacuggaaaucaucauucucaguaaacuaucgcaagaacaaaaaaccaaacacugcauauucucacucauaggugggaacugaacaaugagaucacauggacacaggaaggggaacaucagacucuggggacuguugugggguggggggaggggggagggauagcauugggagauauaccuaaugcuagaugacgaguuagugggugcagcgcaccagcauggcacauguauacauauguaacuaaccugcacaaugugcacauguacccuaaaacuuaaaguauaauaauaaaagaaaaaaaaaaaagaaaaaaugcccuuauucuaaauuggcauagccacaugugagauuucuaaucuauuugguuuuaguuuaggcuaauaaaagacaguugcuuaucaugggaauguuuaacgagggaaauuagggaauguacuauguucucuggggacauuuaaaacaggaaaaccauaaaucugugcacuuuauucugcuuaugaguggagcauuggauucagucucuaaaugucauuccagaaccuuccuuguacauuaugcuauacaggaugguucacuugaggcaggcaggcuucaauagugcaauagcauuuagaaguguuuauuuuaaauuauguuauacuacccacuuagaugacauauuucauagcacuaacaaaaaacauuucuccuauuucugcuaucuuucaaauaucuguauuacauccaccaguauuguuugucaaggauuucucuuaauuacguaaguauuguuuauucuauuauaaaccguaaguuuaauaaguagcucugaggcaucaguaaaugcuaauauaaaaauuaagaaaaacacauuaugagguaaaagagauaaagucauaauguugccuguaaauacugauucucagaguuguagagauuccauuuucuuaauuauuaguaguauuaauuaaauucaaagcucauuauuucuuaaggagaaaaagaagaauuuugggggguuuuaacucccucuacuucuauuuuagguucauccugaucaugcuagaaaaauauuagcaaaaauauucuauucuaauauguacugagaaauuaauuuaacaguauaauuuucagcuuagacacaugcuauaaaaagaaaaaauguuuuacuuagacaauagaauauuagguuaaacaaagaguucucaucauaaaaaucuuauuucuaguaaauucuauggcacuuaaagaguuaaagauugaaaugaaaaaacuauaccucuaaaagggcugaauacacagaaguuuuuaaaaccauauaugguaaacauaaaaacaguaguauucuacaaagcuaaaaauauaacucugaaacaguguaucaguauugucaauacacgucauuaaacacagaaccuacaauucucauacuuugucauuauauuacagaaaauugcaaaaaaaccuauuuauauauugaaauguaagaaacagauaugcauaaaaaucaugaaaacacggccugaacauauuucacuguaccauuucuuuaagaggguccaucugaauugaauuucaaauaauauauaucaacaccuuuacaaaaauguuacuuaggaacccuucuuucucucuccucauuuuuucuucugguuaaggaacucaguguaaccccagcuccccuacuccuuacucacuuccaucauugggagguggagugacugaccaaugauaagcuugggaagaagaacuaggcauuccgccacaguucugccauucuuuuauaagcaagccuacccacauaaaccaugcauuuuccauugcuccccgugccauacauuguccuucuggacccaauuuugucaguaaccuguugcuauagccugaacugggaucuuaaagauaacuuuuagcccucacauuaagcuacagccuucaacuuggccauuuucaauaauaaaagugauauuuugacugccaaguguacucuauugggagccucuuggaaagcacaaugccuagcaacagguaaccccauuuuuaggagcuuguccugaggagcuaacccugaacaagaaacacucuuuuaaaaaugcacaaagauguucacuucuauacuacuaauaauaaacugccaaaaucuaaauacccauacuggguauaaaucaacugauaaauccacaugacagacucucauacaaucgugaaaagaauuaacuauaaaaacuguguaacaguauggggaaaugcuuuuaaaauaaugucagaauuaaaaugaagguagaaugaaaucuaaaauucuuuccauggccuacaugucccuaccugcccugauucuugacuuccuuuuuguuucuacuauucuccagcuauccuugcuuucauuccauuucauggagaaguuaagcuucuguacucacuauuuacugacaagcuccuucuuauuugugucucugcuuccaugccauguccuccagaaagaaauauuugaucacccuaucuaucacauccuacccuauacucuuuccacuuugccuuauuuuaugcuuuguacuuaccaccaucugauuuuuuauuuacuugccuuucuauacccagcagaauguagguuccacaagagcaaggccaugucccagcauuuacagcagugcuuaacacaguaggcccucaacaaauacucauuugaaugacaaauaaagacauaauauguauaaauuaaacacauaaaauagguaaauuaaaaacauaaacauuauguaaagaaggaauuuuagagggcaauauuaauuauguggcaauaagcuuaaugggaagaagaucaugccaaaccacauaggccaugaagccagggcuacaucugugggacagacacggcaauggagaauuaagaaagguggacuucugcucccaaucccacuuuaaccagaguagugcugcuuauuccuuauuuucuacauugggcauccauccaaauuuugucuaauaaauaguuucguggcuuuaaaauguuugaaaacagcacauuagugcuucaucaaugugaguguacuguuuaagauauaaggaccagaaaagaaaacucaauuaguuggguauaaaucauauaaagauaacuaauuaugaaggagaaauuaggaagaaaaaaagauuuaggccccuccugccaaaaaaaaaaaaaagaaaaccacaccaaacuuuccuaaaauaaagguaugguaaagagcuagaaauaaccagaaaaccaagcaaaauaaaacauaaaacaaagcauauucacaugugcaaucuauacugaaagcuuuaaaauauguacagguugagccagguugagggagcuucccuaauccaaaaaucuaagaucagaaaugcuccaaaaucugaaacuuuuugaacguugacaugaugaugaagaugacguuguuaacacugcagaagugccucuggacauauggugaaagugugugacgggcuuugugaagaacgagagccagugugcauucauaacaagaaaucaugccaguuuauauuugguuggugcaaaaguaauuauugauuuugccaucaaaagcaauggcaaaaaccgcaauuacuuuugcaccaaccuaauaaaaucaaagagagacuucuaagcaaaaacucuguuaaugaggcagaugacucuggaggaaacauuuuaaaaagccauccagcagaaugcccccuuauccguagaggacccacuuccuggucccucuacugcuucugauguuucuuaaaaaaaaaaaaaguaaaauacauccuacaguaaccuuuucaaagguuuaaaacacggcaucauaaguggugacugaaagccugccauuuucauuguugcuauuuuucaacagcugauacaguuaucugggugauguuacugugcugcuuggugaacauauuauuuuuucaaugucuuaaugcauguccaauuuuuuuuuuuuuacuguuaaguaauuaggugugaauaaguacaagaaaguaauugccuauugguagcauacagauucagagucaggaaugauggugaugccaaacaaccacugauuguccacauggguggcugagauagugauaucuuugcuuucugaggguucaaugguucaauguacagaaacuuuguuuaaugcacaaaauuacuuaaaauauuacauaaaauuaccuucaggcgauguguauaaaguguauaugaaacauccaugacuuucauggucagacuugagucccauccccaagauaucucauuaugaauaugcaaauauuccaaaauccaaaaaaucuuaaaucugaaacacuucuggccccaagcacugugguaaggaauacucaaccuguacaaguaaaauguauuaccaaaaacucagugcgccauaccugaccagagucuccaguacaauauucaguaauaucacacucguucacagcaucccggcauucauacccucguggcugaaacugcaaaucaaaauucaauauuaagaguuagcauuacauaauauuucagaguuauuauaacauucuuagacucaccgacaaugccuauacucucgcauaacuaacaccaaacucuuuuuaagaauuagcaagacagaauauccuauugcagaauagaaacaagacccagaugcuacccucuacacuaaagaugaaucaucaaccaaagcuuuaaauguucagauuucaaaacccacuguuucagaguacuauuuucagaaaacaaugugacggaaaucaccuaaagaagaaauucugguuuggcuuaagacaaaauagcaaaacacuauaauauaaacauuuaagaucucucugaagaauucacauauauacccaaccuucacugaauuaccuauuagcauagauauuaaacuuucuuuugcuaaacacagacaaucaaauuuuaauaaauucauacgaauuaccuuuaguaaugccagggaaugccuuuuguauacaaagcauuuuauuugaggaggguguggguaaaaggugaaggaaagagcccauugcccucaagcaauuuauaaucugguuggggacaugaagcaaggagaaauaagcuagaaacuucuaaauaccauaaugcauaguacccccuaauauugaaacaaaaucauaaaauuauguaauucuaugguuauaagaaauauuagagguuauauauaugagaaaagggaagauuaaaaugaguuuucaaaaauaacugguggucucuguagauggaagacugugucuguccacacacacacacaaaccauguauauacacauaugagugugcauucauauguuacuuuccuaucucacuuucuugccuuuacaggggauuuuaaaagcccaaugggaaaauaugagcacuagcuuuuauguucaggucuaaaauaaauuaggguaaguuuugaagaaaaauguuauaaguaggucauauuauuaaaaagaccacagaaauugucuccccucuauucaacaauuuaauuuggauuucaucuauguuaguagggcaacucuuuuggaagcaguuuagguauauuuuccuaaugaggcauuggaggauaagaugguugguagugaauaauaguagagauaaauguugcggcccacagaauuugagauuuaucgauccuagaaaacugccaggcuaauauguacacuguacccaagaaauuugugacaagcuacacaaaugcucaguguacacacugagauaucuggcuaaucugucaauuaaaagaaagaugaaacugucagaaaacucacaagacaugagguauuguuacagcagggcccgucgcugcagugagccccguuggagagggaacauuucuuacagcauaauccauagcauuccuagagaaaacacuucacgugaguaagcgaagagccuuaccugcuggucauucauauucucuccacacguggcaugcauauuccaaaugagaacauuuauacaacaguaagcaaauauucugggaaagaauuaauuacuuuaaacaaggauagauuccuuccugccauacuugucaccaaaguaagaucuucuaugaaaggacuucaauagcaaauagaaagcuuuauuuuuuuuuuccuuuuuguuuuuuugagacggagucuugcucuuucacacaggccggacugcaguggcacuaucuuggcucacugcaaccuccgccucccggguucaugccauucuccugccucagccucccgaguagcugggacuacaggcgcccgccaccgcgcccggcuaauuuuuuguauuuuuaguaaagacgggguuucaccguguuagccaggauggucucuaucuccugaccucgugaucugcccgccucggccucccaaagugcugggauuacaggcgucagccaccgcgcccggccgagaaagcuuaauuuuuagcaggcaauucuccuccaauuagcuccacuacauucuaauacccaaucuauuuuauaaagauaaaaauaauauacaacacggaaagaauguuuuacgauuugguaaaacuuaucugagaugaauaugagcuacaaauuuuuaagagguagggaauuuaauuagaagaaucuauuagguuugcucagacaaggccauaaggacaugacugauuccaacaggucugaguugaauuaagcacuaaucagagagaugagaaagaaaggcaguaagaccacaaucaaugugcuggccucucacaaaugcuauaccuguuugcaccaaguaagaucugugcuguaaguauagaagguuucuuauaccuaccacaugaaaaccacaaucacacuccuccccagcuuccacguauccauuuccacauuccgugggcucaaauagcuaaagagauuagggacagaagggaaaaauguuucaauuuaucacagaaaaucagcacaucaacugggccacauacaauggccguauaaucagcuaucaugugauauucuucuuugaucuguuguuguggcaucuuauaaaugaugacuguaugggaaauacuguucacuuauuaauaguacuuaaaaauauaucugaaauggggcaauaucucuugggggauucucuggcugugggcuccacagaugaacucuagcauuagaguuacuuuucauggagacaagcugucaagaggaauagaucacuuuucauauuugcuaauggagcuaaaaugcauugcuaauaagacucacagauaucuaauuugcuaacuugucucaagacagcugagaagccauaaaaacugucaaaaagauaaauaugcuucagucauagccaaaugugauauguacaaucaaguaaaugcaaguaaacuuaggggaaaaaauguugcuagaaauccaagaccaucauucucacugaaaagaaaucucaagugucugcaagcauaagacacauguauggauauacagaaaucucucagucauuccuagggcaauagaagaguauaauuucuagaauaaucuagucuacuggugccaugaacuugcuugccagauaaacuauauuauagagcaacuguaaagguaguugacuguuuaugagaaacaugccugcuucccauuccaggggcaguggggaggggggcaggauuucucugggcauaaucacuacaccuuaaaugaaggcuggagcagcacacuccaacccaaaugcucugagcccuaaauaugagagggagaaacugacuccaucuccagcagcugaacacaccucaaggaagcgcugccuuccacuaaauucaccugagaaagaacugauccuccuuccacuuccaggaaggcaaaacuauuacgaaaagcaaagguuuccaggcuacuugggugggacucccccuguggaaaaguccuaugagcaaaaucagcauugcacaucucuguguuauuuugaucaggaggcaggagaaacuggaaaagggaagggcugacuagaacauggccugcacuuuauaccaggcucccccuucuuuccuucuuaggacucugccuccauccugagacgggucacuaucuccaacaguguggaaaacauggcaguggggaagauuccuaaagcacagaaaauaugcacacauauaauguaaaaauaauacacacacaacacaugcauauacauacauucaaaacgcuugggggaaaaagucacuucuuugauacauacauauaaacuauuccacuggcauccauaguuguuuauuaaccauuguacuacguaguuuaaaaagacauaauuccauauuuacuaacuuuuuaaaaaauagaugauuuauaguuauuuuuauuucauuuccaaguuauuagaauaauuuucuccuaacucauagacaauuucagaaauccauugauggaucuuuaugcauaugcuagaaaccuuaaccuuuccaaacaagugagaguuguuuccucaggcaugaugcuuauaauuagcuccuaagcuacaagguggguaaaauuagccauguacauuacaauucaaaaaugccagcagcucacauuaguucauuauuacuuauuucacccauuuugaacacuuugaagcuuuuggauuucuguugcauugaaaucaacguuaugaaaggcaggcaacugacuuucacgacgcaaggucacuuugaaaguccuguuucuuuuuuccacagccauacuaagauucuacacagaugucaggcaucaagccaccaucuccugacuacguagugucacuuaauuauggguuuaggaauaaauuauccuguuaguuaccacauuaguuacugauuuaaaaaaaaagguuaacauuauuucgcugcucucucaguuugcaaaguauuaaacauuuugcauagcaaugagcuauauuugacucaugaaguaguauuuuaaaaagaaauacgaaauuugccauguuagaauuuccauaccaucugcuaauuagcauugauccuaucuuuugccugcugagcaacuucauuuccaaacaugcuacugcaggucuacagccccgauuuaugcaaaagcuuugaagcuggugaguuugagacuuccagcuuugcugaaguuuagagaaguacgaugcauuuaccauauucuauauaauaguccugaggggccugggacacacccuauaaucaguuaauauuucugcaacaagacuuaugaauauuuaccuuaugagguauaaauauuuucaguuuaggacaaguuuuacugucaaauguguuuuccacaaacauaaaaaacacuucugaaaauuuucaguuuucugaauuaagaauacacgaauaagggauugugacacuauauacacaaaguuugacgagaugccaauugacaauguggcccucuccagguaaagagacaaugcauuauaaacacguauguguauuuaugguauccauaaauaccuugggugauuuuuuggcucgcugauauucauaaggaacuaaugucccaagaggacaaaccacucaaaaaaaaacaaaagucaagaaauuagucaggcccugcaugguuuggcucuguguccccacccaaaucucaucuugaguucuacucuccacuguugagggagggaccuaccugguggaaggugacugaaucaugggggcgguuuccccauacaguccucaugauagugagugagucucacuagagcugauaguuuuaaacuguggcacuuccucgcacucuuucucucucuccugccaccuugugaagaagaugccugcuuccccuuuaccuucuaccaugauuauaaguuuccugaggccucccuagccauguggaaaugugagucaauuaaaacucuuuugucuauaaauuacccagucugagguaguaucuuuauagcagugugaaaauggacuaauacuugucccuagaaagaaugucaaggagaaauggaauuuuuaucagagaaauuaguuaaaauaauauuuuaucuuaauuuaacccaccaucucuuagcagcaggguaaaaaucuuaacaugaaaaucucaaagauauuuuaauugaaggauuguuugcucuuuggaagggaggauuugggaguucuagcuagcacugaaacaccagagacugagaaugcugaaucuaugguuuugucauucauuuaaacaggacucaaucuuuaacaugauaaggacuuuuauaacuaaauauuaaucugauugacaagaaaccugcuuuccaagacaggcgucugauauccagcacuguugcacuguaaaacacuggagaaauaauauacuuucuuaguaugcuuucuaaguuacuaaccuuuguuggccuguugaaaaggcaggcuccaccuccucucuguaaaaagucucuauacuccaaaaugcugcacuuugaaaauuuucgagaaugggacacccugaggaaacaaagaaucaacuauguaaauaauuuaccaaaagcaaucaucagagaagaaaauuaaaaccccuaaauuagaacaaaauguucacuuugaauccaaaugaaucuacacaaauuuugacaagggacuuauguucaaauugccacuuaaguaccugugguggaguuugcagagauggaauuucaaagaaaaucaaagauuugggggcuacauuacaaccuccucagcagucaagcccuuuugugaccaggcuugaaauguuuuuuaaaaagcucauuacaaaaccucuucaaauaggcuguauuuuaaaguuuguuaauuuuuauuugcuauaucucauuaaagucaagcauuuuuuuuuuuugccucuguuuucugaauaaaaggagcucaugaacguacuagauuuuacauuggaggagagaguugugagggccaguauauuaaagacuauaucaugcaggccaacaaugcauucagguaaacaaggaaaccuuaaagagguguguuagaucauauauguauaugcacguauguuuuuaguauguauaugcacagugacaauagaauugggguacgcuuccaugaauaauggcucuuuauucucaauuucaaauacuauuuggugauauucauuauuaaucaggaauagaaaaugagccuuucugugaauuacuuaaucaaauauaauaucucuaugucagaacacaggggaauauuauacacaugguuaguuaaacugaaucacacacacgcacaccuauuccucaggaauacagugcgugauuauaacagugcuugacuugcgagugacaggccacuuauucuaggaaguaauucaauaauuuuaugcauucugauguaugaagguaguuuacagaaguaggugaaaccugccacuguugauaggaaccucuuagaaaaauauauagaaauguauucuugagaaaauacauguuaacuuuaaaacauuuuaucuuauuuaaaacauuuuauauauuuuauuauauaaaauauauuaaagauauuauauguuauauauauuaugaagagucauuguaaaaacuucagagauuaauuuagaagacagaagacaucucccuauagaaccaauauuauagguguuaucuucuuauaguaguccucaaaaagccugguuaagccauaaauuacuaagcuauggaguaauagggaaccguggaagcuaaggguuucacguuuuaaacucuauuucuagaaaugcguucuaaaguagcagggauaauggccuacugugcaaaccuucaugcccacacuccuccccaggaguuggacuccuaggagggcugguggaagaaaacaaaggagcucuguccaaguaggucagggccucuggcaaccagagggacggagguaggaccagaaaugguugguguguugagcaggugucuggcauggcaaagaaagcaaaagaggcacaugggugaggaaaccucuccccucuacuaggaguggguuauggcuuagggggucugggggcaguggcucccaugaggcaggggucccugugaaagagggcaauauuuccaggccuugguucacugaagcaacagcagcucuggggaagcugcucuaguucccaaaguauucacaaaagaaaagugagggaauguucaaaugucuaucacuagaagacuaccugauuuagauacaauaagucugucuuaauuuuuaaaaagcuuuauugauuuauaaacaguaaaguuuaauuuuuauuaccguaaacauauauauuuacgaguuccuuaaaauguaaauugaugacuaaauugauuuucacugacugcuucagguagauaaccaacuuuuaaucuaaguguacuaaaaaauuaaugccuccacuaaacuuagaagccuuuaaucaugugcuuccuuuaaggguuaauaagaaguagaagguaauacauuuuacuuuuaucaccaaccuuaaauaaaaaauuaaaauacaaaguaaauuagaucuuucaguuuaaaaauaucagacaauuaauuauucauuuuauauugugcuuagccuaaaagaccaauacccgagagaccuuguuucuaacucuacacagcaauuuuagcaaaaggcauauaucaaaugcacgcauaaugaaaauuuacccuguuuccuccaugaugcagccaccccaggauucugugcagucacauucugguccaauaaaacaauaaaagcaacagaagaaaaaggaaacaaagaaagucacauauuuuuuugguauuacaacuccuacaauaauucuuuauuaccaauuccaugucagucaaauagacacggaaugugaagucuuacagaacaaaauuucuuuuaaaucaauaguuccuuauccuuuccagaauuauagguuaauuccuaagaaaacagcuggcaagaaguaauauugugccucucuucauuauuuuuguaacucugacaacucaauuugguuccuaguucuaauguuuagugaaaaguacccuggucuacaaaucagacagccugaguucuaguccaagaucugucauaugagagagucccauaggcaaguaacuuagcauuuccugggucucaguguuucuaccucuaaaugggaauaacaccuuuuugucuaucucccagagugguugugggguucacacuagacgguguaccuaugugcugugaauuuuaaagcucuguugcacaaacacaacauaucaucacugaaguuuucuaacagagaaugcucgaaguuagagaagagaauucaauuuguuagaguugaagugaggaugagcaagagacuugaaugaacacuaugcuaaaagguuuagugaaagagagcaaucuaaaacagaaguguacauaaucacuuaaaaacaauuacaacuuaacuucgauaccagaaacugacauauugauauugugaugggcucuucucuucauuaauuuuuuccuguuucucuuuucuaugccucucucucuaucgauauaucgauagagagagcaauauauaucaacguauauauauagagagagguauacaucuaucuauauauaccuauauagagagagagagguauaugcaaagauagacuuccaaauggauuuuuuaaacucaaaguuuagaaccaaugaaauagcuaccuaaacaaacaagucacaaagaaauaaagaauuuuaggccgggcgcaguggcucacaccuguaaucccagcacuaugggaggccgaggugggcagaucaugaggucaggagaucgagaccauacuggcuaacacagugaaaccccaucucuacuaaaaauacaaaaaaauuagccgggugugguggugggcaccuguaguccuggcuacucgggaggcugaggcaggagaauggcaugaacccaggagguggagguugcagugagccgagaucgugccacugcacuccagccugggagacagagugagacucauucucaaaaaaaaaaaaaaaaaaaagaauuuuaggaaggagggaacgauggcaggcauuaguaaugaagucuacuucucacccuauuccaucaugcaacucaguaacaccucucagcugacucuagcacuggccuccucccagauucaagauuucuaaacaagggcauaaaccuggucauacaccuuucugguuuuaagguguuuaugccagauggugaaacucuaaacacuuccuuuaauguguacuagguguuuccugggagagcaaacacucugagcaagauaaucaauggaaguuugcggagguuugugaaaugccaccagacacuugugaugacuaucuuaauguacccauaaagggaauugagaagccuguguaaauauaauuuguuucaauuuuccacaauauuaugcauuaaugaaaaaaagaauauaaaauauagaaugauauuaagguagauuuuuccuuuucuucucuagggagguuggggugguaagugagaccuuuacucccagugucucauauuuucaaaaaauaggaaggcacuuucaucuaauuucuaguuaagugaauaauaugaaugaacacuuuggucucucuuuccaccggauugcauuaggucguugcccacugucauaaaaauguauuaaaaauuauauuuuaccacuggguuuguauaaagauaaacacaaucuggguugacuuuuauucugauuuuaaaagaaauuaacauuuuucauggacccuucagauuacugugagcccuagacccuuugcccacuagaaaaucagcccugucuuccuaucuaccucucaucugauuaacgaaaaaaugacgccuaacagucacuggcuauguuuuuuacugaugggauguguggcccuauugguucuccuuuuuggaccugccugggccacuagaggagaauccuauccucuaccaccuguucccaugcuuaaaaggcccuggggcagggucuucccuugcaaagccuuuuucuccaacuuuucugaugagacuagguggguaaauuucauuagaguuuaaagaugagcucucuuugacucuagaucuaagcuauuucccaauccaacugugaucucacuaagcuugugauggaggcuuuaucuagcaccuuguacgucugcucagcugcuagaacccugagugugagaguauucccugcccccagccccacauucugcagugugagaaagagcugacucauucccggagaaacuggguaugauuuuauggauuuugaaagggaaauuuuuacaaccuaaacagauuaaaaauuaccuuaaguugcuuauuuucuaaauauuuuagaggaaggagauauacuacaauuaaacuauaaugacuggaaugaaaaauauuuauuuauugacuggacaugcauuauacagacagaauggcacaugaaaaugaguaagaaggucaguguacauacuuggcuuucugcuagaagguucccauuggauuccaagguuuugagccaggcucugcgauaauacuugugccacugccauuggaagaccauacuguuuuucagaguugaaagugugugggagacauuugagagagugcacaaagcuaguuauuauuucuuaauuguuaccacaaaucuucucaguucccuaaguagagccugucaguaucuuaagauggcauaugcuacuucucaccuccucuuuacaacugggcccaagaagcagaaagccccucuuacuaugugauaucucucagaauuugaagcucucacauugaaacauaaaauacaagucacaaaaggcugugcuccaauucaacuuauaccaaacuaagaauaaauuuaacuuacuaaaauaugucaagagagguaccuacuaaaugggcaacugggauaaccugguauaauauacuccaauauuauuccaggcuaauuguaggcuauugagauaaccugguauaauauauuucaguauugacaagaguuuagauauaauugguuaugcuuuuugggugcuguuaccaauuaagaauuuccuuuauaaaacugaaaguauuaaaaucugaacaaugagauuaaggaaauagguguuugaguucauucuacagauagguagguagaaggcaugaaaaugaaaauauauacauagggagaaaaaaacauacaguacugauaucagaaauccuuugauuuuaaugaguuaaauuuaacauagacagaggagcauuauaacaaaaaaaaagucagagaaggauuaauaagcuuauaaaagcuuaacaucuuaucuauagaggccuaaaagucuccaggccaaucuucagcugcauuugccugauauauacgaaaaauugucauuaugacaccaaaauaugucacuaugaaccaaaaggaccacguuggguucuauuuauuaauaacauaagccacucaugcuacauuugccaugucaucauucuaaacaagcacgagaaaggauguaaacugggccauagggaaaaaagagaacagaugcaaagaugaaacucuaauugguaaaauuuaccucauucacaccaacuccucuugugcgagaacagacaccuccaaaguaacucagacugcuucucuuauagugaaaugucacccgccuuaagaaaaagcagugcuaucagaaaaccaacgugguggaccaucauuucauacucucccaaaauaugucuacccuccuacauggaacacccccaaaccauccuccuccaagaaaucaaaaacuuuauuucaacuaccuuaaaauuuaugacauaauuaccuuuaaauuuguuauguuacguaauuucaauugagcaagcaccaaguaccuacuaagcaucauguacuagcacaggaauugaaaacaccaagauaaacagacacagcucuugacuuuuuucuaguagagaauaucuagcagugauuaaaaagaauuaauauugcugauuauuaaaaauugcugauuaaagacugaaaaaacaggaagucaacgguaauggugggaggaaaagaaggagugguuugguugguuugauuccaggacagaaccuuagaggacuaucugaaaauagcuuugccaugacuggggaagagaauagcuuauuauauuaaaaagaaaguauagaacccuuuuuccuuaguaguagaaacucaacugaauaguucaucuaaaaggacuacauuuugcuagccucucuuguagcuagguguggcccaugugacuaacaccuagcaaaugauuuguucaugaaacauacaugugcaagcuuucaggaaaccugcuuuacagcagucagcucggcuggaaggaguacccuuuugcccuucuccccacaugucaugcccgcugccaguaaugaaggcuggagggccagcaggcauccuagauugugaguugaucuugaggauggaaguuaugggcucuaaagguagauauugugacuacagaaccaucagcaucccagcaugggauauccuaacuccaugcuucuuaucuaacagacaaaggaacccacagaaaucuuguucaagucacuauuuucugauauuuaacuuaacugaaccaaaaaagggauaaggauaaaugucagaccaaagacuacacuaaaggcugaaaugaguacguacgagaugaggugcacagcaucagcaugcugcuuaaugcgcugccgguauuuugagaacucauggagcaucugcacaggguugguggugaugucaaucugauccuucucaguccaggucucuacagccaccaggacaacccugguguugagcugcuccuuguaaaucugaggguauacaacaggacaggugcaggaggaaaacacugggucaaacaugcacgaucagugagucagagucaguggaaggacaggaagggggaggugagagaacacggggucauaauuagcccauuauagagaaucuucuuuuccuuucuuuuuuccaagagcaaaaauaaagaaagaacaaucacacaauuugguuucaacucuccuauaggguuauuucgaucccagagcaauacauucacuguccuagggagagacaguaaggauuccaaagccagggcauaaauuuaaaacaucguucaguaaaaucacccuuucaaaucucauagcagguaacagguuggagccugauauaccaguucugaguaaccgcagugcaacaauuuauuccugcuggauuggaaugaaucacuaaaucuccagauaagcaccaaacaauauagcuggcuuacccuuggaggucauauuauaugaaaaguaaaauaacauugggagagagagagacucaaggaucugaggcuaaaaaagagcagaucccuaucacucaucucauccucaccacuggguggcaucacccacaauauuuaaauuguucccuuucugcucucucucuauuuuuggcccaguagcuaaacaauucacacaauuaagcaacuucaaugaaugcugucauuuugcccuguuuucaaacuaauuaagaaaacaaugggccaggcgcgguagcucacgccuguaaucccagcacuuuggaaggccgaggcgggugcuucacagggucaggagaucaagaccauccuggcuaacacggugaaaccccgucucuacuaaaaauacaaaaaauuagccaagugugauggugggcgccuguagucccagcuacucgggaggcugaggcaggagaauggcgugaaccugggaggcggagcuugcagugagcugagaucgugccacugcacuccagccugggcaacagagcaagacucugucucaaagaaaaacaaacaaacaaacaaacaaacaaacaaacaaaaaccaauggaugaucuuugaacacacugaagaaggggaacaccauuaugccuaaaucaaauugaagcuauuauauaaugacuuuacaacaaaaacaaguuaaauguaaugucuuuuaaaaauuaguggucagcuucagaaccuuaugugguaacccaaaauaaaaauuacacuuugcaugauguaacucuauucaaucauguugaaaugacuaauucagagaugcuaccaaguaaacagcuuuugcagaggaaaagaugugguuaagauucucuuuuccacauucacuugugguuuuccucugagaagauaaacaagagcugaaauuaaagaaaauuaauaaaccagguguaaauuggcacugagaugcuauccuaacucuauaugagauacucgacgcacauccacucauguuauaguuuugugcagcugugcccaccagguacauaacauacauauguuaugaauauuuacaugauuggagguuuguggacugcuuaaaaggcagaaaagaaggcagcucuuuggaguaaauaaguaucauuuagauauuuggcaacuuauaaaaaauggugggguuuuuuucgcauuuaagaaggaacacacaauaaaauacccgauaaaaauauauuuagcuaagcaaaauagcacuuuacauuacaacauauggaguaauauucuauauuuaauuucugacuagucaacuuaaauauucauuggaacauaauauauaauguucauaucuauagaguucuaaccuaaggcaggaaaaaggcagaaaaucuuaagcauuuucuguaauucacaaaauaagugaggaaaacauaucaauauugaagauuuguacaguuagaagucuuuguaaggagauacauauuuuauucuuccaaauuaguuuuauuuggggacugcacuuauuuccaucaucuagaaaucaaguaugaaauaucacaccaaugggaacacuaagaaaauauauuuguguccuuaaaaaaauuuuuuuugguauuaccuauauucuccaaacauacucugcuucaauccauuuuuucuucucuguuaccaccauauauuuaagaaaagcccaguuguuucuuuaaaaagucucauuugccaguauaauagcaaauagauuuugguagcuauuucuccacuguuuuuguccuccacagacugggggcaauaauguauagacgcaacuuagaagcaacacuaauguaucuuugggauuccgggaauaacucagucaucugaaacucucagagcacuacucugugaagcggaccauccuauaauuccuuagccagaugagcuucaggauuguguuuuuaaauuuguucaagaaauaccuaaaguacaaguaagcaaauagagauaaaccauuccaucuuggcacacaaauucaagaaaaccaggauacuuacagaauccacaagguugaccacggacuuugcaaaguuguugguaugugcaugagaagagcgaugcuucuuauacuaggggggaaauacauaccagucacugccaaaucauaagugaauaauaaauuucaaaaugcuguaaaagcagaaauaucucaguaauaguagaaauauggauuuaaaaauauauaauuuaguuugugguauacuggauuuggugguguuacuucucuguuagguggcaaaacucugacuaucuaaaacaugauguuagcugggcagcauggcucacaacuguaaucccaacacuuuggcagguggaggcuggaggacugcuugaggccagggauuugagaccagccuaagcaacacagugagauccugucuuuacaaaauuuuuuucaaaaaaaaacaaaaaaaccuacgauguucugaauaauaguaaggaccuauagaaaucgauaugagaagcuuuauaccuaaaaaguaaguuuuaaauuuagucuuaaugucuacaaauucaauccuuuuguuuucauugaaaugacauuuuguagcuuauacaaacggcuuaacccacuugucucacuuuaaauucaaggccacgcacagaucaagaaaaugucuuugucagugcuuuagauacuguccaugauauggacagcauuugccaggcauuuaguauauccuuucagaggaaugccuccuccaaaugaagccauuugcuuuugacugcucaaagucaaaacaaagagaagacaaaaaguaaaaaugaagugugcugagaguuuaugauuguuuauguuuauuuaagaaauaaagaaaaguaaauuaauagaguaauucuacaaugacaucuggagggcuacguuuuuagcaaggaguaguacgcuuugcuuaaugucuucaagaggacauuugaaaacuggucuaccauaggaaaaucaugcccucuacugguccaugagguuauuauuucuacaacacuaaggaaaacaaaaccuacuuaaaaccacagacucagauuugcacaagucuuugaaauuuaccuucaauuauaauuaugaaaauaaugcaucuuucauaaagauucaaaauauuucuacauuagaaaauucuuuuauuuguccuuugcccauucgcacccuauauauaacuuuugucagauucccuucauuucauucuaucugugacuauguuuuuuaaacaaagaauauauaucucaauguuuacauaucuaauguuuauuuuuuauaacaacaaaaacacugauuacccauaauaaaugcuaaauaaauuaauauucugcuauuauuauaguauucaugaauacauaacuguugguauaauauuacuauuacuguucauguuauugccacuacuguacaucauaaucugacccaaacugucuauauuuguguucuuuuaaaguaaacuguaaugugugcauauaacugggucauaaaacauccuauuaaucugaaauuauucaggcauuauaacacauuuuguaaacuuggcauaaagaaguuucuauagauagcucagcauuuuaaguugccuagcaaauuccacaagcugaaaacuuuccaagauacacuuaagaguaaaaggaaaaauauuaacauuaaguuccucugggaugaugaaaauguucuaguuccacugaauuguggauugaaagagaaaacauuagcugauaucuauucuucuaaugcagugguguuacacaccuauuaagaugaauuuuaguuugcuucugaguauuaauuuguuauuuuauugagauuucuuuuuauagcauaaugaucacggaaaacaugacaaguuuuaaaacauuucaaguuuuaaaaauuaauaaaaugagguauuuuaaaagucuaucaaaauguaauguuuuaaauuuauuucauauuuguaauuuucaauccucugauuuucuuuuuagaaaaauuauuuugccugucauuguuauguaaauuagagagugccaagaauggaaacagagauaccuguugggaagcuacugcaauaguccagguaagagauaauggaggcuaaacaacuguagagagaagugaauucaaguaccacuacgaggguagagcucccacgacuggaugauguauaggauguggaaggugaggaaagagaagaauuaaaagauaacuccuagguuuugaacuugaauggaugggggauuguggugccacuuaaaauaauaagagagacuagaagaagagaaguuuaggacuagggaacuaagaguucugauucagaaguucuauucaaaucaacacuaaaauagagauaucaaauaggcaguucuguauaugagcacagaacuuaaggggcuagagcuaaaaguagggaauaacgaguuuaaagucaugaucccacuuaaagacuugaggcugcaaguuguuacuuagguagagaguauacaaagagaaaagagcccugaaccaagcccugcggcacucacauaauuccagaggucagauuuuaaagacuaggaagaaauagccagugaggugagagagcuaccacgucauagaagccaagagaugaaauaaaauuuucaaaaaaagaggguaaucaacuguguccaauauugcugagagaguaagacaaggacagaacaaugaccacuagauuuguuaacuugaagugccauuuaauuggacaccuaggguuuaguagaaacuguaaguguuucgccuaaaacaaauauuugcuccucacaacucuaugagguggguuuuauuauccccaaauaacuuacucaagaucacacagcuagaauuuaaauccuucuagucucuagguugagggaggagguaagcugguucaguuaacaauuccuauuaaauaguuuauauauauuccuaacaaaucaugauuauuaaugaaaacucaaaauuuguuagguguauauaaaauguagugguuuuuaaguaaggaaaaccaagugagguuuaaauugaaaaauauuuaaauuauccucacauauuuacauuuauugacgcauaguuaaguauguagcaaaacacguacgcaaaacauuugcuuuucaugcacuuuaugcacuuuaaaaaaucucaaccaauuuucuauuagaauaagauuuuuaauauuuauuuuuaacuuaagcagcucaaagacauguuugcagacucuuaucaaggcuauaauuggcuugcaaaugagguuccaccagccagguacuaagauacuuuuuaccaaauugagggauuuuucuuuucuaauggaaagccacugauaaugugauaccuauugaaaauaagauaucugcauuuuuuucaggcagccaacguuaaaucacucugaauuaaagggauaagcuugaaugcaaauguaggcagaauguuucuauuuccugcaugaauuagaacuaauuuugcauauaaagaaaaauaugcaaucaccauuuauaacaaaacuuacuuucacauuucugaucaguuuaaaacaaucuuuauuuaaaaugguugcuuuuccuuccugaacacaugcaauccuuaagaaaacugucuuuugaaaaaaaauaagauuagaauuugguuuuucaacccgaaggugagaauuaucaaaauaacuauucuggaucguauaguauaaagauuguaagaugaguacucucagugagaugauuauccuaaagcccagcagcaaauccccacauauucagaaauaaauguauuaauuauucuaguucaguuugacuuucaacaugugaauuuaaguacuuugauccaguaaguucugauauacuacugaaguggcaaucaaauuuaaaaacaaccuucaucucauagaaagcauaccucaaaaaauuuuuuucagcucucaaaaaaaaaauucuuauaaaaugucauacguauuugggacuauuauggauuagaauguaacucugucuuaaagcaaaaggaauauauuuaguucuauuagccaagaaguacuauuucuuuaaauaguagaaaucuuaggcaauuucuauuuuaggcauuauuaccacucaaaaauaaaagcuuuccucuuuuuugagacggagucucacucugucgcccaggcuggagugcaguggugcaaucuuggcucagugcaaccuccaccucccggguucaaucaauucuccugucucagccucccaaguagcugagauuacagguaaaugucaccaccuccggcuaauuuuuuaauuuuuuuuguauauguauauguguauguauauguguguguguguauauauauauuuauauuuuaguagaaaugggguuucaccauguuggccaggcuggucucgaacuccuuaccucaagugauccacacgccuuggacucccaaagugcugcgauuauaggcgugagccaccacacgcggccuuuuuuuccuuuuuaaacaucgauucccucuaaauuuaucaguacaaauuacaauucuuuuuccuuguuucaaaaacugaugaccauaucauaccuacuucucacccauuuuaauaauaguaauaauaggccaggcauggugguucacgccagcaauuccagcacuuucggagguugaagcagacagaucacuugaguccaggagcucaacaccagccuaggcaauauggcgaaacccaguuucuacaaaaaaaaaaaauacaaaaaauagccaggcauggucauaugcaccuauagucccagcuacucgggaggcugaaaugggaggaucacuugagcugcggaggcgcagguugcgccgagaugagauuggaucacuguacuccagccugggugacagagugagaaccuaucucaaaauaauaacaauaauaauaauaauacuaacaacaauaauaaaaugaauuauuaaaauuuacccuuaaaagauuugauagccuaaauaaggaacucuaucacagaacaugugacaugguguguagaaauuuucuacauauaaaauaauauuuuaagaaguaugcuauuuuauuauucauaagaauaagguuauuuaaauguuuaccauugagaaggguuaaaaaauaaauucaaaaaauaugcuguuuuaacaauuaccaaaaaacuauaacuguuuaauuguaauuaacacuuaguaguaacuguuuccuauuuugcacaguuacugagauuugcucuuuugauugauagcuucauguacuuuccugauauauuaugguagaacaagagauuuggaauugcaaguaaagguuugagaacagauucuauagauuaacagcuauuugagaaugcacuuugugcauucaaagacauugaauauaucuuaauuauuauuucuacuacucuaaaaguauuuauauaauggauguugaaaaaagcuuaggcuucaaaagccauaauuucacaacaugccacaaugcucaagauugagaaucagcugggaaaaaaaaucucaauguuccaaucaacaaaaauaauucagauaaaaaaacuaucuugggguuucaagcaaauuaaaguccuucagaaacucauauuuuagccuuuacugucuaaaaugacugccuacacaucuggcuuuccuuuccaccaaaaaggaccucucuuaaauuauauguguucugauaaauuuugcuucuuacuaacaucucaagcaauauauuuaaaggcaacuggaacagaaaauaaauguguauacaaaaguaagagguauucuauugauauucaacacaauuaaacugauaguuaauggaaaacauccauuaaaguagaaacuuaaaaguuuaaauauaaauuaagucacuauuuuuuuaaauuucuaguuucaaggcauucucugaguagggccagcuaauuagaauuucacaucauuuuagcaugaagcacaaccuuaucauaccauguacuaaucuaauuuugguuuccuuaaaguaaaacaaagacuuaaagauaauuccaaagcaauuucaauuuuuguuccaaucuuucauaaguuugucaccaauaccugauuucuaugcauuuuuuaaaagauucucaucuauauaaagucuuuucagaagugcaacuuuguuuugauaaaacaaguacuuuuugccuuagaguuuacaacuuuuaaaguucaaucacauaacuacaacagagauuacaauuggccuaaacagucuggggaguguggcagugguugcuggagccagcucccaucagaucccgagagccaacuagauacauccucuccuaacuccucaucagugaucucacuuugauagcuugaaaucagcuaugguggcaauauuuacaccacagauaucagcaaacauuauaaaucaagagagcuagguauuaaaauuuaccagcacaccacuaguauuggguguacuaguauauagccuacugaccaagacucuucugggcuucaggcaaguaauuuuauaaaggaaacgguuaaguauaguuaacggaguuucuauuguaucuucaagaggggaaaaugaggaacaaugaauguuuuucauauaucuuuuaaguguuacugaaaugacauauucaaucacauuuuacugccacagaaguuaacacgagauuauucaucuuuccaauauuuaaagacgauaagucgccgggcgcgguggcucacgccuguaaucccagcacuuugggaggccgaggcaggcggaucacgaggucaggagaucgagaccauccucgcuaaggcggugaaaccccgucucuacuaaaaauacaaaaaauuagccgggcguaguggcgggcgccuguagucccagcuacucgggaggcugaggcaggagaauagcgugaacccgggaggcggagcuugcagugagccgagaucgcgccacuguacuccaggcugggcgacagagcgagacuccgucucacaaaaaaaaaaaaaaaaaagacgauaagucaucaaagauauucacuuuagauaaaccuuuauuuuauauguuugccuccuacaauuguaucuaccauaagcauaauuaacuaguaagaaaaaauaacauauuagcaggacaaaagcacggaauaaaauuagaaagcagugaccaaauacauagaugaagaaaaguagagaauaagaauuuuaaaugaagacaaaagaugccagauagcuaaaucuauuaauuauaauuauuaaauguaaggaaaguuuagaguugugaaaauucuauaaaacucagagucuccaaacaccgacaaauaaaucaagucacuuaauaugucugaauaucuugggguuaauaaguaaaaaauaaugauuaacuauaaaguaaaauguauucuuucuuaaguaagcuaucuguucuaaaacccacugacucuauauucuuaccguuuugugaucauuaacaaucauaaguuccaaauauuucauuucuucaaauauaccacgugauggcuacggaaaauaaaaauauauggucagaauagugauugacauaaaaucucucuagugcucacuguuaaguuguagauaagacuuugaauuucagaacaacucucugcugccuacuuuauaaacaccuuagaagaaaguuggucaggcaaauuuuaaaaagugaucauaaaauauggguacauauucaaguauuuagaaaauaacuguauuuuauuaucauuaagguacuuacuuaucaacauagaaaacaguccauguuguuguauaugguuuuuauauguaaaaauauucuagagaaaaauuauagcauaauuauguuaaaauaaauaaaucucaauuucacauuaaaaugugauaaaauauucauauuuacuuaaaacgucaaugaaaaucuauguaaaacucauuuaauaagaauagcauaaguuauaauuacuuccagauauaucugauacagauaucaauguaguuaaauagaaacauuaacucacucgagugaaauucuaaaaauaauaugcuaauucuuaacugcucaauuucucaaaggaaaaaauauuggcaauuauuacagucuaaagucuucuaaauuaacuagauaauucuuuaagaguaaguauuuuagccuucauuuggacuuuuauuucuuuuucauaguuggaaaauuauaauaguggcucuuuuuucuuuauguacauagucauugaucacuuuauauuugaugagguggacuguagggaaagaacagcagccauuguaaaacauauuauuaccaaccacaucuuuaugaaugagcuaaaagagaucuaauaauaauuuauauaauauauaauaaauguauccauaauuaucauaagaguuucauaaaagggaggaaaauuuaaacuggaacuaaguuuuugauggcugguggucuauuuuuuucacaaaaaaaauacacucagcaaaacauuaucuaaaaugugcaauuucuacuauaguuacucauuaaguuaucuaguaaauuaccauguaauguauaagcuguggaauuaauucucaguuacauagcauucaccauguaauuacuaaacaguccccaucauuacagcuuucuagccuauuaugaaaagaccagaaacauaauuucaauuacaaagccccuauacguuuaucaauacaugugaaguauauaacaguaguugauuauacaauuacaugauuuuuauuuagaaacuguuauauugcuaauagucaaauaaauucauuguguucugaaaaacacauacagcuuuaaaguuugguguaacagaguuuuuaaucugaaaguaauauaaauauguaugauuagccaacauuucaaaaccuaacuccucucucuagauuuuuuauuaacagaaauguuuuauaugacacuauauaagccauauagaaagaaaagucugcuguacuuuaaauagaaaauaaaacgcacugcaauuaucaucagaaaacacguagaaaacagagcuaaaacaacacguucuuuagaugacgucaggguucagagacuaccguaaucaguuugaaucacuaacagaaagagaucaauaaaaagcaguguguuaaggcucaaaucauaggguuuuuuguuuauuguuuucauuuuuaaacaacaguccccaaaaucugaacuguuuuagguacacuuagauaauguggggugauaggcacaugacuucauugaguaaaauaggcccacccaaggcucaaugccacacucacauucacugcucucuuccuucuuuucaaccacuguaauucagagagaaagggccacuggucaccucuuuccauagcugcagaaaggaaaaauuaguaucaaaauuuuaugcuuauuucaaugggaguauguuuuaaaauauuacaugaagaaacaguggcacugauaauauaugucaaacuaaggugaaaaaaagcacacugaucauuauauauuucacacucucaugaccacaaagauaguucaaauguaauuuugucccaaacaucaagaaaacauaauguucaagauucauuagaagaugcauauuugauauaaaaccacuugacaauaucugaaaauuugacagaguucuacuaugucuaauucauuuuagcauucaaaauaauguauggcauuagcuuuugcauaaauuauuaaagacuuuuagcaguaauauacagaaauaaaaucacaugccccaacaaucaaaaagaagcuucuuccaacauuagcacacuuaagaugugucuggagcagagcaugagagggaggcaauccaagcuggcucaagagcagcaaacugccaggaagauuucaggaugaaccucacuguaaaucacuguacuaaauuugaccacacuuucugguucccaaggcagcuuuacucaaagucuucauguuuuagucugcacuggaaaugacucuccaugccucuuuacacaagagccaccacucauuccagugcugauccacgauguucaccccugauaucagaccaauuccacuuccaacaagccugcauaucuacugagcuccaccagauaaaagcucauacuacauaaaauauaaucgcuauuuuuaguuaaaacuuacugagauucuucauuugcuuagaauacuguccugccaagguuuucuggauuauauguggucgaccugugcuuuucugaaacaaaacaauuguaggcaauuuagaaagcaagaugugaacaagccucuaugaaacaguguuggaacuuucucuaauguccuuccuaaaaugggaauauuuauaugucaguuuuuuagcuaucaaaagugaaaaguaugucuuauugaaaucuuaauuuuaaauaaaagaguaucaucuaauugccccaguuuagauaaaaacauaguguuacugguuacucuuaaaucuuagcuuucuuuaaagcuauaaaugggaaauucacaagaaacacaaaaagucaauaaacauguaaaaacaugccgaaugcuuucauauuccuucaacaugcauuuuuuuuaaugaagcaccaacuuuugccauaaaacugaugaaguuuuaaaaauuacgauauccauaguuaauuaccauuguaaggccaaaagcacucucacaccuugcuggcaagaggaaauugguagcauaguuugagagagaaauuuaguaagguauaucaacaaacgugaaaacauuuacauuuuuugcccuagaaauuaugcuuuuaggaaugucuauuaccauuauucuuauuccuauuagcuuccauuacugagugcauaguauguaucagguacuguuaauguacacauuauuuaauuuaguccugacaaagacgccauauagugcaugguuuaucccuauuuuacaaauaaagauauugaggcucagggagauacaucauugucuuaaaauuaucuuauaaaauaaugauccaaucuauuuuuaaaaauauaugggacuauaucauugaaaacuggaagaacauauucugaaacaugacaagaaguuaucuuugggggacaggauaauggaaaauuacuauuuaaguauuuguuuugcuuuuccaaauuuccuauauuaguuuuauaaucagaaaaaguuauaaaaaagaaacuucuuaauagguuacauaaaacuuauaacaguuuugcuauucauuuauuacuugagagauaacaugaauucucauuagaaauaucccaugcguauuacuugacuuaucgcaaagcauacuaaaaucaauaauaucuaacaacaaacaucaaaauaucuaaaauuaauuacaguaagcucuaaauucugguaaaaggugaaaagauaguaaugaaauuaacaaugggaucagcaacacaauuuaaaaaaucgacuaaaguuuaaagcacuauuccuuuccucuacccauaguguggaugaggacaaaucauuacauaaccaaaagguaggcaacaggaaggaaggcaaagagaaggcaauuugcauguaacaaucaggcccugaauaauaugaucacaaguaaacaaugcaaaaccaaugcuuuaaacauuauaacaauaguuuauauuuauaaauccuuaugacaguuuaauagacauugucaccuacauuuauuaauucaucaaaucuacaaaauugcccuacuaugaaugcauuaaaaauuaucucauuuuauacauuuaaaaaacucuaaggcuuaaauaguuauuauuugggaaucuguguuuuguucuuuguggauuuuguuaggguaccagggccauuaaucaaagccagaaaucaaagucagaguuuuugcugaaugagucgaauaauuuugcuguacacagauuaucuuuccuuacuggagugagauaaauaacauuuuacuuaaucaaaaugucuuuaucuaagugggcugucuucauuaccugauaauuuuuauaguuacuaguugaaaaugacagagguuuauucaaacaccaacccuuuaaaacuuuucugcaucaacuuugaaauuuaccccauauucauacauacaucgccauaaccaagacaauaaaaguuugucuguucagcuuuuauuaucaguagccuaucuaacuguuagcuguuucaaaauuaauuaauuaauuaauuuauuuauugagauggagucucgcucugucgcccaggcuggagugcaaaggugcaaucuuggcucgcuguaaccucugccucccagguucaagcgauucuucugccucagccuccccacuagcugggauuacaggcucccgucaccacgcccagcuaauuuuuguauuuuuaguggagacaggguuucaccauauuggcugggcuggucucaaacuccugaccucgugaucugcgcaccucagccucccaaagugcuaggauuauaggcgugagcuaccacgcccagcccaauuuuaucuaaauuugaaaucccuaaagauaaaaaauguuuucuguuccccaucaaauaacugcaauaaucuaacucuaucacucacaaaauauuauuuucccgcuacaguucuuuucacugaucugacuucuguacuguuaccucucagugccuuaaucuccucccauucuuccccuuguucacuccucuccaacccugucagguuccucaaagcuccucgaacacccuaggcacacuccugccucaaggccuuuguauuugcucaucuucuagaauguucuuccagcucucuaauuuccuuaagugcuucauucaccacuugucuucucuugguggacuucccggaacuguguauguauaaaaaauuuaacuccauccuggcuaacacggugaaaucccgucucuacuaaaaauacaaaaaauuagcugggugcgguggcgggcaccuguagucccagcuacuugggaggcugaggcaggagaauggcgugaacccagcaggcggagcuugcagugagccaagauagugccacugcacuccagccuaggcgaaagagcgagacuaucucaaaaaaaaaaaaaaaaaaauuuaacucuccacucuccuggcuucacuuuuucuccuuaccauguaucacuaucuaacauaccacauguaauuacuuauucauucuguguaucucuaucugccucuguagacuguaagccccauuuggcucaaucucugucuauuuugucaccaaaguauccccagaaccuaaaauaauacccagcuuguaguaagcccucaauacaauauuuacugaauauaugucaaauuuuaaauuugauugcauucuauuagcaagcaacacuauuagagcaugugauuucuugucuaaaucacugguuugugcaugacucuaaacauuauuuucuucccuaucuguaaagaaaacuaaguauuuuauaauauaaucauaguucagcccacagauuuccccacuaaagauuuucagguucauaaaaguuaaguacauucuuauagucacacaauugucuaaagaugacaguaagaaugaaagcuguuuuuuuuucuaauuucaauagguuuuuggggaacaggugguguuggguuacaugaauaaguucuuuaguggugauuucugagauuuaggugcacccaucacccaaguaguguacacuguacccaauguguuuuaucacucaccaccuuccacuuucccgagccuccaaaguccaauguaucauucuuaugccuuuguguccucauggcuuagcuuccacauaugaaugagaacacacaauguuugguuuuccacuccugaguuacuucacuuauaguaauagucuccaauuccauccagguugcugugaaugccauuauuucauuccuuuuuauggcugaguaguauuccauggugcgugugcguguguguguguguguguguaucacauuuuacuuaucuacuugcugauugauggacauuuaggcugguuccauauuucugcaauugcaaauugugcugcuauaaaugugugugugcaaguaucuuuuucauauaaugacuucuaugaaagcuaguuuaaaguaaggaggcuggcuaauacaaaacaaaauauccucucugcucuuuucauagacugggaaggacuaggauuugcuucagaaaaccuauguuugaugucuuuuacuauccuuuacggguacaugggccuggcaugugcaacuuaaaacuucaaaacucaggguacuacucuaaguuugaaauaaguuaacauguacaaaggcacuuugaaaucuacacucuuuucucuuuucuucucaaagacaaaguugcuggaggaguagaacgccaucaggcaacugauggcauagacucaccucaucaugaaccagcucuaguggcucuaucauauacacgaagguaucaucuucaaacaugccacuagcacaaaagaaaccacacaaaggagggaauaaacaaacacaggaaauggcaagaaauagcaagugagcuucauuauugugucuucaaaauaaagaguauaacugaacaaaucccuuuacacugucacaaguuuaauucacauaucugcauggagucccaguguggccccagcacucuauuaggcagcauggaggcuauaaaaauuauaaaaguauacaucaaaugcaugcaaauuauaccugauauaacugauguuugaaauucaacagacagauuagaaaauuacucugagauaggacuauucacucaguggcagucucuaaaguaauuauuccagaaccauguacaacuauacaaauuucuaauuaugcaaauucaauaucaucuguaagaaaacagauucuuuauauaugagaauaaucuaaaaccaucugguucugaagaagcaaacagugguaucuuuacgcuuauaaauucugaacugccaucaagcaguaugacucuaugucauacaaauuacauuuaauuuucagggacauaagguuuuuuauaaaagggcgaaaaguuucaagauucuuugucgucacauggccgaaacuaagucuuuauaugaggugcuacuguguccaggucuaaaaggugccaacacaugguuuuguuagagcccaccccuaggucaaugugcgaaccccucucuuugucaccccacccuugccuggcuaacuccaacuuacuguuaggucuaaguuucuuagaucuaaggccuacugacucucaagucuagcuguaggucuaacugauauguccucuggaauaugccgcugggaaaccuuccuggacuagguuuugccacuccacaagcaucuguccuuccccuuuacagcucuuaacacaauggugauuaaacauucaucuauguaaucauuugguuaaucucugaaucuccugcaaacacuaaguguucaagaggacagggacauugcccuccuugugcaccacuccacaugcagucccuaacacagcacuggcacggaagagucacuaaaauauauauauccauaaaagggaaacuggaaagggucaaugaauaaaaugccaaugagauucccacuuacugaaguccauugcagguugacagagccaccuuggagucuuugacgccucugaugcuuccaugguaguaacagugcucuccacccuggaaagcagguuucauugauugguuguauuuuaugcauuaugauuaauucuuugggugcuuccauaaagcaaaaagaaaugcaaggaugggcauauaugugcacuguauuaauaacccuagaaacuccuccuauauaaaguugcaaauaagacuaggcaauuuuucaacuuuuuuauaacaagcauguguguguuaaauugaaugaaggagaaaaggcuuuaaaaaacaaugacaccaagguaauuaauaaaacauacauuucuuaaguauguauuguaggaguacagguacuuuucagauguuguuauagaauaaggacuuccacuugacugaagagagacuccaaaaguuuguuuauaaucauuuuuaauggaaaauuauacaauaucuuauuuguuuucuuaccuuuaaaaauuaacuuuaaaaacauuuuagaagcaauauaugaauguaguuuucaaagucaaauaauaacuacaaguuuuauuuuuaaaaaaacacagcaguuuccuuugucccucuuuccccuccaccuccaaggcaaccauuuuuaauguuuuaagcuguuucuucugguguuuggcuauauauuuuugaauguuuauacuuuuuauguucugacuaauuccauuuuagaaauuaucuaccuaauauaggaucucgaaaaccucucucacccccaguacauucuaauucauaucaccaguuuuaguuaaaucuauauucauuguuuauguguacacaaauauuguucacagcucugccacuauaauuauuguauuuucauucuugcuccauuuuuauuuauuuauuuauuuuuagaauuuuugcuccuuuguuguacuggguacucugugacacuuuuauuuuuauuuuuuucuuggagacggggucuuacccugcugcccaggcuggagugcaauggcgugaucucagcucacuacaaccuccgccuccuggguucaagagauucuccugccucagccuccugcugugacaccuuuuaaucaagaaaacuaugcacuucaguucugggcagcuuuuuaaaauaaauaauaauaaauuuuuauuauuauaaaaauaauauuuauaaauaauauuuauaaaagaauuuuauaauaauaaaaauaauaauuuuuauuauuuauaaaauauagcugagaauucucuccuauccauuuuuuuccauacaugagcuccuaccagacuagggaaguccccgacuuccuaucugcuuaucuggcuccacagggcaggcagugaauuggggacuuaaccgcucuacaucuacuuucaaccaauuuuucuuuuuucagaugcuuuuauuucugccuuucugggauaagugacauaaguugacuuguuucuucuugguuuccccccauacgaacuuagcagagcaugaaaagcucaaagcuaagagucacuccucauccacuuuccaucuccugaaauuuuauggcuacaucucaccugcuuguuuucucuucuccugucuuuguauugguggguucauauccuuuuuuauccccuaacuguuauuuagguggguuaucgggagaaaacagagauaaauauauauuuauaaagucagggauugguucuagaacuccuacauauuucccaaaucugcacauacucaagucucacagucggcccuguggaaaccacauauauggaaagucagcccucuauaugcacagguuuugcaucccacaaauacuguguuugguugaaaaaagucuacauauaaguggacccgugcaguucaaggacaacuguguguguguguguguguguguguguguguguguguguguguguguguguguacagugaagggcugcuuuucuuuucuuuucuuuuuuaaagacagucucacucugucgcccaggcuggagugcaguggcaugaucucagcucacugcaaccucuaccucccagguucaagcaauucuugugcuucagccuccugaguagcugggauuacaggcaugcaccaucgugccuggccuugaaucacuguauuuuuuuaaacuuaaaugagacuucaggcaacauccaaucucugauguuuaucaucauaagaaaguuuuaauagcuaaauuguguaguuauauuaaacauuauaaacaauuugguagcuuccaauuuaauauuaguacuagcaguauuagaggauuuucugauuuuuuuauuacuaaauuaauaccaaguuuuuaaagaguacuauggaaaaauauuauuugguaacacuucagaccacugcaaaguaagaucuugaguuaucucauauaaaauaaauccugagagagaaagagcaauccaucuugggugccaagcauaacagaagugggccaguacagggagcccacuucuuaagggcacuggcaaucaugacuuuggacagucagcuccaggggugccuuccacccagggaucuggccaucuucaacaaccauuaccucacagugacugcugucuccauguacccauauggggacagaaacaaagugcaaaaggcucuucuaaaaauaacaaaaagacaaacugauucccacaucuucagguucucaaguccauguuucuuucuccaguuaggaagaccucagacaauuaaagagggcuggcccugaccaccuaggagugggucacagaccugugacguggcaaauggcagcagggacaaccaaaaagggcucgauucagcccaugacacaagucucugugcacccauacagacaucagcauuuucggauccaaaacugucaguuaauuaaauucaacagaaauggagcaucugauaaguggaaguuauuggcuagucacaggaaauuaaaaauccuaguaugcucccuaccuuucucagccugcuacuugcacauagcugaacacuccacaagccauaucaugcucaaauaauaacucugcuccacaagguuuccaagcucagaaucccauuggaaccuaccaggcuuccucuucauauacugacacauugaagccauguccaucuuuuaaaauacuuccuaaccagaaauggcuggggauaauaacuuugugagucuagugauuacaacuuguagggaaaaaaagauccaguucucugguauuacuaaucuaauaacaggaacuggacaggcaucauggcucaugccuguaauccuagcacuuugggaggccaaggagggaggauugcuuaagcccaggaggaguuugagaccagccugggcaauguagaaagacccugccucuauaaaaaauaauaaugauaauaauaauaauaguaauaacaacaggaacuguuugauucuacucauuuuaguggaaauagaaccaauaguuuuaauuugguuuuuaaaagcaccccaacuuugugucuaauuauuccaucugcaugguaaaguuccaucagccaguucuuuacugcuuaugaaacucccaaaaaccuggacauugauagugaccauacacugauauuuucaaucuauuccugcaggucuggauaaacauuugaaaagaaacuacacaguccuuaacuagaaaauguguauauuaugauaucuagguucugaauacaauaauaaaaacuacugacacuauacucaaaugauuauucuauauacauaucuuuaaauucuucaagcuuaucaacuacuaggauaugcuaaacuauuuuaaaaaucagugagcugauaacaaaugagaaauagaaaaagauaucuauaaugggacauguauaccugauuuugaguacugcagaauaaggaaauaaaaaacaauaauuuuggagacuuggggaacuugagacucccaacacacaaauuauuaaauaauuuaauuauuuaccuucauuaaauuuaauggggaaaauguucuugcaguaguuuaauaaaguauuagaacaguuuggcuguaccaaugcuauguaaauuuuuaauaguucacauaaauuauacuauucaaacuuaaaauagcuuugugaggacuagugucaucugcuaucuugauuucuuggggcauuuuuuaaccccgugcuccuuucauauucuauaauguacuccgaauguugccaggaaggucaauauuuugaaugauuaauaauaauuucaacuuuauacucaaaauucaaauaacugauaauccuggaucuaauuuaagugauuuaguguggauaguucuguuuuccuuguuauugcuuaaauuauuauuuaugcagugguaagaaacuuuuuaaaaaacuggcuauuaauucaaagacuagggaaaaaauucuaguguacacgcaaguaaaagagucauuuuuaguauaggaguggaaauacaaacuuuaaguuaucucugguuagaaacaauacaaacacgaauuuuuaaacccaauuauggcaagcugagaggcaguaaaaaagaagggaaaauagauuuaaaaaauagucugaaaacuucauuaaaauauuacuaaaagaagagggaaugagaaaaauaaaggaaaggaagcagaaagagguggggaaacacucagaaaagggaagacaggcagacccgugugucugaaaauacccugacuccaauacagcaccucggccagacucugacugacuucugcagggcccacccucccuuacucauacacuggacagggucuucagaacacgcacuccuccaaucucuuccacucugcaucaacccuaccucccagccaggagccacgcgcacagagaccuacuccaccugaucacaauccaugcucuccugcugccaaaaacccuucacucuuagaagcgagcuugaacugagcugugaugaugauuugauaaggaaagcacaaagaacauucuaaaagggugaugugguuauacugauaaagaaaagaauaaaggugagaagagaacacaggacccauaagggcagggaucuuuaucuguuugguucacugauacauaucuaguaccuagaacaggaacuaugaccucaaaaaggucacaguacaagguaaaucaauauuuuuucugcuuuuuuguuuucuaaaaguuguauauaucaggccaggcacaguggcucaugccuguaaucccagcacuuugggaggcugagguggguggaucacuugaggucaggaguucgagaccagccuggccaacacggugacaccccgucucuacuaaaaauacgaaaauuagccaagcgugguggcacgugccuguaaucccagcuacucgggaggcugagacaggagaaucucuugaacccaggaaauagagguugcagugagcuaagauugcaccacugcacuccagccugaacaacagagugagacacugucucaaaaaaaaaaguuguguauaucuaaaauauacaacaugauauuuugauauacauagugaaauuauuacuauagucaaucaaauuaacaugucuuauuucuaccucacaguuacguuuuaagcguguggcgugaccaccuaaaaucuacucucuuagcaaauucccaucauacaauaugacugaccauagcccuuaugcuauccauuccaucuuuagacuuagagccuauauaacugcaacuuuguaccaucugaccuacaucucuccaacccaccaccccacucccaccccuccaccuccugccccugguaaccacuguucuauaagguuggugcaaaaguauuugugguuuuugacauuacuuucaauggcgaacaccgcaauugcuuuugcaccaacauaaauacauauucgacuuuuuuagauucuacacauaagugaggucacagaauauuuuucuuucugugucuggcuuauuucaacacacacacacacacaaacacacacgcaauggaauagcauucggccuuaaagaaggagauccuggcauuugccaaauauggguagaccuaaaggacauuaugcuauacaguaaaaccauauuuguuuaaugaaugaacaggaauggcuuauucaugagcauaugugacaagaccaauccuaaaggauucuuguuugaugaagaggguggguaaauaaacucuuauuccccaccuggguuuuuuauuguuguuguuauuuagauauaauucagaaaucauaaaguuuaccuuuuuaaguauaaaauucaguguuuuucuucgcauauucacagaguuguauaacuauccccacuauguaguuccagaauagucucaucaccucagaaaaaaguccuguaaccauuagcaaucaguuuccauuucuccuccccuccacuccaccaggcccuggcaaucaugaaccuacuuucaguuccuaugaauuugccuauucuggacaugucaaauaaacagaaucguaucauaugugccccuucguguauggcuuauuuuacuuagcauaauguuuacaagauuuaucuuuugguguaguauguaucagugcuucauuucuuuuaugacugaauaguaauuccacuauguggauaugccauauuucccuuauuccuucaacaauugaaggacauuuaggguguuuccaccuuuuggcuacuaugaauaauguuaugaacauuuauguacaaguuucuuuguggacauauguauuuaauucacuugaguauaugccuaggaguagaacugcugggugauaugguaacucuuuguugaacuuuuugaggaacugccaaacuguucugccaagcagccacacaacauuuuacauucccacaagcuguguaugaggguuccaaucucuccacaaucucgacagcacuuguuauuguccaucauuuucauuauagccauccucauagguaugaauuggugcccacccaaguuuaaaacuaaaugagagagugacauagaauugaaacaucaaaaugucaccuucauuuauuauagagcuauacuggaggagaggauuaguugagaaucuaauaggccugcuaaugcugcacccaggaguagcuagccuuacccacccaggcagagacaaugugggacaaccuaaccccagccacauacacacauguggguggccacaguacaauucagagaagagaaagguggagagaauguacucuucuuguaggaagguagauccuacaaaaaaaaaagaaaaaaaaagggagggaggaacuggcugcacagacauacuuucccagcagucaagccgcucuuccuucccugagcaagaaugagcaacggaauaggaagaagccagggugaggaaauagaccuaggaaaagaagccuuccccaccuaauaaugauaguaauaagguagagggaaguugggauggaggcacuucaucuauuuauucaucaugacugcugacguaagcagaagagaaaucaaaguauuaguaagcacuuacaaauauguauuagcagcucaccaaaaaagacuuaauagaaauauguuaauuuugaaaaguacuuucauaguguuuuguugaugcuuauuauuuuauaagaacugaaaugcuaaaaauuaacuuauuuaaauaggcucaucagcaaaguuggucaacaaauauauaguacuugaaacaugcuaagaggguggaucuuaaauguucucacuacaaaaaaaaaaaagauaacuaugugaggugauggguguguucauuagcuugaguguggugaccauuucacaauguaccaacauaucaaccugauguuuugaauaauacauacaauuccuauauauacaauuuaaguuacauaccuuaaauauauguaauuucuauuuuucaauuauaucucauuaaaacuagggacgaaaaaggaaacuagucacaaaggcccaccuauuauauuauuucauuuauguccagaauaggcaaaucuauugagauagaaaguauuaauagauuagugguuaccuaugguugguaaaagagagacuggggagcaacuguuaacagguggugugguuucuuuaugcagugaugaaaauauucuaaaauuagauuauguugauggaugcacaauucuguagauauacuaaaaacaauuauaugcuuuaugauacauaaguuauaucccaauaaauuuguuuaaauaagaaaaguaaauaaauuacuuuuuaaaguuguaaaaaaaucaacaaaauaguuuuauuauauauuaugugcaaagcacugguaggaacuuaaacaaaagcuauugcuccaucaagugcagaacaaaaguucuuccuuauucuuggacugauaccuagcauucauauuacacgcuucuuuuggaccucucgagcuccuauauuugcuucacauggaaagaagcacuuuuaacccauguccaugcaauaaaaguaaaagccaagacauuaaucuuuucuuagugagaaguaagaaugagagaggggcuuguuaguggugaaaugggaaaaccuagacaacccucuuugcaaaguaugguugcaacuaauuccugggaugcugucaauauccacauucacauuuaacuucauagccaaauagacuguucuuuaguuacguggaaaauauugugugucuacauguguguguacaaugugugcauguacuuuucucuaaacaauuugagaucuuugagccgggcacgguggcucacgccuauaaucccagcacuuugggaggcugaggcggguggaucacgaggucagcaguucgagaccagccugaccaacauggugaaaccccgucucuacuaaaaauacaaaaaaaauuauuugggcaugguggcaggugccuguaaucccagcgacuugggagacugaggcaggagaaucgcuugaaaccagaagguggagguugcagugagccgagauugcaccacugcacucuagccugggcaguaaaagcaaaacuccaucucaaaaaaauaaaaauaaaaaaaacaauuugagaucuuuaggggaaaaaaggcugcauuaugugaaaauaaguuuaaccuagccauucuuacauauuaauuuccuuuucugguacucuguacaaagauuuucugaagcagcauaaaagacaaucuucaugaaguuuauuuacaaaugcuuuaaaaauauauauauauauguaaugguggugggaauaugaauuuauacaaacuuucagaaauaaaaauuguuaauauauaugaagaguguuaaaaaauuguaccaacucuuugacccagaaaauuccuuucucagaauuaauucugaagcaauuauaagggauguauucaaaacguaucuggaaggccuucccuugaaguuauucggauagugaaagauuggaaagagucaaaaugucuaucaccauggcauuuuuaaacauauuauaacaaaugaauuagaaauaauauuaugaaauuuuuaaaaauuaaagguuuagaagauuacuuaauauaugcuaaaauauuuaaaauuuugcuacauuuaaaaaaucuugauauaaaauagugugcaccauaucaucuuggguuuuucugauguacauaaauacagacacauaaaaaacagacuguuaguucauuaucuaugaagcacguaaguuuggguauaugagcuguuugaagaaaaugggucaugaaagagagaaaagcagugaacacaaaaacaaacugcagugaacacaauuucuuuugcuagaguugaaauaccuuuuaaguuuuaguuacaacugauaucagauuuggagugucuuauuaaugauaaggucuccuuuugggaccucaaaugaccucuggaggccaauuagcuauucuguuucuuuaaaaaaaaaaaaaaaguaacuaagugccuuagugagaagucuggaucagguuucuguguccugcaaauguggcucguuugcugagucuauaaaguucccugcaaucuugucuacuccaggcucaugauucagcaucugcagugcucagggcccuggcacagcugacagaagcuucaguuuguacaaaugccaggaagcuuguucccgcgcuugauuuagcuuuucugcucacuuuccacagcacuaacuuuuagggagacucaacaacccccaaaugcaaccuaaggcaagaacugacaacuaauaagaaugauacaugaaaguucuuaaucuguggcacaaaacucaaaggcuggaaaacacguccaauuacaaauugaaauguuauaaauccugagacaugccagggccuccugagcaguauuuauaaugaaggacaccuauaaacauuugcugagaagccaucagauugaaaaucccaguuaccuauauggcacaaguccacauacgggaaaggugcuacuuuuaugcugacauguguuagcaaucuaggaaaaagacaaacaaaaauccagugagguuuccccacuuuguuuccuuucugguguccccaguaacugggacacugcucagguucaguggcacuuguugauucccuagaagucagaguuucuuucuguagccauucuggggaucuucacccugacugacggaggucacuguuucuuacauacaaaucaucucucucucucucuugcuuuaauccaaauccacuugcucuuuauuaauccucccugaagacaagaaaguucaucuccaaaugaaggaaucagauacccaaguacccucauauucaaugucccguggccuuaagcaggcuuauuugcccucucucugccuuaauuucuuccauaguacagcaggaauaauaacauccaccucauagaauuguuaugaagguuagagaaaaaguacuaccuaaaucucacuucccccaccuguccucugcccuucuugggcagcaaaaucauuugcacuaaagaaccguucuaacagcccauccagucuucuaauccagauucgauggccaugagccucauccuucuuuacuaacuacuuucaggugcugauauggaacuguauagcucuuuauacuaucacaaaagguacugcauguauaaucaaaacaauaaacauuuuuuguccugaauaccuaacguuaccucaaacauuuguauauuuuaauaaauuucuccucacuaaaaauaguaucauuguaaaagagcacaggugauuuuacugagacagacgucaaaacaacgcagugugcacugaucaacucuaugauaagcacacuuauacuagaguacuugccgacgccgguaaccguaccuuagaguacugugguuucccauuuucguagugaaucuccacauaaucagaagacaacaaaccacuacaaaggaaagaaaauagagugauuucugcaucuaagacacuuggagguuuaaaaacaaucggcucaauaaaugaacgugaggggcaugcaaaccagaaauagcugcaguccaugguuaguacagaaacaaaaacagguuaucaucgaguuucacacaguauccaggaauaaauuacuccccaaucugcagaaaaaaaaaaaaaaaaaaaaaagacaagacacagacaauccaacggugaacucuuuuuuuuuuuuuuuuucuuuuugagacugagucucgcccugucgcccaggcuggagugcaguagugcgaucucggcucacugcaagcuccgccucccggacggugaacucuuuuuauucacauuauucaggaucugauugauauguuaauuaauacagaacaaaccaaaaggcaaguaacuugaggagacagauccuauaaaaauuccacaauuaugcccuaaacaguuggaaugucauaaaauguaaucaccaaggaagaguauaaagcaaaggucagcaaggguuuucuauaaaggccagggaguagauauuuuagguuuugugggccaugcgggcuccacuacaacuacucagcucagccauuauauugcaaaagcagccacgggcaguauguaaacaaaugagcauggcuguauuccaauaaaacuguauggacacugaaauuggaauuucacauaauuuuuauguguuauggaauauuauccuucuuuugauuuuuuucaaccauuaaaaaauacauaaaacaaagccgggcauggugacucaugccuguaaucccagcacucugggaggcugaggcggguggaucacgaggucaagagaucaagaccauccuggcuaauauggugaaaccccaucucuacaaaaauacaaaaauuagccgcgcgugguggcacgcaccuguaaucgcagcuacacaggaggcugaggcagaagaaucgcuugaacucaggaggcggagguugcagugagccgagaucaugccacugcacuccauccugagagacagagugagacuccaucucaaaaaaaaaauguauauauacacacacacacacauauaaacauucuuaacuugcagacuguacaaguuaagaauggccagagauugcuugugugcaauaguuugccaauuccugggauaaaaggaaggguaaggggucaggcacaguggcucacacuuguaaucucagcuuuggaaggccaaggcaaagaauuguuugaggccaggaguuugagaaccagccuggcaacauagcaagacccccauuuccaaaauauuuaaaacauuagccaggugugguggcaugcaccuguggucccaacuacuagggagccugagguggaaggauugcuugagcccagaagaucgaggcugcagugagcuacgauugcaccacugcacucuagccugggugacagagugagacccugucucaaaagaaagaaaaagaaauuuaaaauaaauaaauaaauaacaaagguuaagaaagucauugaagucaaauaguguuuaaaaccuauuuuuuaaauaggcaaguuccccaacuuguaugucaaauggagauggucaaggaugugaaucucauagaacauugugaggauuaaaggaaaccaugaauaugcaguauuuaacucagacuaugcaguacuaggcuaaguacugcauuucuuagccuaguacuuauucaguacagaguacugaguaugcugauuagguacacauuaauuggcauuguggcagucacuauuuuuauuuuaacucaacuucuuaaaacauauuucucccuauacaauguggaaauacaaaauaugugccuccugaagagcacuggauuauuagggcaucuagguuccuguuugggcucuaucacuaggaauaaugacaagugauaacucgcauuugcugaccacuuacuauggcacagguacuguuauaaggacuauaaugguauuaacucauuuaauccuaaugggaacugaaggacaagaguaggucccacucuaagccagcuguaugcucuaaacuugggucuuuauuucuucuuaugcaaaaaugaagggcuaaagcagaagauuccucagcucaugcccuauucugcuauucugauuuucuauaauuuugccucauaguagguuuucuuguuaggaaaccgugacacuacuucuuuagcugaaaaaugggaggacucaaugauuuugcaucauuuugagagcugcaucugaugcauucuaaaaauaauccagugaagagggcuggaaagggguguugagcaccagucaacagaguaacugggggccuccuggguauguccugcguauguccugugugugaugaaggacaaccuuuccaacacagaaaggaagccaaugcuuaaacuuuagacauguuucccauuaaaaucacaaaccaaauguguacugaaggauaauucuacacuugaaacuaaauugugguaugucuacucauuccuuuuuaaaaaucucagauaguaaaaguaaugacaauuacugaacucuguauacauggggaauaucucacagggugcagaaacuuauuucacugcuaguuaauuaaguuggcuaccagcacuaugauauacauagaugaagcuggugaugguaucauucuucugcagaaagcuucugcaacaccaggaggcagagaggucucccuaacuacauuccaacugugucucucuacagguaauuuacuauuuucaacauuuucaaccacacaaucauuggagcacaucuaagaguuggaaacaacguuaucuuaauuuugccuguaauuacaagggcauucuaaccaugaauucccaaaucucauaaaggucacuuuaauuauccuauuucccucuuuuuaagggucucuucuucucaugaacauaccuguuucuaguaucucuggcauuuuagaaucuuaaagaagaaaaacagcuacuuuucaggaggucuauggcaaauacugagagaaauacaccaccauaugccccuccucaccaugccaguccacucuucuacuuccuguaaauagcacacauccccauuuacuccauucuuuccuucugucugaccacagccagccucccuugaaacuaauuauuccacucaucacaguaucccuagcaccuggcauaaugccuaaugcauaguaggcccuuaaucaauaucugcugagugagcaaacaucuaccaacaccugcuauaggggcuuggaaacagggugaaaaaugcaacuuucaaauugaaacuaagcaaaaucagcacaaaugugcaagauugaucaccucacucaaaaauauuauuuuguaaucuccuugagagugaauuacaucaacugaaauguaaccuaauuaauuauaaaagucuugaaauaauagugaaauguaauuuuugaugauggacaagaaacacuaaaaagggagaagggaauaguugauugugcaguggugucuccagccccacccagccaggaaggaaccgguaaucuaugucuccacaugccugaagaugaguuguccuuuccuccaccucugcuuucuguaguccuaauacaauuuccuguuggaaacagaauguucugaaaugcuaauacucaucuauuuagcaauugcggacccaaauauaaacuggcauuuuacuuuguugaucagccaauuggauguuugguucugaagaugcuaacaacuugugggcaaacucugaacauccuaaauucuaaaauaaacaucuuuuuucaaucacugaagcuacagaaaagcuguauucucuggcuacucccaugcuucucaugcagguuaucuguugaaagaggagugaccuuuauaaguaaaugaauaaacguaggauggaaguucaagccagugaaagaaaguggaagaacuagaacaaggaaacucuugaacccacucacucugcccuucauggugaaucugcaccacuaaaguggugaaaacucuaggaacucuagaaugagacuaaauaugauuuuacucaaaauaugaagaacauguaagagcaggagaauauaaaacuauugaaacaugacaaaugagccaagaaucaggucaaugaagggaacuguggcagaaauaaugcuguguguccaccaaaugcuauuucauuuuccccuuccuggcauccugauaagaccacauuuugcagguucugcugcaguuagguuagggccaagacaauggaucauggcuaaugagacaugaaggaagugaugucugccccucuagugugaccacuaaaaucccugcaggauuaucuaagcccucucuuccauggcaacccuggaagccacaugcuccagauggcauaacagaaauaugaaugcagccuagacccuuucaucaugauuuggagaagaacugucuaaaagagcuacucaacuugcacuauaucgcaguguggggaagagauaacauuuuacagugcugaagucucagauuucauguuugucacugaaacauugucuaaacuguccuaauuucaggauuuaucacaaauaucuuuuagaaaucuauguucaaagaauuucacaaucaucagcaacuauacaagcagagcugcuauuauauuuaggaauuggaaauucacaaaaagagauuuaccucaggaaaguuuuauauguauguguauagacgugugucugugugugucuguguguguguguguguguguguguguguguguguguguauuuguuggaauccuugaauaugagauucauguuucuaauguaaguagacacauaaacagccauguggucaaaacucccaaaaguuuauaucuuccauuacaaggaaguuccauauggagaagccaaggauucuaauaauuggaaaaguuagguaccaagauucccuaguaucuaggaaagcuauuaaccaagaagaguagauccaguuuuuuuggaaaauaacuugaaccccuuacuuuaaacaaagaaccagccagacgcgguggcucaugccuauaaucucagcauuuugggagacugaggcaggcggaucacagggucaggaguuugagaccagccuggccaacaugcugaaaccccaucuguacuaaaaauacaaaaauuagccaggugugguggugagcgucuguaaucccagcuacucaggaggcugaggcaggagaauugcuugaaccugugaggcagagguugcagugagccgagaucacaccacugcauuccagccugagcgacagagcaagacucugucucagaauaaaacaaaacaaacaaacaaacaaacaaaaauaugcuucucuuuggaguaauucuggucagaaaaguuuaagggcaggcugaucaaagaaaacaauuguucagaacaagacgacguggcuaacugggccuugggcuaugaggaaggcuacuagaaaagauauacauuggaccacaaaggaaaucauuuuuucuacaugacuuaaaaucauuuacuucauuguaaaaagugguugaacuaccagucucuggaaguccuuucuaguuuuaaaaucuguauucucugaaauuuuguauuaagcacucaguuuauuucuaacuaggaaauugagugaguugcugagaacaagcuugucugaaggaaccuagaggcccacacagcauuucuucaccagcagaacuagguaaaaaaaagucuagaugaauaguagcaagcaccaaggccuaacaacuggauggccauauaauuuaucauccaaacuagggcauuuguggaaaugaaaagaggcauauuaauaauugugccaggacaacagacauacauaaaccaggaagggcuauccugggaaaacuggggcauauggucacccuaccuaaaggccaaauuuaagguauacacaucgaguucuacauggaaggucagguuggucuacaagguggaaaauacucaaaagcugagauucuaguaagcaaacagucugugaguauguccucuccuccaguugcuuuuggguucugucaucauacuucacauggccacugauacaguuuggcuguguccucacccaaaucucaucuugaauuguagcucccauaauucccacguguugugggagggacccagugggagaucacugauucaugggaggcaguuucccugauacuguucucaugguagugaguaagucucacgagaucugauguuuuauaaggggaaaccccuuucacuugacucgcauucucucuugucugccaccauguaagacauacccuucaccuuccaccaugauuguggggccucccuagccagguggaacugugaguccauuaaaccucuuuuucuuuauaaauuacccagucuugggaaugucuuuauuagcagagugaaaauggacuaauacagccacuguuuuaggaaagccuugaguaggugccuuaggcucucucagugcauaacaucaguagguggaucugggcaagaggagucagcaguguaaguuguggaagucaggaagcuaugagaucacauucacugcaagacacugaacuugucagguggugacuagccaugcaccuugccauacaucuuuguuccuaaguaaacaguagcacaaauacccuaauucaauucucaguaguaaaacauguaaguuacuuccauauguguucaaauugggacuggaacagaaguuaaacaaacaguagaaaaauuaaaugauaucuagaaaaggaguaccacaaaugcccauauuucucaugcaaagucagucaucugauuaucugcugcuugaaaguacuuaaguucucaguacugggagcccuaaucacaccuaaaugagcgcugacauucauccaagaagucuccuaccaccccuuccuuccagguacacauuucauucauuuaaugacaaccaaugcugucacugcggagacucucaacuucauggagccucgagcguagugacauuguuaugcccaaggcuccaugaagccacagugaagcaucgugcccgcucccucuuuccauuagaagcuucucuguuuuguccuuuuauacacauaagauauuuuaaauucacuagauaauuacuguaagugguaaugcagacacaaaauuuaaacucaauacauucauauaaacauaagcuuguauccuacaauuaugcuugcucuuauauuucuuuucuuuuuguaacagaagacuuuaaaaguauaacaauuuuucaaccauuacuuuucuaaaguuuuaaaaaaaaaauagacucauaccaccuaaaauaguuuucauaccaaaaguuguuucagcuaaaaaauauacacuccuuugaguguaaacaauacaguaagaauuuuaagcuacguuaaaagaucgaggacauggagaggcugggauuuaagcauguagcaaugauauauuaagugggugaaaauaauuauagguugcauagaggcuuugcguuaagucagacaaagauggcaugcccggcaagggcugguaagugugggcacauuucauaggaacagaacugcaggcagagaauguuccuagcaugaauagguuauagagguuuuucuuuggggguaacaagagaaauuuaaugaucuccuaaaccauaugagagauugcaguggaaauguaaauguguagguacuccugcaucucagguaauggucccauuagccauaauaaaguuuagaaaacccuaguauaaugaggacaggaaacauaggcaggccugcaagcuaauuguagaguggagaaacaaagaguuaggagacuugaggugauauaaaagcugagaacccucacucagcuggcuugaucagccuaaaagccagugagaguucccuucugaggagggugguaucagaagaaaaaucuuuaaauaaaagaugaaagauguuucguuucuuccccuuaacuuaaagcucgaccauaugaaguggauaacacauuucuaguuguggcuaccagugucucuccaaguuuccaguaauuuugagauuccuuuaugacagaaucaugguuacuuucacaaucuaguuuuacccccguaugucauaaaaccaaaaaaaaaaaaauuaaacacaaggaaaacuggauccaaauaaaaaaggccuaucuucugcacauaguuacacaucacugaaaugcuaugaugaacaaauuucaaagcuaauaaugaauguaguuggugacuauugcuaauccagcuucuuuucugauacauccaauauuuauuaacauaacuauaaagcaagcaucacacauagagaaauugcagagaacagaagaggauccaugaucagcuuugccuucugguaaccuuguacagaagaaacuacucucuuccaaguccaguuuuugccacauucuaggaaaagaacucuuuucauuuuuuuacuuuuuucuuuacuuuuuucauuuuucauucuauacagaaaaacugcacaucuguuuauaugguguucuauucuuccuagguauauauaaaauagccaaaagaauaaaaaagaaaccaacagaaaaacuaucagaaauaauaacaguuaaguaaggugacugguuacaagauaaauaugcaaaaacaaaacacauuucuagauguacaaccaacaaaaaacaucuaaaaauaaucuagggggaaaaguuucuacuaacaacaacaaauuuuauauguguacaaauauaguugaauuuauuuauauauguauaauguacacagagauauauauauaugaauauacauacauauauauuuacauacauauauauaaccuaugaauaaacuuggauuuaaauaaacaugaagaauuauguauacaacaugcaacucaugaaaaaaagaaaacaagaaauauucauggugaucaaucauacaccaaccuacagcugcacuagcaauaaaauaccugugaauuaaaauaaugaaagagaucguuuucccccaucacuuuagaaaauaaaaaugaaugacaguagccacugcuggcaaggauguaggaaaacuggcaugcagagggcaauuuggcaauagguaucaaaagcccugaaagcauguucacccuauaauccacaaguuccacucauaaggguuuccugaggaaaugacuagacaaaaaacaauacaugcaugauguaggugagagcagcuuucaaggcuuucacacuuagaaagauguucacaacaucauucagugaaaagaaaaauaaaagaauacuaugcuuggcaacuuuuuagaaguauguuuauauacauacauucacauauagaaaaaugucugaaaagguguauaccaaauguagcagugagcuacuguuuccugcagaacuuucaagaguuuuuauuuucuuucuuuugcuuaacuguauuacccaaaauuuuuacaaugaauguauacugccauuuuaagacgaaaccacaauacaagcuauauuuuuaaaggaaaagaagcauaguuccuuuaauaaaggaauuauuuaauuaaggacuaauuucgaguccaggaaacaccaggaaccacagacauucacaauaccaccaccuaccaugcagggagcagcagcugaccaggcuuucccuacauccccuaaacucaaugagacagauguucccugaauaucagcuggugggaguagguaaagacaaaaagagaaacaaaaugccucucaccgucaaggugauuauaaucucauugcuaaaauaagccaaggcagcaguuagccuacuaccauaaauaacaaacaaagcaucaagcagcccucaaggagaaaauuaauuucaauuaauaugaucagggaacccuuuagugaagaagcagggcuuaggcagucucuacgauacaauuuggacagggaaauaugggcaggaaagagaagauccuauagacagggaccacuguguacaaauccaugaaacaggaaaaggcaaagaggccuauucagggaaaagcuaaaaguccaguugagcuggggcaucagugauauggggcaauaguguugaaaagguggguuuagaaacagugauccacaggcuuaagcaagggguaggacuuucaaaggaaagggaacucuagaaccagaacucagaacuuggaaggcuauuuauaaaggcugaaagcaagcagaagcugcaaagacuucaggaccugggaagggcugaacacagauaagauucuuuuacugggucaauuagagccaucagcaaaguaauuaauguuagcagcaggagagaacggcaagagaccagcaaagacauuaaggagcagccucuccacauaugaaaaccuguggcuuuaacuguccuccacucauucaauuaacggccgaagauacugagugagagaaaaaaauaagaagaagagaauuaaagaaaugauuaacaaagauaaagguuuuuaacuaaauguugccauuucuuuaaauucuuucacuguaaguuauagauguuuguccuaaaauuuauuaugcaaaugcuaauguguacuuuguaauuuuacacuguuuuaauaaaggaagaguaagauuuuuguagaacuacuacuauugucuuuugugugcucucuuccucucuuuuuguccuaccuaggagaagcccaacucuugauuucuccugcaccaccacaaccugagccuggaauauaucuacuggcugaacugagacaggggccucuguagagcaaauccccaagagacagacugagggcaugucugcacaacccuguaaaguaaaaggcauuugaaguugucacccuugauuucucuguacuauacagaaaacaauauucugugcaaucaugguacccuucauacauauaacacaggaaucuuuagagaugauaaucuugcuccuuuuuauuuuuuauuuuuuugaggcaggcucuugcucuguuacccaggcuagaaggugguagaaauaucacgacccacagcagccucaaccucccagguucaagcaauucucccaccuuggccucccaaguagcugggaaccacaggcaugugccaccaugaguggcuuaucuuuuuuauuuuuuuguagagauggagucucacuaucuuccccaggcuggucuccaacuccugggcucaagcaauccucccuucuuggcuucccaaagugcugguauuagaagaaauagccaccuugccaggcugguucuucuuaaauaguagauauguuuaaguaauugucacaauguagcaauuagaaacauacuucuacaguaaucucaaaccaguaugguagauaagaacacaaccuaccaagaagagaaagagaacagagaauuuuuaaugcuuucuucauguggguacaaaacuacuaucauacaaaguggcaacuauuuuuuuaaguuaucauuuagaaaaaugaccuucaaauaagcccaccuucugagcacauuucauagcaucacaaaaauuguucacugggacuucgauuguuuaaaaaaaagucaugauugugcuuugcuuaccuaaaucacaacuaauuucucuaacaaacagaauuuucauucuucuaaauuauguacaauuuuaaaauaauaacaagcuaagauaccucugaaaauuacagaauauauuggaaaaacuaucagucauuuguagcuucuuuggaaaggauaauucuuccaacugguguggacuuucagauucaguguuguuuaugagcgugcuaaccggcccuuuuucacugugcugucauauccugucacaggggaaugccugaacuaaacaggcacccaggagcugaccaucucugagaucucagagaaguaacuaacauuguccaacuagucuucucccuuacaaaaaccaagaauguugaauuauagggucuccaagaaaacuucuaagucuaaaagagugaauaugaguaugauugucaucaucuccuaccuuaaauauacaccuaggcuaaacuggaaguugaggacuauuaacacacacgucuauuugauauuuucaucuauuugauacaugcuuugucaaauaaucagcuauugcauacugggaugacuucaggcccaucuuuuucagaaggugcugaaagaacaguucuauucguauugccuauaugcuguaaagagcugcugaaauuuucuucuaauucuacauauuucuauguaccucaacaaaaagacuguaccccaauuaccaagauguaaagugauacacucuuucuacagauuagauugauaacaaaauuccuuuacauagaaauucaucugagagcuaaugaucaagaucugcuaaagccacaguugcauuaacaccaaacuauuuaaguggucugcugaaaaucagacaacacaauuagaaaaccaucacuuaauuguaauuaaaacaaauuuuaaaaaccugagagucaugcuaacauguuuuuaaucacaaagacacuaaaaaauaaauauacugaaaauauaaguacucauccagcaaaaucuuauaauaagcaaauuugaugacaauugaugucacuuugaaagacauguauaaaauagugauuagaggugcauaauuuaaucuacuccaggcuaauuauagagucuagacauuuugcauaauacuaaaacugaauuuuuaucuuuuaacuauuauuaaguauuuacacucgauucucuaaauauauguccugaaaucauuuuaaauaauuaugagcacacacauuccuucuauccuaauuaaauauaaugugccaguaauaaaauccagugguaguagaaaaaugcagaacagaucuauaaaucagaacuuuaagacaauuuguaaaaaugagcauuuuuccugcagccagacaacuuucauuaaauggucuuaaauuuucagcccauguagacuaucuuacucacauucacaaagugccuugcaguguuuggaucaaaagcaaaaccuuuguaagauuccagaagcagccaaaucccaaagagacugacacagaaaaagagagaaacuauucuauuuaggucuuucagagggacuauuuuuaauuuaaucuuaaaaccagacauuuuuagaacccugguagaaaugcuagcauuaacuguauaugguccauuauggcgaauuuacuaucaguaucaguuccaggaaccagaaugguuaggacuagagaagauaugagaaaaguccuaaaugaacugauucacauccaggaaagccacaccaagguugguaacucaugacagggguagaaaaaugaaguggccacuccaggaaaaauccagaagcuuguggucuagcagagucaaaauucugggucaagagaaaugccuauaaaggcuagagaucauaccagccuguggacacuagaaaagcaaacaagacucuccaaaauaaccaucccauaaaaaggacaggcaccacauugcauccacaguucuugguauagcugccuacacagaguaggcauucuaacauuuguugaugaagagucaacaagucaagcagcucagaaaaaaacaagauggcacaccauacucaagacaggaauccacaggaaccugaggguccuagaggcagggcuuagcccccagguaagcaaugaggggucugagguagcacacggcaguggcagcaagaaaacuuugagacucgggcuacuuucugucucuaucuuuugcagauaaguaucugugaaggcaaaagucaaucccaggcagucagcccaugaagacugggaaugugaggcugaaagaacaaaggaugagagcagacaugacugcaagauuacuucaggaacaguccucuuuaguauauuucaaacagagcuuuacaaagaaagugcauacguguguuuagguguauguguuguguguacgagcguguuuuuuuauuuuagcaagcuuacuauuauuuuauuuuuauuuauuuauuuauuauuauuuuagcaagcuuacuauuguaagacaaggaaaugcugcugguguauguccacaaugaucaggaggaaaugaggucagaagaaguugucugcccucaaacugcuaggccaaaauagaaaauuuccaauuauuccuuaucaaacaaggguagguugggugccagcucacugaauauuugcauuauauguacgugaacuuuucuuuuuacacuaguucuaauuucagugacacagcacgaauagcugaaauccuucaagagugaacgucugugcccucccaaaauucauauauugaggcccuaacccccaaugugaugguacuaggagauggggcuuuuaggagguaauuagguuuagaugagggcaaaggggugaaguccucucuuuuuuaagaagagaccaaagaacuuugucucucccucucucucucuaccauaugaagacacagcaagaagguggcuugucuauaagccaggaagagggucucugccagccacuaaaucuugaggugccuugaucuuagacuuccuagccuccaaaacugugagaaauaaauguuguuuaagcuucccaguugaugaaauuuugcuauagcagccugagcagacuaagacaagcauuaauucucuccucaauccuaaacaaauuauucuuuuguggaauguuagaaaaaaaacgcauuuacauuaucuuuauuuuuuuccugaaaauucuauuguuacuauuuuuuaucacuacuuggcuuuuucuuucuuuuuuuuuuuuuuaauaaaaaugcccaaaucuuccauguaagcuucaggaugagagguuaccuuggguaggaguuggggugggggaacgugacugagaggaacacagagagcuucugagacacaagcaauguucuauuucucaaccuggaugguggguauauacgaauguccauuuuauuacucuucuuuaaacugggugaauauauuuuccacuccuuuauguguacauuucauaauuuucauaaauuagaggaaaagaaacccaaaauguuuacagauaauagaaagagaagagcccagcccaauucugacauuaaaaauuuugaguaugagacaaaaugagccagaaacagacccaggaaaaagccucuggaauuagaaagcugucacuacuaagaccagaacaggaaaaaaaacucuaaagaacaugugggaggugaaaagcacagagagaacaaaaggcaacuuucuccuucucuaaaaauagcaagccuauuaggccacuuuuagacuccagucuaaaaguguucacauaggaguccauuuauauuaaaacaguaaaacuuagaaaggaaaaaguucuuggaggaugccaaagcauggaaaaguucaaaaauuucacgaaauaauagaccagacaggauuugaacuauaucugacuuuauuaccaaaauagugaacuaucagaccagagagcuguaggagcagaagauuaaaggguaagacaaaccaaauccuuccccacacuguuuuuuucuauggaaggacacaggagcaaagacuguguguggugcaacauggagcaaaucucauggagcaaaucucauggagcgugccaccacaacaaagcugguuucaaaauaaaauggcaagggaaauuaucccgugcccuucccuggaagaaugugcaaacuuauauuuaauuuuuaaaaaacagaucuugcuuucaaucaccaaaacugccguggcuggaaaauaucaaucucaguuguuucaaugaucacuagaaaacauauuucugaguucauaaugacaauaaaugucuuccuuuucugacucccauauucuccuacuguaauaagagauguuuguacacaggaaggugaaauucauggaugauaacaccaacagugaaucuaaagaaaagcaagaccuaugaucacgacuauacugagauacaggcauaccuuggggauacugcaggaucuguuccagacuaccacaauaaagcaaguaucacaauaaagcaaguuacacaauuuuuugguuccccaguguacauaaaagguagguuuacacuauacuguacucuagucuauuaugcauguaauagcauuauaucuaaaaauacuuuauugcuaaaaaacgcuaaugaucaccugagcccuucagcaaguuguaaucauuuugcugguagagggucuugucuugauguugauggcugcugaacugagugaucagugguugcugaaggcuagaguggcugugccaauuuauugaaauaagacaacaaugaaguuugucucauugauugacucuucaugaaagauuucucuguagcaugugaugcugugugacagcauuuuacccgcagcagaacuucuuucaaaauuggagucaauccucucaaacucugcccaaccaaguuuauguaauauucuaaauccuuugcugucauuucaacaauguucacagcaacuucaccagcaguagauuccaucucaugaaaccacuuaaguaacucuucauccauucaagucuuaucaugagauugcagcaguucagucacaucuucgggcuccacuucuaguuguuccucucuuacugucuuucuaccacgucugcagugacuuccuccacugaacucuugaaccccucaaagucauccaugacgguugaaaucaacuuauuccaaacuccuguaaauguuuauauuuucaccuccuuccauuaauuaggaauguucuuaauggaauccagaaugguuaauccuuuccagaagguuuucuauuuacuuugcccagacccaauagaguaaucacgaucuauggcaacuaucacuuuacaaaauguaauacaaaauguauuucugaaauaauaagacuugaaaguugaaauuacuccuugauucaugggcuucagaauggauguuguguuaucaggcauaaaaacaacauuaaccucguacaucuccaucagcacucuuugguggccaggugcauugucaaugagcaguaauauuuuaaaaaggaaucuuuuuuuguccugugccauaggucucaacagugugcuuaaaauauucaguaaaccauauuguaaacagaugugcugucacccaggcuuuguuguuccauuuauggagcacaggcagaacagauuucgcauaauucuuaagggcucuaggauuuucagaaugcuaaaugagcacuggcuucaaccuaaagucacaagcugcauuaucaccaaacaagagucagccuguucuuugcagcgucgaagccagguuuugaguucuccucucuaguuaggaaaguccuagauggagucuucuuccaauaggaaggcuguuucaucuacauugaaaaucuguuguuuaguguagccacuuuuauuaauuaucuuagcuagauguucuggauaacuugcuucagcuucuacauuagcacuugcugcuuuaccuugcacuuuuauguuauggaaacagcuucuuuccuuaaaucucaugaaccaaauucugcuagcuucaaacuuuucuucugcagcuuuuucaucucucucugucuucauaaaauugaggggagauaugcucuggauucagcuuucacugaauggaauguuuuggcugguuugaucuucuauccagaacauuaaaacuuucuccauaucagcaacaaggcuguuucacuuucuuaucauuccuguguucacuggaauagcacauuuaauuuccuucagaaacuuuuccuuugcauucacaacuuugcuaacugacucaagaggccucaguuucaaccugucucagcuuucaacaugccuugaaacuaugcuuaguaauuccuaccuuuuaauuucaagugagagacaugugacucuuccuuucacuuaaacacauagaggccgguauaagguuguuaauugaccuaauuucaaaauuguuguguuucauggaauaaggaggccagagagggagagagaaggggaauggccagucaguggagaagccaggacauacacauuuauccauaaaguucacuggauucuauggguacagucugugguacccccaaaacaaccauaauaguaacaucaaacaucacugaucacagaucauaauaauuuaaauaauaaugaaaaagucugaaauacugcgagaauuaccaaaauaugacacagacagagaagugagcaugcgcuguuggaaaaauggugccaauagacuugcucaaugcacggcucccaaaaaccuucaacuuguuagaagcacaauaucugcaaagcacaauuaagugaagaacauaaaacuagguauaucugugcacucauuuuauauaguucaaggcacuuccagaugcuuuuugcucaaaaaaaaagucuuuuucagaguuucuauuuuuucaucaaagacaauacguuacauuguuagacuauuuagaacauccaauaauucuaaaaaggguuauucuaggaaugucuucacaugcaugcucagagggucagaucaguauuauaaauuguucuauuuuuauacaaaaguuuuuagaucuugaggccauguaacggcacucaauagccuuuucagcugauuauaguaucuaaaaccagaggacauuuuugaaauagcuagcaauuuaaauacccacacuaaacugcaauuuaaaaucagaaaugaugagugaaguaauagcauaaugaggcuuuuuuccuuuuuucugugucucaugccugaucauucuuacaauucuuaacuagagaagaauuugaauuuguucguccuuuaagaggcuauuaagcagcuuguuuagaaaauugaaaguaauucuaauuuuuaaacccauaaucucaugaaauaagcauguggcuaucaguucucuuuaucucuuuuaugugaauucuaagcauuacaccauuuccuacaguuaccuacauuucaccacauaugucauugaaauuaccuucuaaauauuccaaaucccagucaucugcaccuaguguugaauaccucagugaauguuccuaguuaacagaaccucauucguuaccuugucauccaaggccacugacacuguaacauaccuagggaaauauguaacaaucaaaauacuuccagggaaugaaaauguuuccuucccucucauuuucugucuuagacuaucauuaauuuuuccuuauuuggauuccuugcacagauaaguuccucauaaauagcaacaaaggaauaaaaaaagaggaauaaaaaauuacuacacauucccuacagaaagaaauuaguccaauuucaagcugcuaaaaacuacaaagcuaaauacugagaagucuaagccaacacaugcauccccagaauuucaacaggucagaggaccuucuaggggugaagugaagaaaugugaaaguucaaacgccugcuugccacacagagcuccaaggagguucugcuaugagcuccacuguccugauuaugccccuagggagggaugcaccccuccaaggcagagaacaacagacuggugaagagugaucaaaacaacaaacuccaaacaagcuguggaacccuggcucacucuucccucccuguccccacuggcucuccuccccacacucugcuucagcaaauagcuguccccaugcauggaagaaucauaaugagaaagaaaagaacacagauaaccaggaagaaaagaaagaaggaaaguagcaaaccgcaggggagaugaaggauaugcaucauaagaaaacagaggaaauguucaaauacucugaucucaaagaaauuauagaaagaaccucuuuuguaaaaggacuucaaagagacaucauaaaagaacaugaaaaggcagcuggcaaagcucaggagagaaaaaaaugaaauaaaaaauaaauaguacaagggugcaacccaaauuagaaaaaggaaaaacaacgaaaauacagucaggaaucaaugauaaaaugguauagagaugauagacaaaaaagauaaaagauacaucuuguugguagguacuccuaaauaaaacacauggaagagaaaaaaauagguaaaaauauaacagaacagaacuuuccuaaaaucaaagaaagacuugaauuugcagcucaaaaaacuauaccauguuccuggaaaaacugguaaaacaaugaacauaaauaguguuaguacaccuggaaguuacugauaaagaaaaaucauaugaccaucuaaggcugaaaaagcgagcucucuaaaaggaaaaacuagguggccucacacucacugagcaaaucuccagcuuaagcugagccauuucuauaaagucccagggaaaguaugauucaaaauuucauguccagccaaguuauucuucaaacacuucccaacuguugaagaacucaugaaauacaacacucaaaagucuuucucagacaaucugcuuuuuaauuaauuccagucaagccaaacacaaauaauccaggaaguauggagaaaccaugcuaaaaagacccaugaugggcccaguuauuuuaaguaaagaauugguauuuauugugguuacuaaacaaaacacaaauuuaauaaaucuuggcaauguaaaaagaacauuauaacaggugagaaugaagugaaagaagucuuaguauauaaauuucuucucuucuuaaauauacaaucugaggcauuucuuuuuaaacgacuccauacaaaguucuucacaacuuuaguaggauuuuuuuagcaaguaauauguuuuguuauaaagaaauacaguauuugucugaucuucaccaauuccuuucauuucauuuguuuuucuuuuaaauuuaauauuuauuaagccccaaaagaaggugcucauaauuagaaucacagaccaugaguuccuccacguauaauuccuccuaaugugauuucaugcacaguauaugcacuucauaacuaugaugcauaauuagaaagcaaaaacuaggaaggaacuaaauaaagagaccaagucuaggaaaugagucucaauucaagacuaacugcagucaauugggucugacaaucuacaaaacuauguugauaaagauucugagcucaagucugggauccaaaggaaagacuccuacaacuauuagcuaaugucaaagccacgggcucaggaggagagaaggaaucacucaugugucacacagccacuacugauacuugucuucauuacauaaaacuuauuaccauaguuuauuuuuuguuauauaauuuuaacuaugaaaauaauacaaguucauuacaaugucaaaaauacagagguaaagaaaauacaggcugggcgcaguggcucacaccuguaaucccagcacuuugggaggccaaggccggcggaucaccugaggucaggaguuugagacgugccuaaccaacauggugaaaucccaucuccacuaaaaauacaaaaauuagcugggcgugauggcgcaugccuguagucgcagcuacucgagaggcugaggcaggagaaucgcuagaacucaggaggcagagguugcagugagccaagaucaagccacugcacuccagccugggugacagagcgagacuccaucuccaaaagaaaaaaaagaaaaaagaaaauacaaauaaucucccccugaaaaauaaauuuaauauuguauucaaauuuuguuaaauuuaaucauuuauauuuaaaauaucauuauagaauaaucucauauguguacacuaucaagccuucuaucaguauacauacagaguucucugaauuaaguuuaacaauauuaauaaugguuacuucugaauacgaaucuguuuuucacuuuuucuuuguauucuuuuuguaucgacuugacauuuuauaaugagcagucacuuuuccaaaaacauuaucucuuuacaaaaaaacugcuuuugauuuaacagcuauucuucuaugucucaaaaguacaaagauuucugacaaugaaaaagaaacuaauauaaacaucuauugcuaucuucuuuucauaugaugguuuggugacaacaggucucuaacuucacuacugaggaugaacaaguaacuugggauauucauugcuucaucaugacaagcugccauuuuaaugaauccuugguuuuggacaaaacuuugccagcgaucucagagagaaaaauugagaaaauuauucauagaguuauaaggugcguuuguuacaagucuuauguuguugaugacuucucagaaauaagacaaggucuuuacuacucaaauacaaaaugccuauuucagcaccuggaacuuaguagguaccucaaugcaugcuauguuuagcuucauuaggugauauuugaaaagcagggggcuuuacuaagccccuuccuuuucuuucuucuuuuucuuucuuuuuuuuuuuuuuuuuggagacagagucucagucucaguccaggcuggagugcaguggcaugaucuugguucacugcagccucugcuucccagguucaagcgauucuccugccucagccuccuggguagcugcgacuacaggugugagccaccacgcccggcuaauuuuuguauuguuaguagagaugggguuuccccauguuggccaggcuggucucaaacuccugaccucaggugauccgcucgccucugccucccaaaguucugggauuacaggugagagccaccacgcccagccuagccuuuucuaagaccuguuaguaaagugauaaaaaguaaacuaggcggccggacacaguggcucacgccuguaaucccagcacuucaggaggccaaggugggcggaucacgaggucagaucaagaccauccuggcuaacacggugaaaccccgucucuacuaaaaauacaaaaaauuagcugggcguggugguggaugccuguagucccagcuacucgggaggcugaggcaggagaauggcgugaaccugggagguggggcuugcagugagccgagauugcgccacugcacuccagccugggaaacagagcgagacuccgucucaaaaaaaaaagugaacuaggcaauuuauuuauaaaggagaaaaacucuuugucucuucuucauuucauuaaacccuuaccuccacugagagacagaccuagaaaugagggaagcccaagcaggcugcacaggaucauuggucugcagaucugugcucuauaaucaccauugaauaccagccuauaaauuuacgggcuaaaauaaagucuaucaggaaauaaaagacccaggaaagcuuaaagacaccuauaaacuuaaaaggcaaguuugcauuuuuauaucagugagaccaaacaaaaguauuagacuacggcuuaaaaauacacaacaguggacauucagacaaaaucucauuaagaaaaguacauuuuuaaaugaagcacgcaggaaaaagccauacaauaaauccuacuguauuaguacuuucucgcauugcuauaaagaaauaccugagccugaguaauuuauaaagaaaagugguuuaauugguucacaguucuguaggcuauacaggaagcaugguggcaucugcucagcuucugggaaggccucaaaaaacuuacaaucacaguggaaggugaaggugggaggccggcauuucacauggccagagcaggaggaagaggaugcaagggggguggugcugcauacuuauaaacaaccagauuucauuagaacucaacucacuauugugaggacaguacccagggggauacagugcuaacccaugcaugagaagucugcccccaugcuccaaucaccucccaccaggccccaccuccaccacuggggauuacaauucgacaugacauucgguggggccacagauccaaaccauaucaccuaccaugcaagcaucugacugcaacuuaucauaugggaugucauaguuuuaucaauggucaaauuuuaaauauacuuucuuauaguuaaaaaaaauagcccugcauuuauaucucacuaugugaauguugaaaagcaagaguccuuaaauagaugugaaucuccuuuuauugcaagguaagguacaauccaauccaacauuuuucagauccucugagcaccuuuuuccauuuuuaaaaaugauuucagccaucccacucuuuuucacuuauacagguuuaucuaacaauuaauuuugacaaauaccugcuguuucaugucaaaaugcaaguaugauugauuggaaaacaagauuuuucucauuuuacuuagauaaaaccaagggacaugacuacacaccugcuuaaagaauuagauuguuuugugaacagcagagaaguuaagaaaaaaaugcaaaugaugauuaagcaugacgggcuuuacccuucagagagcaaacauccagaaaaauaaacagacuagaucugcaaucuaaaagguaaaauccaaaugaagguacucuguuuaccucaauauggaaauacagauuucaagcuauaacugacgaaaugcuugaaagaguaaaaaccaaacagugggaaccuaggaacguuaagguccaugacagccuguagugugaguagguggacaaggccuggagaaagacuccuaaacugaaguuuucuucugccuagcgaaacaucagcuccacuuggugaaccuugagagcaaaggcuuagcccacuacauuucacuuuucagcugaaguuacuacuuuuugcaucccuauucugcuuugcuucuacuuuauuuuccuaccauccuacaggguccagggucagcaugugguaaugaauccccacccauaagccuuuuccucugcaaaaguugcuuaaauaugacaaagaauaaccguguagaaagauaccaccuuuuguuugcagaaauuguuguggugaggcaaaaacaaaaggcuugucuagaagagacuugguaagaaauuucaugaaaucugguagccucuaugaggcauauguuaauuuaacaggaaauaaauuauuuugucuugucugagaacucuagacuuuaaaucuaacccuucuuaaugugaugauccauucuauaaagugucaacacacaacuaaaaaagggcuggaccuucccaagaaccaauguaaaucugugucacccacaaaaaucccacauucucucucuaaggaaaaggagaaagccuggugaaaaucuggauauccuuugcacuugcagcuauaugggggugccucuuuagacagccgguggagauccagagccagaaugcagaugaaaucaacuauauguacaacuuaacauucaagaucuaacuccuccaugccucaguuucaucaucugcaaacggggauaauaauaguaauaugguuugagucugugucccugcccaaaucucauguaauccccaauguugaagguagggccuuguggaaagugacuggaucaugagggaggauucacucuuuagugcuguuuucgugacagugagcaaguuauccaagaucugguuguuuaaaaguguguggaaccucccccuucucucucuuccuccuacucuggucauguaagacguugccugcuuccccucaccuuccgcuaugacuguaaguuuccugaggccuccccagccaugcuuccuguagagccugcaacaccaagagccaguuaaaccucuuuucuccauaaacccuuacccaguuucaggaauuucuuuauagccaugugagaacaaacuaauacaaauaguaacuaucuccccgguugcugugagaacaaaaugaguuagcucauauaaggcacuuuggacacuauaacacacacuggaaauguguagauuauuagugauuaaguugauuauuaguguuauuuugccuggauuccaggcccuguuaacuuugagcuaaaauuuuuauccuuuugcugacaauucuggaggugaaaaccaaaucuaaacuaccauuuuagaagcuuuaguuugcaaauacauaccuccuggaaaauucuauagcuaguagguuugauagccccuucuuccccuauaggccacuuggcucuuaccaaagucaggagaggaagucuuauagcaaucaaaucugguacugaagaccucaaaacauauucucagucccagaaucuucauuaauguuuugacauacuuauucuucuuuuuacuuaaucuuuacuauuuaaauauucugaaauauuuagguacagacgguacauuuaauaauuccacauacauaaucuacagcuuacacauauaagagcccuauaggcaauacugucccuauuaguaaaggagaaugacaagagcuaugggcugaaaguccagaguccuggguucuagggcucaacacaccccaaggggacccuggacaaaaguguccacuacuaaauuucugggucuucaucuguagaugguggaauuuggugcaaacucuguaacucuacaaaguaugugucaaauuaauagcuacauuucugaaguuauuuugcuaaaaauugaaauaaagcccuuuguuuuccagauuucagauucaugauacucuuaaguaccuggaacauggccagcaucuaggauacaaaguugagucuucaaaagcacuauuuucaaggcagggcgucucuuacacuuggccagagaagaccucaagucuuuauucaagguuacuaacccaugacuaacauaaaaugcuacuaauuuugguuauuucuuauucuggcucuaacacauuaaaaaggaacaaauuaguuaagagcugggcugauacaacagguucacucagggcaaauaugauaaccuauauaacaagaaaacagucacaaagccuaucauauugcugauuaaacaggcaaaccaauaauuuugcauauuaaaaaguaaaauuacaucuaauacauucuaucaaaaaaauguauuuaacauauuauagaggauuuuuaaauggcaccuuuuuuaaaaguuguauuaaagauauauaaagauuauaucaagaaauaggucaugaauauaucaaggaauauaucaaagauauaccaaggauauauaaaaguuauaucaaggaauaaauuuaaguuaccuggaaaaccuacuuaauguguaaaacuccauucccagaagccuguauaaaugaggcuuuacaauauaagaccuuucaaaauaguccuuuauagguuuuaggugaucgggaaaaaauuaggucaaaauuuacguaguugcagcacagacaacuguguuagugaagccaugauaacucugagugguuuuuaaguaaaaccuuacuuaaugcuuccaugaauagcaaaauaggaaauaacagacuguucacaaauccuuacagcagccauuaaaaaggccaaaaucagaauugacuuaugacagaauauuugcagaagaaacugauuauuacuggucauguaauagaaaguauacuuugccaaaggaaugaaacacccguuaaaugccuauuauacaugccagucccuucacauacugcaccucaauuagcccuuccaucaaucucaguuuucaguuucauaaacugagggucagaguggucucacgauuuccccccaguggcagaagcagaauguaagucaaaauauuuagcuauaaaucuaaaacaucuaccauaccacacuauuaauucacucauuauacaaacauugacugacccucuaccuugugucaggccuaguuuuaggagcugauaagcaauguauuucuuuuucccucauccuuuucucacuucauuaucuccucuccuuuaacuuucagacaaguaccuucuugucuacuguaagaaaucacccauucaaacccaacauacagagaguaacuaugccuagggaaaaaaagucauuuaguucaucccaaaaacaaauaugagauuugaacacucuagugaacaucaugcuuugcucaagaggagaucagugcagcccuucuggaggacgauccugaaguacuucaucaaauuaaguacacacuggcccaauaaaccagcaacacaaccacaagccauauuauaacgcacauguauaaaucaggauggauaaagcccauuggccuauacagccaauguauauguauauguauaaaugggcucuauucauccugauuuauacauauacauuauaauauggcuugugguuguggagagccacggggaaucuacauagcucccccugggggaugaagcaguuagagacacaauauaggguacucuaccacgguuagauauaaaaauguacacagguuuacagacagaccuuuaaacauuguauugaguagagaucuauagcauaacacuauuuuuaguaaauaaaauuacauguccacaaacuguaauuuuuaagaacaccuauaauaaaaagaucguguaaaacacaucggguugguugccucauuaggauauggucagggaaaauaagauggggacuggagauagauaaagauaaugaaaacauuaaacaauacuggggcuuugcucagaucaaugaucuaacauggcauaaaugugaaagacaauuaacaacagcccucuguaccugaaguucauuggaaacccaaggaguaucacuuagaaucaccaaaacauacgauuuacaaguguuugacuucuuuucuacaguucuucaaagucgauggaaaaauaccaauuuuuggccaacauuuguauuacauaugaaagaaguaauaagcugaaugucauaauuacaaaccaaaaaaacaaacaaaaaacucuuuuaaauccauaaacacagaagaaaaguuucugcuggcucauagguaacacaggagaaaauaacuacaguuauuuauaaaauguuuuuagguaaaaucaucaaaaggugaccuguuuugaacaaagacuauggccaaagagccaguuuaaacagcaugcccuguuuucaaucgcauuuggaagauagauguguuaagaauaacaaaagauaacaauaaucacaaaauugugguauugcauacugaugguuucuaaaucauuuuuuauacaccaccaucauuccccaaaucaaggcaaaggaaguuagugcauuuuugacauuauucuucccaaugcaaccagauacaaauuaauuuuuggcaucaaauuuaauuuuuagaauaaacuaauauuuucuguaaagaagauacuaaaaacauauuuguguuacugcauuucaauucuaaccagaaugcuaaaacauuauauuucaaugaaauuuuagaaauaaaacuaaauuauauuuaacacauugguuuuauauuuaauaauggguagguauuaacuucucucuuaacagacaguauuaacuucaauucauuuguaaaucauauugagacagcaaaaucuggcagaauucaaccugagauugcuaucaccuugcaaaaaguucuuauagacucaaaauaucccuuuucagacuauaaaaaucuccugcuguuuaauagcacuggacacuggcaggaagaaacuauaaauagcuucuuaugugcuuaaaauauaguauuuuucaugccuuagaaaaguucuuuuuauaauuuuccacucuuggaaaaugaucuguauucuuauuuuauauucuagguaaacacauacgaacagaacuuuggcuguuaucuuugggacaauagcaaugucaggaaccaauuuccaggaggugcugauaacugaaugaaguagccuaaugcucagucuccaugagugaguugcuuuaagugcaaaaauugaaaccaggggauaaaacguuacagaaugacaugaaaaaaaaaaguacuugauagcaaucagcauaguuuaagaaucagcuaccuaagucuggaaguguucaggaauacaccagaagagcucucaauagggauaagaagagauucgaaaaucagcuagggaguuagauugcaggacauuuaaagauuuaucuaaccucaacaugucaugauaaaaaggaagcucauuuuuaaaaagcuacaaguuguucuuggaaacaggaaacaaauacacaaacauacauguaaucguuuucacugagguaucacaaucaaagcucuuuucaauucaguagccuguauaaaucccugcaauucaaacacuacacacaacuaagucaaaaaaaaaaaaaagugaguggcucaccucuuagccuucuuugauauauugacuuuaaacaggaaaacacugaaacccaacuuucaaaaaagagguugaacuaugcuuucuucaacaguaagaaaacuguaucuucuacuaaaaaaauaaauaauuaaaagcaugagguugugacacucaaagcccuaccagauguggcagaugagagagggugauucaucaacgguggauaaaaaugcuggcaggaaaguaucucccagcgaaccagggaucccucacacagguggaagcagaugacaguagauacagcccaaagauacacacucucagguuccuggaggucccuugaugccaagggcagaggaaggacaagacuaacccucaggauugugcacaaaggagaggagaugggcauccaugcuucucugugaaagguauuaccuauagagcuaguagucaaauuauacuaagaaaaacauuuugauuacagacccuguaucauucaccgcugagauagagauaaaucuuacuaauauacaagguuuuguuucccuucuaaaagcuacuuuugagcaccgauuuuucaugaacauaauauccauuaucauggcuaacuaccugcauguuggugcuacacaaauguggaguaauaucuaaggaauuguguuauuuuuguacuuugagagucauauaauuuaaucauuacuuaccaggaaguugccuucaaagaaagagacaaaaacacuaguuuucuuuugcuuccuauaugguguggcuaccaugacaauagaucuaaugcaacaaugaguacgagaucaucuacacugauauuaguaucugaucaacacaacaaggcauuaagcuagccuuauauucugggccuuauaggaagaaagaauuuucugcauaaaaaauaaccagcaaaaauaaauuuucaaacaagucgugcaauauuuuaauaauaaaaaaauacuuccaaacagcauaucuucaggagagauaaacucaaaacaagaaaaauguaguacggguguuguucacggugcugggugaaggaacaguuugauuccuuuaauccgccaaccugaaaaccuugucucaaacugcuuuuauugaaaauacuucauggugucuuaagguuugcucauuuuuucauaguucacugaaucaaacguauacaaagaacccaggaauucaaagcugcaugaaaauagacauauuauuuacuucuaaaagcacuguugucacuagauguuuccauucagacaugagaacauuagugauuucacagcaacagaguuaacuaaaccucucaaaggaguaagaucacauguaaauuuuuuuuauuuuauuuauuuucuuauuauuauuauacuuuaaguuuuaggguacaugugcacaacgugcagguuuguuacauauguauacaugugccauguugguuugcugcacccauuaacucgucauuuagcauuagguauaucuccuaaugcuauccccccuccccccaccccacaacagucccuggugugugauguuccucuuccuguguccauguguucucauuguucaauucccaccuaugagugagaacaugcaguguuugguuuuuuguccuugcgauaguuugcugagaaugaugguuuccagcuucauccaugucccuacaaaggacaugaacucauccuuuuuuauggcugcauaguauaugguguauacgugccacauuuucuuaauccagucuaucauuguuggacauuuggguugguuccaagucuuugcuauugugaauagugccacaauaaacauacgugugcaugugucuuuauagcagcaugauuuacaauccuuuggguacauacccaguaaugggauggcugggucaaaugguauuucuaguucuagaucccugaggaaucaucacacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucauugcgguucugauuugcauuucucugauggccagugaugaugagcauuuuucauguuuuuuuggcugcauaaauaucuucuuuugagaaaugucuguucauauccuucacccacuuuuugaugggguuguuuuuuucuuguaaauuuguuugaguucauuguagauucuggauauuagcccuuugucagaugaguagguugcaaaaauuuucucccauucuguaggcugccuguucacucugaugguaguuucuuuugcugugcaaaagcucuuuaguuuaauuagaucccauuugucaauuuuggcuuuuguugccauugcuuuugguauuuuagacaugaaguccuugcccaugccucuguccugaaugguauugccuagguuuucuuguaggguuuuuaugguuuuaggucuaacauguaagucuuuaauccaucuugaauuaauuuuuguauaagguguaaggaagggauccaguuucagcuuucuacauauggguagccaguuuucccagcaccauuuauuaaauagggaauccuuuccccauuucuucuuuuugucagguuugucaaagaucagauaguuguagauaugcggcauuauuucugagggcucuguucuguuccauuggucuacaucucuguuuugguaccaguaacaugcuguuuugguuacuguagccuuguaguauaguuugaagucaaguagcucgaugccuccagcuuuguucuuuuggcuuaggauugacuuggcaaugcgggcucuuuuuugguuccauauaaacuuuaaaguaguuuuuuccaauucugugaagaaagucauugguagcuugauggggauggcauugaaucuauaaauuaccuugggcaguauggccauuuucacgauauugauucuuccuacccaugagcauggaguguucuuccauuuguuuguauccccuuuuauuucauugagcaguggauuguaguucuugaagagcuccuucacaucccuuguaaguuggauuccuagguauuuuauucucuuugaagcaauugugaaugggaguucacucaugauuuggcucucuguuugucuguuauugguguauaagaaugcuugugauuuuugcacauugauuuuguaucuugagacuuugcugaaguugcuuaucagcuuaaggagauuuugggcugagaugaugggguuuucuagauacacaaucaugucaucugcaaacagggacaacuugacuuccucuauuccuaauugaaugcccuuuauucccuucuccugccugacugcccuggucagaacuucccacacuauguugaauaggaguggugagagagggcaucccugucuugugccaguuuucaaagggaaugcuuccaguuuuuguccauucaguaugauauuggcuguggguuugucauagauagcucuuauuauuuugagauaugucccaucgauaccuaauuuauugagaauuuuuagcaugaaggguuguugaauuuuuucaaaggccuuuucugcaucuauugagauaaucaugugguuuuugucuuugguucuguuuauaugcuggauuacauuuauugauuuucguauguugaaccagccuugcaucccauggaugaagcccacuugaucaugguggauaagcuuuuugauguguugcuggauucgguuugccaguauuuuacugaggauuuuugcaucaauguucaucaaggauauuggucuaaaauucucuuuuuucguugugucucugccaggcuuugguaucaggaugaugcuggccucauaaaaugaguuagggaggauucccucauuuucuauugauuggaauaguuucagaaggaaugguaccagcuccuccuuguaccuuugguagaauucggcuaugaauccaucugguccuggacuuuuuuugguugguaagcuauuaauuauugccucaauuucagagcccguuauuggucuauucagagauucaacuucuuccugguuuagucuugggagaguguaugugucgaggaauuuauccauuucuucuagauuuucuaguuuauuugcguagagguguuuauaguauucucugaugguaguuuguauuucugugggaucgguggugauauccccuuugucauuuuuuauugugucuauuugauucuucucucuuuucuucuuuauuagucuugcuagcagucuaucaauuuuguugaucuguucaaaaaaccagcuccuggauucauugauuuuuugaaggguuuuuugugucucuauuuccuucaguugugcucugaucuuaguuauuucuugccuucugcuagcuuuugaguguguaugcucuugcuucucuacuucuuuugauugugauguuagggugucaauuuuagaucuuuccugcuuucucuugugggcauuuagugcuauaaauuucccucuacacacugcuuugaaugugucccagagauucugguuuuuugugucuuuguucucguugguuucaaagaacaucuuuauuucugccuucauuucguuauguacccaguaguuauucaggagcagguuguucaguuuccauguaguugagcgguuuugagugaguuucuuaauccugaguucuaguuugauugcacuguggucugagagacagucuguuauaauuucuguucuuuuauauuugcugaggaguguuuuacuuccaacuauguggucaauuuuggaauaggugugguguggugcugaaaagaauguauauucuguugauuugggguguagaguucuguagaugucuauuaggucugcuuggugcagagcugaguucaauuccuggauauccuuguuaacuuucuaucucauugaucugucuaauauugacagugggguguuuaagucucccauuauuauugugugggagucuaagucucuuuguaggucacuaaggacuugcuuuaugaaucugggugcuccuguauugggugcauauauauuuaggauaguuaguucuucuuguugaauugaucccuuuaccauuacauaauggccuucuuugucucuuuugaucuuuguugguuuaaagucuguuuaauccgagacuaggauugcaaccccugccuuuuuuuguuuuccauuggcuugguagaucuuccuccaucccuuuauuuugagccuaugugugucucugcacaugagauggguuuccugaacauagcacacugaugggucuugacucuuuacccaauuugccagucugugccuuuuaauuggagcauuuagcccauuuauauuuaagguuaguauuguuaugugugaauuugauccugucauuaugauguuagcugguuauuuugcucauuaguugaugcaguuucuuccuagccuugauggucuuuacaauuuggcauguuuuugcaguggcugguaccgguuguuccuuuccauguuuagugcuuccuucaggagcucuuuuagggcaggccugguggugacgaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugccgagagaucagcuguuagucugaugggcuucccuuuguggguaaccugaccuuucucucuggcugcccuuaacauuuuuuccuucauuucaacuuuggugaaaucugacaauuaugugucuuggaguugcucuucucgaggaguaucuuuguggcguucucuauuuuuccugaauuugaauguuggccugccuugcuagauuggggaaguucuccuggauaauauccugcagaguguuuuccaacuugguuccauucuccccgucacuuucagguacaccaauuagacguagauuuggucuuuucacauagucccauauuucuuggaggcuuuguucguuucuuuuuauucuuuuuuuaucuaaacuucucuucacgcuucauuucauucauuuugucuuccaucgcugauacccuuucuuccaguugauagcauugguuacugaggcuugugcauucgucacauaguucucgugccaugguuuucacauguacauuuuuaaccucagcuaaaauaucaguaguacucauuuuugcagcuuauaaaacuucuggcuguuaaagcugugucagguugagauacuagugggaaaaaagaugcaaaauagcuaagcuguaucaacaauccaucacuuccauuuauccaguaaacauuugauaucaaccacugaauggccagcuaaaauaaauggaugcucaaaaaguuauugucccucaccacacccaaaaguacugaacuacucacccucaaauuagucauccuucaaaacagcucaaccaucuccuccucuguauagcuuucccugaucccacccuaaacugugggcuccuuaaacgaacugcaucuuauucuuguuucccuaugagcuggcauagugcacagggagggcaaaugcuagcaaucauauaaagaaacccuuuaccacugaacagcuuuaaagagcaaacauuuuuuuagggucaaguauuagcucaguccuuaaugaauaaauaugaacaguaauaagggagagccucagacacuaguaaguuucuaagaaucccuugguuggucaaaggguuucaguuuccauuuugcagaaucaguaaguucaguggauguaaugugcaguauggugacuauaauuaauuauacuguauuguauaauugaaauuugcaaaaggagaucuuacauagucucagcacaaaaacagaaaaaagauaaccaucugaggugauggauauguuaauuagcuugagcguggugaucauuucacaauguauacaaaaauuaaaacaucaccuuguauaccuuaaauaugcauaauuuuuaucuguccauuaucuucaauaaagaugagagggggacauucaagaaaaacaagaaauccuggagauuuacaagagauauaaucuauucuuaugcugugagauccuucuggucacauguaguuuagucugauuuauuggaugugugaacucacuugggcaaaaaagaaaggaggaagaaaugaaaugugcucucuacaauguauuagagauuuccaccuucuuauuugaaagauauuccuguaaaauggaaaaauauauuuguaauuauauuaaaggacgugaaacuuuuuguagaaauuguuucauuuaaaaagccaauauaggcuaggugugguggcucacgccuguaaucccagcacuugggaggccgaggcagguggaucaccugaggucgggaguucgagaccagccuggccaacauggcaaaacacugucucuacuaaaaauacaaaaauuagcugggcgugguggcggaugccuguaaucccagcuaccugggaggcugagguaggagaauugcuugaaccugggagguagagguugcagugagccgagaucgcgccacugcacuccagccugggugacaagagcgaaacuccgucucaaaaaaauaaauaaauaaaaagccaguauagauuauuuuguuuuuaaacacaaucuaaauauuauauuaaggcucauggauaucaucauggaagaagcauuagaacaaacuuguuaaagagaguacuuuuauaaauagcccauaauaaaccauaguuaggauucuuauuuggggauucuaauuuauaauuaauuuuaaaagauuaggagaaaugacucuagaugaugagauucuaguguaugaaucauccaaaaaaugguucuaaaacaacacaauucucacuggcaacagaugaccaucaagagucuuaaugagccaguucaugugaugucaagcccuuacuuuauauaaaucuauggagaaccaagaggaaaauuuaauaaguuauuguuugggacuagauuuaugcaaugaauaguaguauucaaaauaaagcaagguuaagacacaaaugauauaaaguuuuuuauuucucuaagguucacauuuguagagcuuuucaaacacauuuuuagucagacuucuuuaucacugaaaacgucugcuaugguuugaauguauaggucccuccaaaauucauguggaaauuuaaaccccaccuaugaagagguggggucuuuucagggugauuaggccaugagagcuuugccuuuaucaaugagauuaaugagauuaaugagaugaucaaugagauuaaugcccuuacaauaaaggcuuugggagaauugccuggcccuuccauauggcucuucugccacgugaggacacagcaacaaggcacaaucuugcaagcagagaucccucaccagauaucaaggcuuggucuuggauuucccagccuccagaaccaucagaaguaaauuucuauuguauaaacaauauauaaauauugcccaguccauggcauuuuguuauagcagcacaaacgaauuagauaaugucucaacucuccaaggcuuugacaaugggcauuccuaggucuguucuuggcuguuacuuacuagcugugugguucuguucaccucucaaagccuccauuuucucucacuccaugucccaaguuucuugcuuaccuucaggccuccacacucucucccccuucaagccuuuucugaccaccucuuaaacaugcuuuaggccugaguugagacauuuagcuccauaaacauuuaccuuguuauccauuucuaccucuaaucuggguuagguaccccuccuaugugggauaaaaacauccuguacuuuccccaucacaguacuucucagauugucauuaaaugccuacagauuugucuuuccuccuccauuguucuauaagcuucaugagggaaggacuucuccaggcaaacuuugacagugccuggcacuuagcaggcacucaauaaacauuugugaaauaaaagugcucggaaucauucaugaauggcuucugucaauggaaaucuauccaucaacucagguuagaaagaacuuuauacacuuggcuaacacagagggucaauaugagaaacccauuuaagaaaaauaaugguugcacacauuaaccauuaugcuauugaaugcccuacuacaucaggcgucaagggauaauuccucuuugacaaggaaacauuuauaucucuagagagauaaaauucuuguaucagauaaugaaaauuacacaacccacuaaaagguaagaucucauuucaguaacuacuguaauaaacuuaucucagaugcuuggucacaucuaauucucugugcuuuucaauuuuuugucacaauuaacuucugcuggaauuuuuauacauuauuugucuuugucuucaaaagaccaagaagugcucugaaaaaaugagucaaguucagauuuuauuugcccacauucugcauugggguggauacccgcaaagggucuccuuuuauccaccagucaagaaauagucuccugacucacuagagaugucuuuuauauccuagguaagauaaacaguguaauaugaucccaucaacaauuaaauucuuuugauuuugcuacaaauucuuaguugccauacuuuuuauucuccugcuaaagacuguagccacaggguccucuuuucugggcaaucccaguuuucucaucucccagaaccuagaaaaucuaaaucuggcuccuguggcccuccucauuucucuagccuggugcuuaaucucccugggucccagucacucacaauaauuauuguuaauaggcaagcagggguaggggcaggcagagggcaaacauccauugaauuucaccacccaagaguuaugcuggauuuuguucaucuaugaaaaucaagaaucaguauauaaguaucaaugguuugguugugauuuuauuuuuaauaaucuuguuauguuuaauugugcaagucauucucaaaccauuuugaaaguagguugcauagacacccuaaguaaauagaaccagaaucuacuaaaauuuagacaauauuucuuuuauuguauauguuuucaagauuuucuggaccugaucuaccagcauaaagaugagucaucaaaagcaaaugauaauacccaaggcauucaauauggguugacucagaccagaaaugucugaucacccugaucagagaaaauauggcaacaaaaagaguuaccuggcacucuagaauuaaaaaguuuagaagcagacaggaaaggguggcuucaggagagaaaaauccauagcaacucauuccuaccagcacuagaaagcuuagaauacuaucaggccucuaggacauauacaaugcaauauuugacuacaucauauugcacacagcacaguggcaaucaauauuuacagcaacuuuggggauaccugccucuuaagauucuuuaucaucacacacuuuuucaaaacuaccaaaacaguuccaaucauccuaaaguaccuaaaugcaaaagaaaccacaauuucucaaaacagcacuugaaaaucauaguauaagggacaaacaguuuuacccauuaacaagcagcacuuaaugcugaaugucucacugcaauaggugagcaauaagugaauuagaacgguguauuaguuugcuaaggaugccacaaaguaccacagacugguaguuuaaccaacagaaauguauuuccucacaguucggaaggcuagaaguccaagaucaaggugucagcagggcugguuuuauucacagggcucucuccuuggcuugcagacagccgccguccaucucacugugucuucacauggucuuuccuccaacacacuagugucuguguccaaacuuucucuuuucaugacaauaguaauauuaaauuaagggccacccaaaagauuucauuuuaacuuaauuaccuuuuuaaagacuucauuccaaauauaguuacauucuuagguacuagggguuagaacuucaacguacgaaugcagagugggagacacacagagcauaacagaugguucuacucaacaaacagcauuauuuucaauccuauuugggaccuuccguguuuuccucauauaguuacaaauugaccaaaauaauuccacucuuuuucucacuuaaugugaacagauaugcaaucaucagaauuagguucagcucacuugcaaauugguaguccagugcugugaccacagcagccacggugaaggagacuccaagcagacagcccaugcuggagucccugcaugugacugaaucucgccagcccgcauguuacucagcaguaaaauggggauaaucacaucuuccucacaggguuaucaaaggaacuuaaauaggagacuauggguacacauagggcuuggcacagugucuaucaccauaauagaaagccuuccuucugcagaucucuugaaacugggaaguaaagcauuuaaccuucgaguuagcagcaucauaaaccccgagacuccugaaauggaaagcaauguucacauagucuccucuaauuccuucggacuaaggcccagagugugugaccagcucucugaagcagaggugaaauuggaagucuugacuccaaauuccuaaggccagugccuucccugauucccucucucagauguguaagagaaaugacagcagugagcaugaugggcugcuaguuggagagaaaaaggccagcaaugacacaaaaggccugccaaucuggauucaggaaucacaaaaauuuagaaaccaagacguaagacagcaacaccacagcucaggcugguauaggucaaggugccucaagcuguccccagccacagcuccugacuccuguccuggucuuacucgaccacaagagaaaaaugaggcaggaggccuguuucuucuccacauguuccuucuuacaaccauauuuaaguucaaucuccaaauccgcagagcugaaaaaaacauuuagccaaauaaagcugaauaucccccuuaggauccagggacucccaccaggcaguuugccuucuguuugcagcuugguaauucagguucuuuaagagagggggccucaccaguccugacucaccccaggaguuuggugcuuuugggcuuccacaccucugccugccacuuccuguggagucugcgucuuucuccuucccacaccuuucaaagucuaaagcaccugcuaugggcuccacugggcccugccacuaugcccuuggcauucacuuccacacacugaaggcagcugacuggaacugccugagacccugggccugagggcuuuguacucuacccaggaggagguaguaaaguguuacugccccaagaaacagacuucagccaacaacagccuggcaguuaguggacaaaacucuagcucccugccucuaggugggauaacucucuggcaugaguccacagacucccagagcucucagugagaaucccagcugcccagaggaguaaacagcuugagaacucacccuuuccuagcuccucccuccuugucucagggucugcuaccaggggacccaaaaccaaggcagccuccuguaggagucccauggaaucccaccuuccccagaaaaccuucccucaucaccaagaucucucaagucacuuucuaucauguuuuaacacuauucguguacacuguaaucucauuucucuaccacaggcucuugaagacgagaaauucuuucauacagcucugaauucccccguguugcucagcacagugucuuacgcaaacgagaagcucaauaaauguuuguugacugaaugaagaaugaauuaaccaugucagucagcaagaagguugggcucuguauuuaagcuaacugaaacuauaucaguguagcugucugcuucuuuccaaaacacagcgugaacugcuuuuaacgagcaaaguacugccugcauguauuucuuuaaaucagcauuuucuagauauucaucuuaaaucaaacaccucugauucccagaaaaucagaauaaagauuguuuuccuaaauccgaaacuaccuuacucuccaaguuuugggucuacuccucaguuuuuggagucagccacccaauguggaugucuuacacugauuucacccggaguucucccugggcaucauucaagaugaauguacaaagacaugucacaucaccacacucucucgcuggaguagcguucuauuaagaaggaacauaaugcugccuuuuuaaccaagaaggcauuacccuugaugcauccuaagaauucuuuccucucugcaucgggcaggggcuaaaagaagcacagggauuucacuucacaauaaacaggacagcaugcugaggaccuggguguucaccucggaccagucagauggccuggaaacuuaaauacccacauauacgcaauagccugcaagucgugucauguucuuuaauggaugucuggugagcagcucugggaaaacuggacaaguaccaagugucucgcgagcaugcuuucaacucaauggaaguauguuaucugaauucccagugcucacuaccuugagcaccuaucaacccagggccuaccaaauugucuccauuuuuuuuucuucagccgacuuugaagagagaaaagauuacauaguggaccccucccuucucacuuacuaaagucagaaaaagacugacugaagccaaagggaagacaagcagcauuucuuaugaccugagcugcucucaccagaucauaaguuccaugagaucaaugccucuucuccucaauguagaaucccccaacaucucagcgcagugacugccucacggagguaauaauaauucauugucaacaaacacgugcaagcaccacauguuaucucaucuaauccuugcaacaaccuacagcuucggaaggaaacuaaagcuuaagaagcuuagaauauauccaaauaaugguauauuacucagcuacaacauggaugaaccucaaaacauuaugcuaaguaaaagaggucagucacaaaaggcugcauaucguaugaaauguccaggacgcgaaugcauggagacagaauguagauuagcggucaccaggggccuaaggaagaagggaauggggagugacugcuaauggguacaggguuucuuggggaugaugaaaacguucuagaauuagauuguggugauaacugcaaaauuuugugaauguaauuuuaaaacacugaaugguaaacuuuagaaaagugaguuuuaugauaggugaugacggucgugguggaggugguagaagagaaggaggaggaggaggaaaaggagaaagaggaggaagaggaaaaaugaagaaaaggaagaaguuaagaagcuugcccaagaucaaagaguuacccaugcuuucaaccauugugccacucuaaucaugguuauucucaguaaacauuugcugaaaacaccagcaaauauaauuauggguaauauaggcuuuggcauaauucugaucacacacagagaagagacaaucaauccucagaccuucugagacuuccaaggacugauaaacauuaagaauuguugcucuaacaucaaucauaccucaauaaaguggauaauaaaaaucaaaauaaaaaauaucuaaaaugcuuguuugacacuaaaaaaaaaaaaggaaagacaagaaacguuacccuagugaucuuuucaaaaucuucuguaaccuggaauaacggcuauuuuagaggaaacacuaaacaaaauuuuaaaagaggagcacccugagaggaguguaauuaaaggaccucuaaggccauaacuaagaccuuuggggcuaaauaaaauagaaaucugaccaugucucuuccaugcuuacugccauccaauggcuucagacccacacuccucaccauggaccacaguccuucaucgccugacugcacagcugcuuccucucugaucucgucuccucguucucccacuauccccugcccugcacugcauaauggccucugcccuucuugaacaucccacauccuccuuagcucuggcugucuugcugucccagcugugcagaacccucagccuuccagcaacguguuguggcuccucuuugacaaccagggcucagcucagguucccuccucagauaggccuucuugcuucuucugaccaucuaaaucaugcuggacaccccaccuccagucccucuccauccuauaugucuuuaugugguggcccacuguuugccuccuccucuggaaugaagcucuaaaagggaaggcacaagucuugucuaucuuauucucagcaacaucagcaccuauaacagccagaggcacauagcagaugcucacucaacauuugcugaacaaaugaauaaaacacacagcacugccaugagaugccuccacaagccagaugcaaaccaggcucuccucucaggaacuccugucagguuaguccucacaagcugggcuucugggccuggugaggucaccaacucugaagauucuauggucaccaccuggauuaacuuaugguaacaccuuuaugugcucauuccuccacacccugagcccacauacuuaccagacaccuuucccuccuuugauaacuuaacaccucugucuguaauguagcaaugaucauccuauaguggaaaugaggucccucuuuccucagaagcucuuuuggguccucuauuacugacuuaaacauucuccugacucucuaccuuuauucuaacacauaucaaacuuuuugguuaaucccagacagaaguaaucuaaacuagagcccacccccagcaacacaucucauguucuaacacaguucccucauuuccaguucaucaugccagccuugcacacucagguugcacucagaaagcucaggacagcaugggggauguauuacauuaguccauucucaugcugcucauaaagacauaccugagacuagguaauuuauaaagaaaaaaagcuuuaauggacucauaguuccauauggcuggggaugccuuauaauuauggcagaaggugaaggaggagcaaaggcaugucuuacauggcggcaggcaagagagcaugugcaggguaacugaccuucauaaaaccaucagaucucgugagacuuauucauuaucacaagaacagcaggggaaaaacccgcccccaugauucaguuaccucccacuggggcccucccaugacacauggggauuaugaaagcuacaauucaaaguaagauuuggguagggacacagccaaaccauaucaagggagauagcacuugagugcagcucucauggccucucucucacugcaguuaguuuucccuucagagaccuccauuuguccccaguucauagccuccucuugaccucaucucccuucuaacccagacuggauccugauacuuaacuaugcaaguuauucaugaguauucaaagagcuuugccuacacuguucuuauucugugcuaccacagagauugagcccuggguccacacuacagucugccuccuucauucacacucugcagugacaaagcacuccaauuuuuaaaaauaauacaaauaaaauauaaaaaacaacaccagaaagaaauacacaaagacuaacacauagcacaugauuucuaaugaagguugcucaaaaauucuugcauuugaccuugaugggcuuccucacucauucuucccagcaauuuugucauuuuccucaagccccaacccaaccucccucuccaucccaaccccuacaguagauaacuucagaaauguguuucuucaacuccauccccucaccugcaagucaaucuccaucugcacacacccuacagcuucacaccagugcaggacaaccugucuuuaccgguucaaaacuaaguucugcccuugggcuuugaucucauucccuucagucucuacccagcucuugcccuauagauaucuccucucuccuuucugcaucuucaaccucccacucuuaucagcuccgucucucaguccaccaaacuugcucuguuaacuugcucugccaacuugcucugucaucauuaaaaagcccugccuugaucccaaugucuucugcucucuuuucuucucauccaaaccuccucaauggauauuugcugccuccacaucaucuccucucauucacucccagccuacuguaacccgguuucuguccccucucauuuccuccaccccagaguuucauugaaacugcugcuuuccaaccaccggugacugcucaaauggcaaauccaaagggcaaauuuugccucuuaccucauuagauuauuccacagcaugugccaguagauggcucuacugcagaugacacuguaaaucacaccuucccauuuugaaacucuguuuaaucauucuccugauuguccuauuucuccaaucacuccuucucaauuuccuucaugggugccuccucuucuccccuccucuuaccugucuucucagcuucugucuccuuacucuaccuacccucccucgguaaccucauucacagccauguuggucauuaacauuuauauaaaaauaccuaccaagucuacuaucucuagcucccaucucuccccugagguuauauccagcuaccuccuagacauggccacauguaugucccaaagccccucaaaucuaucaugucucuucugaugccacauucucuucccuucaccauuuaaccuguuuguucccugguacugcccauuucagcuagacaucacccucaaaccaaccaaccaaucgagguaccucuguuggcuuuaacuauccucucugccuuguuauccacauggagcaauccuaauaauuuuuaucaacugcagauuuauugaaaguauucccucuccacgccucuuagcacuuccugagaacaggaccucuguuuauuccccugacuugauuuuucagucuaggggauaauggcccagcacugacacgugaaauaccagaacuuccaugagcugagcugucccuaggcuuaccucucccaacucaucuuccucgucucaaucuugucauuuaugaggaaggucaacaaaaggcucaugcuccucuaacaugccacacugcaacguggccuugccucuucagauauacuaucucacaugccuagaacacacuucaagauuuagcucaagcaucaccuuucccaagacgccuuuucacacuccuccagccugagagcugccacuccuuggugcuaccauaacauuccauuuuaaccuccagcauauuucauacucuucuaaaauuacguacuugucuaucaaccuucccccaaguagacucuaaauuccucaagucagggacugcucauaauaggugcucaaccugauuccuuugcaugcuaaauguuacugauaacuucuggcacauuuccagaccucuaaguacccuggccaucccauaugacccuuucucugccauguacuaauugacugggaggcucugcuauggcugagauauuuuauugcucaaaacacacagcaggguugguugcgaucaucucgcuacaguuugaaaugauggucuccaccgcaguaagaguuaaaggaauugaggacuuacacuaaaauuagcucuaucuugccacucaacauaguguaagauuuggcaagacaagucccuuaggcagacaaacugcugacacagcauggugaaacggaacucaaccaaagaggaaaaccugcaauaccuuuacauaggcaauucugaguucugcugauucauucugacuuaaagcugcaauaacacuugguaaggaacacccaagcugacuuugcauuuuuuucugcagagcucacagaauuuggcauacaaaaaauuuaauaguuguucuuuauaauucuuugcaauuucucaaauauugguuguggucacuuacauuauaguguuugauagcauuaacagguauuuuucuugcaaagaugcaguccugaucaaaauacugacaaaagcuuaaaauacugacuauaauuucuguaacucaagaaaaccacauagaaaaucucuuucaccaaagaaaggcucacugcuagaucuauuugaggcugaagagccuuaguuaagucaacagcucuuguucacacuuuguacaaagacaucuguacaacugauuugaacuuaggaaacagcauuuaaauaucaacaaacacaugcucagagacaaucggguaaauuuucaucaggaccaaaauuucuaagaaaccauauuagagcaaauuauaaagcaaagaaucuucucaaaauagguauuugcaagucaucacuuacucuguucuucccacagaagucaugcgaauugcauuauaaagaguaaauggaagaaauuucuagacuguagucaaauuauacuugaaucaguaaauuuaucaugcuucuuauauauagugaugauuauaauuaacauuuaauuaacuggauuacuucaaauauuuauuccauuuaaaauuauaauauguaagugcuggguuugagaugcuuaacauguuaaauaucuuuuauuucggaaaaaaauauauaauucaccauucagaauuuuauacuuuacaugcucuauaauaaucugcuagaaaauaguuguuaaacaacagacauuauuuugacuaaaccgauauuauaaaaacaaagcuuuauugcaccugcuucuuaagaagauuaugucuaaauacucacuuguucaguaugaggucaagaaugaauuuggagccgaaggcuucaaucuggaagcuugccugggccagauggacagccuauggauucaaaaagacagaagaaccuuaacuuacuuuccugucuuuaagacagauuauuaucaagaaugauauuuaagacgaauaacuuuuauguaucaguucauuuccuuauguaucaucauauagcaauucauuucuuuaggagacuagauacaauaucaugguuuugcuaggaaaaucuaaauauuuggguagcaaagagcuaauaagacaacacauccuugaaaaugaacccacuaagauaaaaaccaacagcauauucugcuggacuuacaaagugaccgugacgaauuaugcaaaagucugacuaauuaaagcuugauuucagcccguuuugugcauaaagcuaaacaacucuuucugcacaccuaagugaaaaaucaugucagugcucugcucuucagcaggaauuagaacuuucuuggaacguucucuaaaugauguaucagcagaauaugacaguaaaaugggagaguacaaccuuguaacuucagaaagcacuuagaaccuggccuuuugugaauacugagagcuuaugucccccuuuaagagucauauguuuauaaauauugucauuauuuugucuuaauucaaacuacaaagauaauuccaucuaaacaugaauccuauuuacuagauguuaaagauuauuauagcucacagaagcaucuugaauauugcaaauuaacaaaucaauaaaguuuugucaaaguauuagcuaacauaaaacucuccuuugucacacuaucaggaaaaaaaaaaaaaaagaacaaggcuaaaugaaacaccuacacuguacuuccuugacucacuaacguccuuccuccagaauugcauuccuaaggcacagugggugcugcaaaucaucugugaagugcuucaugcaugguaacuggacaccagcaugaacacaccaggcaucucccucccaguacuuucuauucccuccuuccccccaauacuaccccaugcuccucuuugccuucccuguauuuaugaugauugaaacucuccccauccuucaaaggcgucccaccugcaaugcuuuucaugaagucuuucuucacacagucuucacguucagggcuuuggaagcacuuuauuugugcuucccugucucucccuuucccaucccuccccugggugguaagcuccacaacauauaucacaggggucuugcaaacaggucuagauuaaugacucuuccccagcauaucugaccuuccaaguaauucaccaaauauucauugucaagaucuuuuugccauaccaaacccauaaaacacuauaaauaaaccaugacuuauacuuucagucaagcacacugccaaaucagauagucacucaauaauaauccauaaaauguaaaaaggaaauuaacaaauauuaaauuuuaaauacagaacaaugagaaacaaggcuccuaaauccuuaaugccauaggacaccaagucaaauuccaaacaaccuucuagaacagggucaccauacuugugggcuuccuguauccauacaacuaugagugagagagagagagaaagagagagagagagagaaacuucugucaaguguggucucuguuauccacaacagaaccucuauucaauacaaauauccacuagucuucaaauucauucuguaccuugaagcauuaauuuuugcauaaagauauuuauauugaugaauaauuuguacaaggagagauuuuucagcucuagaucaaaaaagcuuuaaguauguaaaauuuacuuccuaagaauaagauaaauccuuaaguauaguuucucuuaagaauauuauacaguagagaugaguucauuaguggcacccuggucuaaaagagcugauaaauauaccuccuugaacaucuuuauaaacacuaagaagaacuugacagagacucaguaaaaggcuuauuuuauagcaaauaagugaugugacaaguacaaacacugacaacacucuugcaaaauaagguaaucuggugguaaauguaguaccuucauuuuacagaauuguaggaguuacacaauuugauaauugcuagaauagguuuauaccaagucaaugugacuagcuucaguuuaauagaauuuaaucaaagagcuaguaaaucauacuggguuuuccuuuugcuuuugcauucaaucauuccacacaaacauauuaaguccugcuuugcauauaaagauagcugggacacagcuuccgcccucuaagaagugauggucuccagaggggcagguacaacugucagccucagcuugucuaaugggccacagggaccauggcugaaccccauccaggcacagagaggugcagaaaggauccacugacaaggugcuauuugaacaacaacucaaaagaugaauaagaauccacgugucagagaaagaaaagacacucaaggcauggaggaaaacauuuauaaaaaucgagucaaaaugaaugugagaaaaauaagcuuuuuaaauuuuuuaaaaaaugaauauggccuguaggaaaaugguuuucagaugaaaugucaaacaaugaaucugaaaaggugggauggagacuggcaggcuucacgugacaugaucagugacauuuaugaucgcaaacaagaacauguggccaagacaaugagccuucuccuaaauggccacucccucaaacucacucagcaccauuucuggcacacgccaucaucaucaucaucaucaucaucaucaucaucauaucauuaugauucaaacaucuuaacagauuacucuccagaacugaagcaauuuaucaugccagcaacaagauaucuguuuauccauaggaaaaaaaaaaccugauuuuauuaccuuuaucaguaagaauguuuuaauauuuuaauucuaagaggaagcacauuuucuauaaaaugauuuaagauuuccucaccauauucaucuucuuugucaauguaucaaauggaauuaguuucaucuaauacauuuauauccauuuuaagucauuuaaauauauugauguauguuauuuugcuuacauucuguuucucuuuccauugcuauacauucugcaagugcuuagacaguacagauucuucucuauaccaaaauaaauaccugacaagugcuacuuuucccuaucauuuuauuucugcccugucuuagacacaauuaaaauaguguuuaacuucuggaugcuaugcaguccauuucaauuugucacuuuuucuuuaacaaaauauuacacaguuuuuauauaugcccauuuuaaauguuuucaaaucauguaaagugagucauuauuuuauaaaccacauuguuguuuuauauauauauauauauauauauauuuuuuuuuuuuuuuuuuaacagaauauuggcuugcuucuuccaaaugguagaaaaguuagaagaauggcugggaugaguacaaagucuuacaauauacagccauaucauuuuuaguugauuuaacagauuuuagagauaaugaacugaccagcaucacugaaauccauuaaaaauacaaagacuaccuacaguauuguucuucuuuuacaaaggaacuauacagugagguuuagaaauguguucaguaauacaaaaucagauccuaggaaugcuucagagaagaguucaugaaccacauauuaggucauaaucaguuauuuucucuuucgggauaucuguuaaacagccuugcuuuuauaaggacauucacuauaauagcacuggggaagaaugcaggguuuuauagccaaagaacaucauuucacaacaagaaugagcaugucccugggcucagaauuaccacccugaaggacugagaacagcugcugccuaaccacuuuaguauuuuucuuuuaacucagaaucuggcacagggaaauuacaggagcucugaaaagaaaaacaauuaaacucaauuauauacacaaaccuccuucacuggagaacaguuuacacgucuuagcaaugugcuuuuguuuuuauuuuuucuuucuaguggauggcaucuaaugguauauuaaauaacuuuaagaaagcuauuggguucuucggcuaagacuuguuucucaccuuaucaucaagcaauguuaugacauuaagcaaucauacaugcucaacucuguguaggguacauuaaauaggcucaauagauacuauuguguuuucuugggacuuauauucuagaauagcuaauauagacauaaaaacaagaagaaaaauaacucuauaucuaaucauaaaaauaaaaggcagccauuugcaggauauacauguuuucaugcaacuauguuucacacauaauagguguucaaacaguauucuucacuacuuggcaagaauuugugaguucuguagagcguacccauaacuggaacugaaaaugggaaauaacauuuucccagaauucaaaaaauaucauaaggcugaauuucuacuaaauuguaaaauuuaguagaaauugagcaacuuggguaacugagugccuacacuauggaucaucacaucuucugagacauauauuucaccuuaguaugcucuaaaccagugguccccaaccuuuuuggcaccaggguccaguuucacggaagauaauuuuuccacggaugggguggagugggggaugguuucaggaugaaacuguuccacuucagaucaucaggcauuagauucucauaaggaguaugcaaccuagauccaucgcacgugcaguucacaauaggggucaugcuccuaugagacucuaaugccacugcugaucugacaggagguggaacucaggcaguaaugcucacucacccaccacucaccuccuacuguguggcccaguuccuaaccggccacagccugauaucaaugugaccuggaaguuggggaccccugcucuaaacuauagguggugugagaaacauaacagaauuuggaagugguuuccugaucuuaagauauauucaguuuauuuagggagauauucauuuaaguaaugaacgaaacaugcccaaaguggaauaucaauagacaagaaaauguuuuacaaacagagguaagaagcccuuuaggguaucaagcaggccuaagcaaacaccaguggaaugauucacauucaacuucguaaagaagagggcuacaggucucggcuucaggaaagagggcauuagagaccgcaaaagucaguaagcagaugccugucuucucuguuuauucuaacauagaaaaaacaauguuuauucuaugucuguuaaaacacugaauacagcagcuacacuguauacaugugacaggugugugaguguguguguguaaccauaaccuuuucaggaaguauuuuauuuccuuuaucuuguugcauacgguucuuuuccuuaccuuuacaguuuuucaauagacccuucaagaguuuccacuccauuaucuucaaauaugguggagaaaggucauagaauauaaaacaucaccuuuuuuugagauucaggacauuuuauaauguuucagagaaggcagauuugaaaauucaccaacuaacaagaugggaggaggaaaauucgcuaauuugaugcuagagggacccugccuuugucaucauggguugagcugcugagaacaagaguccacuucaccaggaagacuuucaucagcguggcuguuugguauguuuuucuuuucauacgaaaacaguaggcacagaauccagcaucccagauaauuaaauaucaaugagaauaaaaugucaacuuuaaauugaaauaaguuugaggaaaagaagucacuucuuuucaaucacagagguuuuucuaaagaggacuaguuuggaccuauccuguagcuagagaaacaugaaaguccagcuugugaaucuuuuucuguauaaugcaaaaauccaaauauguaaauauaucuuaaaaguuuugaaguccaaaagaaaauaucaacagaccauuuuuaauuguaauuuuguucuaaucccucauucuaaauugauacacuggugauugcacagguuuguguuaugauaaaaauaauaaugccucacauuucuuacauuuuaaucaucucaaaguacugucaugucuaucuagaacacagcaccccaugcaauugguacagcagacauuuuuauuacccuuuuauagaaaagaaacuuuuuuaaagggcagagagagauuaacuaauguuauuguccaaggucauagaucaaaggaagaaacaugagguguuaguuuuaguuaaaugacaaaaaagugccauacuuaugccagaaguccuuacaucugcaagccucaauguuuuccggucaauaaaauacaaauaauaauagcuuaacaacaugaugugugcgaggauuaaauaauacaauaaugcaacugacggccaggcgcaguggcucaugccuguaaucccaacacuuugagaggcuaaggcaggaggaucgcuugaagccaggaguucaagaccaggcugggcaacauggugaaacccugccucuaugaaaaauacaaaaauuagccaggcaugguggugcaugccucuagucccagcuacucaggaggcuggggcaggagaaucaccugagcccagguguuugaggcugcaguuagccaagaucaugccacugcacucagucugggugacagaaugagacccauucucaaagaaaauagcaauaauaauaaugugaccaauguagcucagccacagugaaaaagcucagucauuuaggaaggagacaguaaaguaggaaaaagagaaaaaagaauacaguaacauuuuggaaggguaucaaucaaccccacccuaaaguucccucccaggauaguuagccaccaucuagcaaauuccaaugugcauuuacacucagcaaaauuugcaaauuuuguauuuuuauugcuaauuaccauuauguauuaugcuuugaccuuguucaaguugucaugucuucaaaauaauaugaaucauuuuccacagaagugaaacagcugcaaaugcuacaugaaggcgguucugcaaauuaggguaauuugcugaacauucuugccaugaugcauuuaaacagguaguuugaaggagaaaaauauuaucauguuuucuucuaccauguuccaauugauaguauuaugggcuaaccagcaacaauuuguauuaaauaccuaccuuauguaagauacuagagcagauuaguauaggagaguuaguuuuguuuuucugguuuuuuuuuuuuguuuuuuuuuuuuugagacagggucucacucuguugcccaaguugguguggaguggugcaaucacaacucacugcagccuugaccuccuagcugaagcaauccucccaccucagccucccaaauagcugggaccacagguacaugccacugcucucagcuaauauuuuuauuuauuuuuucauagagauggggucgcaccaugcuguccaggcuggucacaaacuccuaggcucaacaauucacccgccuugaucucccaaaaagugcugggauuauaggugugagcuaccaugccuggccgagaauuaacacuuagaucaaaaagauuauaauaugguuaaggaaaucaaaugaguaacugaaaagagugaaaaauauaauaugucaauuaaauaagaaucguuauuguuguuguuguuguuguuauuauuauuauuauuauuauuauuauuuuagagaugggucucacuguguugccccagcuggucuugaacuccuggccuccucaagcaauccucccaucuuagccacccaaaaugcugagauuacaggugugagccacuaccccuggcauaaauauuauuuguaaagauaccacacacaauauaagcaugauuaauuaccaaauuuggaguaagggcaacaagcgcauuugaauuuguggagugagucugcugggggcuggagagagcugagaauggcuuaugaggaagacuuucuccgcauuuaaagaaagaauucagacagcucuucuaggauuuauuuaauagaaugaaauuauaaaguguuaauaaguauuugcuaacaaauaaaugcuuaagaaacaugcuuuuaaaguaaaacacaagaugccuuccauucuggaguguuauacugcaauguggauuguggugugaguuaaacaugacaguuuaucauaaaauaaagcauuuuacaagaaugacaaguaggggggaaacauacaugcccgaaaaaugcccgaaaacauacaugcccgaaaauguuaaucaaucuaucuuuuggccuuaaauuaggaagcuuaagucauaccguuugaaggcuauuacagaaacaagaccaaagcaucaacaaagcacacucuucucacaacccacgaugaacaucuccuacuuaaaggaagcagaucaccgugugacuuuguucucugugccaaccuagccgaaaaagauggaacuucuacucuaaaagaaaucuagccaauauucgauuaugcgaucugaugguacagaaaaaaggaaagcuuggauuuauggauuugucaauuuuaacuucugaccaaaucuuauacaagagcucuuuucuaaauaaaucaauuuuaaagagauuccaaauucaucuuccucucuuuucuuauguaccucaguuugagguacucuuuuuuuuuuuuuccccugagauggagucucgcuuugucauccaggcuggagcacagugacaugaucucagcaccacaaccuccgccuccuggguucaagcaauucucgugccucagccucccaaguagcugggacuacaggugugcgccaauacacccagcuaauuuuuguuuuuuuuuuaguaaagacaggguuucaccauauuggccaggcuagucuugaacuccugaccucaagugauccacccaccucggccucccaagguacugggauuacaggcaugagccacuucgcccagccgaaguacucuuaaauaugcaaaagauggacgcugaagagaaagaggaaguaggcacugauaauccaaauacauauuccagucaaucacauuagccacacuaaauauuucuuuuuaaaauucuucauggccagccaaagaagagaagcuacauuuaaucuuaugguggguaugggggaggucaaacuaagauuuucccuagugauuauuuagcaacccuggaggacucuguaacaauacacuuucacugacaaagcauccuuggacauguauaugaaacgucuucuauacauuuacuguuagugauuaauguuugcuggauauuaaacuggcaaugccaacuaaggagaaagacugaauuacaagccuuuggagcacuugcuauuuaaaauggguaaagcagcacaaguaucacuacagcaguauuauuucacuuucauauauuuuuugaaagaugaguaaaaauacaacuaugacaacaguuaccauggaagcuucuugguaacugccuuccugaauaguaacauuuaauguggugcauuaaucuaguagcugaggugugauucaccuuguucuuuuuccucgucaauuccuacaucaccaaacugcacaacuccaaggaacacuucucucucugcuaacacuugugucauaaagcaagaacauauuuugucuuucuagccagaauuauugaacacccacuaaauaauuuaaauaaaagaauggaaauaaaauauaaguuuuggaaagcaagacaccaagcaccaugcuuagugucugugacucauuacauggcaguuuuuuaaauuugcuuauauaaugugaauacuauucuaaaagaaaaaaaaagccucaugugaggcaacccuccuuaaggaguccuacuucccuagucugccuacucugguccuuggaauuuugacuauaacaauccaguggacucaugucaaugcaaauaucaauccaaggcaauagaagguucuuuaacuugagucuuuaugaugacuacacaaggauucguuaagaaugagaaauucugaaauacaaaaugaaaauuaugguacaguaauuauacaguucauuuuagcauuguucuaccuagcaaaccauaaaugauauagaguagauucaaauauuaaccuccaauucucccucacuaauaaauuacugaaaacauguaaucaaagaaggcugagcagaccuguccaggccagagcucucuucuccugaaauaccucgauucacugauccuuguugauagguuucauacuguuucuacccagugauuuauguugggaucucuauaccagagcugauauuuccauuugcagaauuuuucaggcucugcuuaugagacugcucaaaguucauguuaaauauacagcuguuugacaaugauauuccuaaguggucuuugcuuuccuugacuacccucagcaaguugcacauuacuggggcagagaucccuuuuaucuacagagaacuacagcuacagauuaggaaaaguucaguguucucugguccucagccaugucuggcucuguccuuugcacugaauucugaccucaucuacgacuauggauggguuguauucuaccccuuuggaugaaaagaguaacuuucacauugggagucaugccaaaaauggauuucuccauuuuacaaaaaugcaggugccaguagacuuccuaaguaacaugauuaaggccuguuccucaacauagaggcccacaacuguccuguuucacaauuuuacucaaaacaaauguguacuacacauacuuuacccaaagcuagauguagaaaagcuaauauugauacgugaccucauguucucuaauaucgaacuuccacagagcucuggaaacgaucaaccacucaaccuguauuugcacaauuuuuaaaacuaacauuuagaauacugaccacuaugcagaaucuccuauuuucauacgcaaaugauaggucucaccacguccauguaauguuuuaggccuauuaaaacuccauuuuuuuuucuaaaugugaaccuagaaaauuagauggagccuugaagacauauagaaauaaaaauagaauaugucuauuauguaucugaggaauauaucuauuuccucagauuauauauuaccuuguuggcuucuacaucauacaugaaaucauuuacucauuaagcaaauaaucacgugugucuaccacauuucaagcagaagcccuggccuuccaggguuuacauuuuaggguguguguuuugugggggauggcuaauacaaccaacaauauaaaguaaguuagauagugaugagugauauagguaaaaagauuaaaguagacaagagucaaaauaaguuagggaguuuuuagaagaaagaggugauaguuuuaaauaggauggucaaagaaggagucuuugaaaagcugauauuugagcaaagacuaggugaaggugcaagucauguaaauaccuaaggaaagagaaucccagacagagggaacagcuaguuguagaagccccgaggcaggggcacacuugguguauucaaagaauagcaauaaaaaggccagugugggucaaguggagggagacuagaggaguugugcaggcaauagucacagaaccaaugaggcgucaauuguguagcaccuugugggccacuguaugaacucugccuuuuauucugaaugaaauaguaauuugcugagaauuuugagugaggaaugauaugaucagguuuccauuuuuuaaaauucacuggaagcuauugugcggacuaugcacuaaaguggucagagggcaagggagaagcagaguagccuuaagagacuuuugcaaaauaauccagguaggaggugauagggguuugacuugggaaauaacaauagaguugaugagacuuggucagauucugggaagauagugaaggcaaagucaauaggacucacuuacagaguagacauggauuauaaugaaauagaggagacaagaaaacucuaaaaugucuggccugaguaaccaaaaggagcaagcaauuuauuaagauggggaaaauugcaggagaaggagguggugguaggaauucaggacucugaaucuaaguuugauaugcacauuacauacccaaguggaguugugaauaggcaguuagauauaaagaauaaauccuuuaaacuaugguaugguuuggaccuguaccccacccaaaucucauguucaauuguaauccccaauguuggagguggggucuaguaggaggugaucaugaggauuugaucaagaggacgguuucucaugguuuuaacaccaucccccuuggagcugucaucgcaguagugaguugucaugagauuugguuguuuaaaaguguguggcaccucgucccaucucucuuccuccuguucuggccaugugaaugacugcucccacuuugcuuuccaccacggguaaaagcucccugaggcuuccccagaagcagaugcugucaugguuccuguacagccuacagaaccaugagccaauuaaaccucuuuucuuuaucaauuaacagucucagguauuuuuuuauugcaaugugagaauggacuaauacagaaaauugguaccaagagugagguauugcuauaaagauaccugaaaauguggaagcagccauggaacuggguaacaggcagaggcuggaagaguuuggagggcucagaagaagacagaagaugggggaacauuuggaacuuccuagagacuaguugaaugguuaugaccaaagugcucauagugacaugaacagagauggccagccugaugaggucucagauggagaagaggaacuuauugggaacuauagcaaaggucacuuuuauuauacuuuggcuggacugugccccugccuuggggauccauggaacuuugaacuugagagagaugauuuaggauaucuaguagaagaaauuucuaagcagugguguucaagauguggcugcuucaaacaacuuaugcucauaugcaugagucaagaaaugaacugaaacuagaacuuauguuuaaaagggaggcagaacauaaaaguuuggaaaauuugcagccuggccauguggugaaaaacgaaaagcccauuuucaggagaaaaauucaaggggauugcagaaauuugcauaaggaaaaaggagucaagugcugauagccaagacaaugggaaaaaagccuucaaggcauuuuagagacucucacagcagaccaucacaggcccagaggccuaggagggaagaauugaauuguuucacuggccaagcccagggcacugcagucugccucaggacacugcucccugcuucccaggcacucuagcuccggccagucaugguuaaaagaggcccagguacagcucaggcugcugcuucagagggugcaagccaugaaacuuggcagcuuccauguagcauuaagccugccggugcacagaauauaagaguugaggcuugggaaccucugccuggacuucaaggggauauauggaaaagccuggaugugcaagcagaagccugcuucaggggcggagcccucauggagaaccucuaguagggaagugcagaggggaaaugucagguugagcccccacacagaguccccacugggguacugccuaguugagcugugagaaggggucaccauccugaagaccucaaaaugguacauccaccagcagcuugcacccugugccuguaaaagccacaggcacucaaugccagcccuuaagagcagccuugggggcugaacucugcaaagccacaggggcagggcugccaaggccuugggagccacaccucacaacagugugcccuggaugggagacaugcagucaaagauuauuuuguaacuuuaagguuuaaugacugcucagguggguuucagacuugcauggggccuauaagccccuuucuuuucgcugauuucucccuuuuggaaugggaguauuuaccaaaugccuguaccucuauuguaauuuggaaguaacuaucuugguuuugauuuuauaggugcauaggcagaagggacuagcguuaucucagaaaagacuuuggacuucugaguuaaugcuggaaugaguuaagauucugggggacuguucagaaggcaugacuggauuuugcaauaugaaaaggacacgagauuugggaggggccaggguggaauuuuaugauuuggaucuguguccccacccaaaucucauguucauuuauaauacccaguguuggagguguggacuguugggaggugauuugaucacgcaagcgguuuuccaugguuuaacaauauucccacuggaguuguuguuacaacagugaguucucaugagagcugguuguuuaagagugugucacacuuuccccccaucucgguccuacuccugccauguaagacaccuugcucccacuuugccuuccaccaugaguaaaaguuuccugaggccuccccagaagcagaugcugccaugccuccuguauagccugcagagccaucccccuuggagcuggcaucgcaguagugagcugucaugagauuuaguuguuuaaaaguguggagagccauaagccaauuaaaccucuucuuuacacauuacccagucucagguauuucuuuauagcgauuugagaacagacuaauacacuaauuaaagauauauccuuuaauguuuacugagugaauaaauuucguaguaauggacaagugaguaaaugagagacauaugaaugaguaaauaagggcauauuagggauaaaaaaauccuaguaaaugaauaaaggaggguauauaauucuguggauaacuuacugucugauagagcuagaguuuaaaugagaaaccuaagauaacagagaaaaaauuauagaagucaauuguaaagcaacauacuaaucggguuuuaaaaucaacauuuuuaauuaggacagugucacuuugaaaaccaagagauauuaugcacuauaaacuucccaaaaagaauucaaguccaagagcaucacuuucuuaugucuugcacauacauguuaaaauuucaaaagaaugaucagcaaaugaagacacagcucucuaacaaaccacauggaucacaugcaugaauguauauauauuaaacauuccuaagaaacaacauaauguuuaucuuugauuuuccgaaaguucacuuccauguucuggaagucaugauaucucuacugcuucuaauauuucaaacaugucacuacuuuuaggcauacaucaucauauacauugucauauacaauaucucauuuuaggaauuuuuaaaggcauaaacuuauuuauuuuuauuuacuaacuauaucucccaucuuagagaccucauuuuaagucacagaaauuaagauauaucccacauccuacuaaauaauguagguuucucaaaaucucuuaccaauuucauaauuaaaguuuauauugugaaauucaggaacaaaaagauucugaagcauuauauaaaucacuucauuccuacaucuguucuccgagcugcuacuuaagucaccaaaugacagcaagaagacuuuucuugaauuuuuaaaaaaauucacagugcuucaaaauuuuguaauagugccaaagaauaaaaaacaaacagagcaauuuuuacaauuuuauauuauuucaauuacgguuauuucagaugauguuuuuaauuaccugaaauaagcaaauaacuauaucugggcaauauuuaauuagccauaauuagagaaaacauaaugcuauuaauacuugauuaagagcucaaaauaaaagcuacuuacaguacauuaauuuuuuuccaaaaguagaggacuauaauaaauuuaacacuuuuaucuuggcaaaaagaaaauuuuauaauccauuuaaaugaagacuucaagcaaacucuuuuuuuucugcuuccuauuccagugaauacuaaauuagccaauuucccacaaaauaaaaauuauagaaucugcaagaacguaggccagaugcaguggcucacaccuguaaucucaauucuucgggaggcugaggccagaggaugaauuaaggcaaggaguuugaggccaggcuggucaacgcaguaagaccuuuucuguacaaacaguagaaaaaaauagccaggcaugguggugugagccuacaguccuagcuacgcaagaggcugaggauugcuuaagcccaaaaguuugaggcuacggcgagcaacgaucacaccacugcacuccagccugaguaaaagagcaaaaacccaucucuaagaaaaacaaagaaagaaaauguuguaguacuuagggcagaaaaaaacuaagcuggcugguucacugagcaacuagaugcaauguaggaaacagugcugagugacagaaagauaacaguugccauauuccuaacugauaaguuuacaaguucuacugcaggguuucucuaccucagcacuauugaccuguuaggcuagauacuucuuugauuuuaggggacuguccugugcccugugguacauuuggcagcaucacuagccuccacccacuagauuccaguagccucccccgcccaguucugacaaccaaaaauaucuccagacacugccaaauguccuaugggggaguguuggcagcggggagcaaacugguugagaaccccuacucucuauguacagaagauguauguauagcuuccucuagauguguugccucaacacaaaauucaacuuuuguuucuuuuuauuauuauuauuauuuuuuuuuuugagacagucucacucugucacccaggcuggagagcaguggugcguucucggcucacugcaaccuccgccuccuggguucaagugauuauccugccucagccucccaaguagcugagacuacaggcacgugccaccacgcccggcuaauuuuuguauuuuuaauagagacgggguuuugccauguuggccaggcuggucucaaacuccugaccucaggugauccacccgucucgcccucccaaagugcugggauuacaggcgucagccaccaugcccagucaaaauucaacuuuauuuucaaagcuuauuuucagcugucaccaaggcccuugaaacaaaacagcaagaaguaacugaugcaaacaaaaaugggaaguuucguucuuucaacaguuaaauauaauccaacugaaaagaacuagauuuuuaaaaauauauagccauacaagccuuccccccaaauuaaacuacagguuuaaaucugucaaaugagcucauauguauccuucaaaaaauaauaacagaagaaauauugcaacuaucuacagaguccagaaauuugaucuucgaaaaagcugcuuaauauugcuuucuuucucccaaaguggcagcuucauauugucuuuugaaaugucauuugaugacucaaaagaaaacaacuauaauuuagacagcaagcaaugagagggaauaggucucuauguagccucugaaagaaauuacuaagcuguuuuuccacaauucacguaauacagucucuccaugggugaaaccccgaggucucuacauaccauuuaccuggugaaggcucccacauuuccaucucauccugaccugccccugaucccggggacaacgaggucauuaacauaugcacacagaugaccaacaguccuccugagcugaacaggcucaguuuccugucagccuccuaaaccuuccuuuucggccccacauugggacauagcagcacuauuccccaggacaaagaauaguagucauuuuugacugcuggauuauuuccugcugcuacccuaacaaauuucccuggaugucagggcuuaaaacaacauaaauuaucaucuuacacuucuggaggucaaaaguccaaaaucaaagucuaaaguuuaaaguuaagguguuggcagggcuggcuccaucuggagguucuagggaagagccuguuuccuaaucuuuuccaccuucuaaaggcugucuguauuccuuggcuugugggccccuccucgcaucacucaaaccucuguuuccaacauuacaucuccuucucucugacuguaucagggcccuugugauuacacugggcccacccagauaauccaggauauacucccaucucaguagccucaauuuagucauaucuacaaagugucuucugccaugcaagagaacauauucacagguguuggagauuaggauguggacaucuuuaggggaaucugucuacuauaacuccucuccucuucuagccuacaauaauccaaaauguaucccaaaucuacuugcaucccugcaauuccucugcucaucacccagugcaguccacaccaucacugccuggacaaauguaaaccccucccaacugguaucccugcagccacucuugccccauccaguccgucuuccagagagcugccauaaugaucuuauuaaaauauaaaucagguaauguuauuuccuuguuuaaaacccaucaguggcuuccugaugaaaccacaacaaaaucuguauagacucuuccuccucuggccccuucuuaacuuuaaaaaaaaauaacagagcaggaaauaugcaauuuuuccuucacaaaaugucucuccaucccucaccaucaaccuucugaggcuuuguaugccaagcaggagcucccggcaaauccuuaaauggggguacuuggguuccagcuguucuugcugagucuccaaguuuacuuuucuccccaggggcagaagacaacaacugaacacagaauucuaacccuaagucccgcugcuccaaguccuuuucaaauguaaaaugaccacagcaaauucaaaauaaguaaggaagaaaaaucgaagugguagggcgaaaaggggaagaacaccauagugugauacagucuuugccuuucagagcaggcagacaaaagauaguacuuagguugaaggaucuaaaaauaggguagagauaaauuauuuaacguugugagaacuaaaaacagaaauguaacagccuuuggggcgugcugggagagaaauuuucacuuuucauauuauauuuuuaugaacucugaauucuuagaccauguaaguaaauauaccagaguaaccaccaauuuuauaugacauauuuauacuaacuuuacagguguaagugugcauguguaugcaaauuggucaucaguuuuucaccuccaguaacauuccuuugcucuaggcucccagcacuccuguuuagaauucccagaccagagacugucuguuucuggacuuccuggcggcaaaucaggacuuucuggacuuccuagugauaaaucgaggcagugugauccccccaacagccucucugcugaccacuguuccuuagccccucuccucugcuucuauuuugcaaaagcucuuuugucccugaaucaucucacaccagccacuccugaaggcagcuacucuuuucauuuucaagcaauaaauguccucacuucauaauuccuacucuccaucuaacaugcccaaaucucaggaggcagcuuguccacaaaugcaaccaugauuuggaauaacaaacaaucccuaauucaauggcccauacccucauuucauguccucuaauaaauacccaaaugccuuuuacuggaggauauuucaaagaauuuuagagccauaagggauucuagagaacaaacgcauccagaucaaaaucaccugagacuuauaaaaaugcaaaccaccagaccccauacagaccuacaaacucaaaaucuuuucaacaacuuccccaagugguuccaacucacacuaaaguuugagauucccaaaucuaacccaaccuccuuauuuuuaaaauuaggaaauuuaaaucuagauauaagugucuuacccaaaacuggcuaucuauugcacagccagucaauuauucuacucauagucuggucucccuuuuaaagaaacuuaugagauaaaauaugcaaaaacagauagaaggaaacuacuucaagccagacgcgaugggucacgccuguaaucacgcacuucgggaggccaaggcaggugggucacuugaggucaggaguucaagaccagccugaccaacauggugaaaccccaucucuucuaaaaauacaaaaauuagccaggugugguggugggggccugucaucccagcuacucaggagguugaggcaggagaaucacuuaaaccgaggaggcgauguugcagugagccaagaucacuccacugcacuccagccugggcaacagagggagacuccaucucaaaaaaaaaaaaaaaaagaagaagaaaaagaaugaaagaaauuaaagacacaaacaaaugggaaaacauucacaagggaaaggauggucuuuucaacaaaugguguugugaaaacuagacauccacaugcaaaaaauuaaaauaaaguugguuccuaaccuacaccauuuaaaaauuaacucaaaauggaccuaaguccuaaacauaagagcuaaagugacuaaacucagcaggaaacagaggggaaaaccuucauaacauaggauuuggcaaugauuucuugaauauaacaccaaaugcacaggcaacaaaauaaauaacagauaaaucggacugcaucaaaauuuaaaacuuuugugcaucaaaggacucuauccacagaaugaaaagccaacccauagaaugggagaaaauauuuguaaaucauguaucugguaagggauugauauccagaguacauaaagaacuccuacaacucagcagcaacaaccaaaaaaaacacaaacaacuagauuagaaaaugagcgaagaauugaaagauacuucuccaaauaaaauguaaaaauggccaauaaacacaugaaaagauguucaacaucacuaaucauuagggaaaugcaaccaaaccacaaagauaccacuucauacucauuagaguggcuaauauuuuuuaaaaaauaaauaacagaaaauaaccagugcugguaaggauguggagaauuggaacccuugugcaccaucagugagauuauaaaauggugcaaccaucauggaaaaugcuauggagguuccuccaaaaauuaaaaauagaauuauaagcgcccaacuuuuuauaucucauuaguuuuucuagggcauguguuuaaauacacaaacauaaagagcacuuccugccaaccaacuauaacaacuaacaguagccuaauuuucuucagugaccacauuaugauuggaggugggaaaaaaaaaaaaaaagucauucugaguagaugggaaaucccuggagguugagccaagagugaaaugauccaaucagaauuuaaaaaggaucauucugccugauaugugugaaacagaggagaaccagagugauaggagagggacaaaaucagggagaagagaagaagauacucuaauggugcaugugagagauaguggguuagaccagguuggcagcaaagaagaaguggcuggaucucuggauaguuuuuuaagggaacacaaaacuugauggcuuggcaugaugcuugagaggaagagaaggcaaaagguuuuuggccuaagcaacuggaaggugauguuccauuuaaccagaugggaaggauuugggagggacgggcuaggguagaugauaguacaaucaagaguuccauuuuggguauguuaagcuugaguugccuauaagacauccaaguggagauauagguuaaauaguuggauauguaggucuguguaucaaggaagagauuaugcuuucugugaaagaacaaagauucucaaacgauuacaucacaaacaaguguuucauacaaguaaguuaauaaauguuuaacacauuacggugugaaaauauaagggaaguccaagaacucugaaaaacuaaauggaaaaacaaauuuaagaucugauggcagacaagauaauucauaaauauacuauuuggguaacaauccuaaaaugcauuaguaggucuuaaaaggauuaacaucccaaauaaaagaauaaauaaggauauaguuauaguuaaucagaaggguaaagaauaauaauuaaccauuuccaaaaacuguuuaacaaaccacugcaaagccaaaaguaauaagacggcaucaucucaguaucacacugguucugaagggaacaagugacaguacuuaugcagcccaacggugauaaaugcuucuaacuacagucuaaacguucugcagagaugaaacuccauuacauuacacagggcuguccacaguaauuaccaaguuuacuaacucucauaauuuuagccauaauuuauaagaagaggggaaucaguguauuaacucuucuugguuaagacuguuaagacgcaaaaaccaaaaucuuaucuccuugucauaacauauucaauuguccuaguguccaaauaaaaacagaauuuaugucugauauuucuacccuguuaaauuucuucuggguugggaggucuauguccuauucuauuugucaugguuuuauaauuguuccauuucauuccaaagccagaaaacuaccaaaggcagaugaaaguauuucuuagguuugguuucguuuggugaguuggggaaaagagaggagguggguggaugucuaauuggaauacaucuuggggaaauuaucaucugaacgugugcuauuuauaguaugaguauuuggggccauaccauacccauccugacaauuagcuccaagaagcaaaugguucaccuugacaacccacuaaaaugccuaauauccaagccugacuuagagugcccugauuauaggcaaagguuuauggaaaacuucuuuacaccccuacaguacaacugccucaaugugguccagggcuugcagccucugagacaucaugugcaucccaauguagucucuccuucuuagguguucacuuacgucugagguagaccaaucaagcucaucugcagccauacaaccagaaagacccugagaaucaccccucgccacaacugucucacaauuacccuuaaaucuccuuucuuuuuuaaugaaagaaauacauuauucaugaaagagcaguucacaacuuggauucccuaagccucuggucagucauuaauugguaacauuucccauguaccuccuguaugccaggcacugugcgauugauaaggaagcuggggcuuagaggggcuaaguaacuuguccaguuccagauaguugguaacagcugaucugucagaccuccagaaacuugaccuccaaccauucuuccuccagaagagagaagucaaaggaauuucugacauucuauacagccuagcagcacaaucauauuuauccugcaaauaaauggcuacacuggaucguuaaaaugccaauuuccuugcuuugcaccaaaauaugaugucaguguagaaacacuggcuauacugcauuucacaugcugacaaaaaguuuaaauuugguguauaucauuuccuuaauuaguaaaaaauaaaggguauauuaaccaguuauaauuaaauucaguuuauuuugaagaccuacuucuucaagcagcauacuucuguauuagaaaauauuuuucaaaacaaaaagaaaaucuacuucuagaaugguacgaaugucugacauauuauuuggaaacaccaaacauaaccacuuuguuccauauacaagaaagaaggaaaaacugcuagaggaaagugaaaauuaaagaaggaaagguaagcagauaagcaaaauauucuaaaaaugcuaguaguuuaaacaagguuauuuaucuggaguacucauuuagggaaggaaaaaaaaagaugagaaaaccagcuggucauagaggaaggccaagugagguguguacacaugcauauaguucagcugcaguuaguucacaggucuuuaucaucaagaagaaagcugucuacaaaggacagaaacuucccuauucaacccacagaugugugaaaaaagaaacaagagacuggaagucuauaaaccacaguccuggucguuuuggucacgcuaauaauucuuaagaccucuagcaaacugaccugacuuguuugggcuuuugacucauucucugguugcauuuccucauccagaacacagaaauaauaaucaucuuggcaguuaugcugcaaggaccaugugagauuauagauaugaaagugccucaauaaaaccauucagguuccauagaaaggcaauauauuauauuuauuaccaaugcauuggagaguugagcuaaaguugauuucaugcauucuacuuaccugaaaacauaaaaagcaaggauaaacauggggagagaggacucucuuaagcauugauugauucacauuguuaauggagcccaucugcaauacagcuauuauaguauaugguauuagcaggccugcuuacaauuaaaagacagcacaaagcacccgacuaagugauucagacuacaacuugaugcaguaaauuauuaaauaaccacacuaagggaaaggagguucuaaaacaggcacuggaauucaacagauacucaaaaaccucuaucuccaugacucuggaauguucuuuaugaugucucuagcugugcuuggauuugacuacuucuaaauuuaaucuuuagccccacugagggcaaaaagaagugguccaggaauacgugacuaccuuguucucacuaccaucuaagauuuuuuuuuuaauguggcaggaugacucccucacugucaugcagauaagcaaaagugagugugcccagcuauauaauuacagaucaaagcucaagagcaacauagucacugguccaagguuuacaugauuggcucugugccugcaugcaaauaucauguugaauuguaaucuccaguguugagggagggaccuggugggaagugacuggaucauggggacggauuucccacauccugcucucauagucaccaguccaggguugauaugauuuggcucuaugucccuacgcaaaucucauguugaauuguaauccccaguuuuagaggaggguccuggugggaggugauuggaucucggggguggauuucccucaugcuguucucaugagagugagugaguucucaugagagcugaugguuuaaguguguggcacuuccccccuugcuugcucucucucuccugcuccaccaugguaaggugugcaugcuuccccuuugccuucugccaugauaaguuuccuaagaccucccagucauacuuccuguauagcuuacggaacugugagucaauuaaacuucuuuucuucauaaauuaccuagucucagguaguucuuuauagcagugugagaacgaacuaauacagaaaauugguaccaggaguggaacauuguuauaaagaaaccggaaaauguggaagcgccuuuggaacuggguaacaggcggagguuggaacaguuuggagggcucagaagaagacaggaaaaugugggaaagucuggaacuucauacagaccucucgaaugauuuuaaccaaaaugcugauagugauauggacagcaaaguccaggcugaggugaucugaaauggaaaugaggaacuuauugggaacuggaguaaagaucacucuugcuaugcuuuagcaaagagucuggaggcacugugcccugcuccagagaucuguggaacacugaaauugagagaugauuuaggguaucuuguggaagaaauuucaaagcagcaaagcauucaagaugugaccuggcugcuucuaaaaguaugugcccauaugcgugaaugaagagaugggcugaaacuggaacuuauauuuaaaagagaagcagagcauaaacguuuggaaaauuugcagccugaccauguggcagaaaacacaaacccauuuucucaggagaaauucaagccugcugcagaagcuugccuaagaggaggugaaugaaaaugccuccaaggcauuucagagaccuucauggcagccccucccaucauagguccagaggccuagaagggaaaaaugguuucuugggccagaccugggccccauugcucugugcagccucaggacaugguacccugcauccaucuacuccagcucuagccauggcuagaaagagccaagguacagcucaagcucuuauuucaguggguccaagccucaagccuugguggcuuccacgugguauugggcccacauguaugcagaagguaaaagucaaggcuugagaacuucugccuagauuucagaggauguacgaaacaccuggcuauccaggcagaaaucugcugcaggggcagagcccccauggagaaccucuaugagggcagugcagaggggaaauguuugguuggagcuuccauacacaguccccacuggggcacugccuauuggagcugugagaagagaguuacugcccucuagaccucagaaugguagauccaucaacagcuugcaccaugcaccuagaaaggccacgggcacucaaugccagcccaugaaagcagccacagaggcuguacccugcagagcuauaaaggcagagaugcccaaggcuguggcagcccauccccugcaucagugugcccugaugugagaaaggcaauuauuucagagcuuuaagauuuagugacuguccugcuagguuucggacuugcauggagccuguagccccuuuauuuuggccaauguaucccuuuuggaaugggagcauuuacccacugccucuacccucacuguaucuuggaaguaacuaacuuguuuuuuauuuuacagacucacagguagaagggacuugccuugucucagaugagacucuggacuugaacuuuucaguuaacacuggaaugaguuaagacuuugggggaacuguuggaagguaugauugguuuugaaaugugagaagaacaggagauuugggaugggcuaggguggaauguuaugguuugguucuguguccccacccaaaucucauguugaauuguaauccuuaguguugggguagggaccuggugggaggugacuggaucauggggacagacugccccaugcuguucucaugacagugaguucucacgagggcugaugguuuaaaaguguauggcacuucucucucucucucuuuccugcuaugccaugguaagacuugcuugcuuccccuucaccuuccaccaagacuuuaaguuuccugagaccuccuagccaugcuuccaguacgaccuguggaacuauguguuaauuaaaccucuuuucuucauaaauuacccagucucagguaguucuuuauagcagugugagaauggacuaauacaaagguucuauuuacacuuugguucacugguuuguuugaacuuaacuacucuguaauuagugccuaucagcagagaagacuuguuugaauuuccauccuuuucauuuccaaauaaaaggcuuagagaacacuuagaucuuaagguagaucuugguaacaaacaucuuucacaauacacauggcuugaauuuaucaauguguaauguuccagaugaggaaauuagccucucuauauucuuuagccauacaggacacccauauaacaaaacuuuauuugaaacauugugcuaauucacagguucacaucugucccaggcuggggugcccugugauggagaaugaaccucucaugucacuuauagaaagcaaaaguuuuauucaaacuggccaugaauuaacaugauuguuuuuaauuucucauuauucugaguaaaacauaacuggaucuagccuuuuuauaauagcauuucuaccauuaaauuuaauuaaaaucauacugaauucauacaaauucuaaauacaaagacucccuuguaaaauugaaaauucacucaguagauucugaaugaaugaauuauaugaaugaaugagucuuucauaagguuaaagggugcccauaucaauugugaacugaauacuuuguaugaauaaagccuuauaauuguauacauucuugaaaggaauaaaauauuuucauuuagaaaacugauauucuacaagcaauuaauuauucagaucuuaaagauggagaugacaugauguucugaagcaggaauuuaacagaauuuggacuugaaagucuaagaacacauuccugauagauucgguucuugccacuggucacagggguuuucuauaacuagccccaggguuuggacagaaaugaauagaaucauccaaaauuauaaccugcuauggacugaccuuuggguaaacaggccuggaaaagugcugaaaggagaagggaacagcaaaugugugguguaagaaggaaagcagcaguucuucucaagagacuuuuacauccucucccuggcuccaagaggaaaauucaucuagcugaaauuaugcuugcugaauguggauaaagggagucacaugaugaaauaaguguuccauaaagauuaaucugucagcagugggacugauggauugacagagagagagaccagaggcgaugacaagaacacaaugcagagaagaggggagggauggagucaugggagacacgucaagacuuaaucagcgacuauuuauaggcaggagagggaggagucaaagaugacucccaagguucacucuuagauagcugggaaaacugaggggcauggcugagaaagaugaggaaggcaggaaggagagcucucuuccugcaugauuuaccuucacacagggcaucaccauugggcaaaugcuccuggguuauuuuuucuuuuuaauuuuuuuaacuuauuguagacacagguucuggcuagcuugccugaguugcucucaaacuccuagccuuaagugauccucccaccucagccucccaaaaugccuggaugacaggugugagccacugcaccuggccuccuggguuauuuuuucaccaacuguaaagagaaggacagugguccacccugcuaacaaagccugagaauaagugaagacagaaugacacuaauaguuacauaguuagcaggaaugagucaacccgugagcagaaagcauuauuuagggacacaugcugaagcaagacuuucaacagcacagcucagcuguaggcugcuggaaagcacaguuagcaguuggaccaaaccaggaugaaauguccaaaaauggucuagacuuuauggaagagaauaaucaaagacaaggauccaaacucaaaugcccaaagggaccagaaaugcagaaggguuaguguuagcaacaaagaaugagggcacugcaguaaacagcaugugucauccuaucuaaagaggagccacaucuuaccuguagguggguuacucccuaggugaauuacucccauccagggccguaagcccaaucuucugauucuucaagagaaaucaucacacccaccacucucuaccauauuaugccuuuuuaucuucugcaagcacgugucaauaccuaaaaucuucaugugguugucauugcugcucuggacauguuuauggucugucucuuccuacuagaaguaaagcucgcuggggagccacauaauuggcacucaucuaugcucaaucaauaugcgcucaucucuugacuuccuaggacuuacaguuugauauagaauaaauccagacccccuugugucuucacagucuucacaaccuuccaccuucacuuccugccacucccaauacacccuaccucucuucagcaugagcucugcaaagggaagaccuggauucaaauccuggcucucucugccauuuacuagcuauuuguccuuacugaagauacuaacuauaaaucucaacugcuaugucuauaaaugccuaugucacuggguucuuagaggaacuaaguaggauauuuaaaaauugauuacaaauguuacacuaggccaggcacagugguuuaugccuguaaucccagaacuuugggaggccaaagugggcggaucaccugaggucaggaguucaagaccaaccuggccaacauggugaaaccccaucucuacuggaaacgcaaaaauuaccugggugugguggcacacaccuguaguccuagcuacaugggaggcugaagugggagaacugcuugaacccgagaggcagagacugcagugagccaaggucgugccauugcacuacagccugggcaacagagugagacucugucuuugaaguuuccuacacuugaguuuccccuucuugcacucaccacccaaauaaccugcuacuacccaagcaagucaggccuuugcaccuggagccucuccucugccgauucuguggcucuuccuuucuccaccuucugcacaaacuuaacuccuaauuacucuuuagggccagcucaauugcuucuuccucuaugagguuuucuuugacuucccuaggcaacgguuauucucuccuuuggaugccuacagccuucuguuccuuccacuaguaacugcacuaacauaaaccacacaucagcggcuaccuugauucugacacuccaccagugagcaaagguagggacaaaguguuagucuucuucguuuuccccagagucuagcacagcgccugauucaaaagaaguauucaauaaaugucugcugaaucaaacaaaacugaacaccuacuauguguaaaucugauuuacuggaaacuauuugaguagaaagacacaucuugcuccaccauaaaaauaacaaaaacuaccagcucuugauuaucacaaucacauuaaugauggguagcagugagagacauuaucuaagaauuguugauacaggcauuuuugcuacuuuagguaguguaagcauauaguuagugugacuuaugcagugcuaaaaacucaagaccaaaauuaucucuccucaguagcagugaggagcacagugccaaaaauacuugaguauuuugaggguccuuuugaauuuuaguuugauuauaacaugaauuccaugggaaccccuauacucuaacauauaaguguucaaucaucaauucauuccacagaaggccuacuacaugccaagcauuacaaguaaaaucauuacaagccugaauucuauauauuacaauuuuguaaugacugcuuaggaagaccuggaaaacuugggaaggcuguuuagauaaaggcagcucuuuagauaaagucuaggcuugcuaaagaaacuuccagaagggaaaucuuuuccccauguuccacaguauaaaacuuucuauugauuuuuaaaauuaauuccuuauaauaaaggucauaaaaauuuauguuccagaauuguaaaaacgugugcuaacaucucauggcagagacaggugggagucuucauccuauguuccucuuucuguugucccauaccaacaacaauggaacaacugguuucuggaaagucaagaaauguggaaccaguccuauccuaaaauagagaaggaaacaaaaauaaucaccaagaucuaaauucacuuaaacuucucucucuucucucuucaaccuggggugguagguaguagagaaagcaaaagacugagccacacaggucaacuaaagucagcuuuccccaagguccggugcuaugcaucgugcaucuccacaaucccuucccaaccagaagagacgagaauccuaagggagcaugauauaggacaaguaguuuuuuagggggguuuuuuguuuguuuguuuuuugagacagagucucauucuguggcccaggguggacugcagugacgcucaccgcaaccuccgccucccgggaucaagcgauucucaugccucagucucccgaguagcugggauuacaggugcgcaccacugcgcccggcuaauuuuuguauuuuuuuaguagagaugggguuucaccauauugaccaggcuggucucaaacuccugaccucaggugauccaaccgccucagccucccagagugcugggauuacaggcaugagccaccacgcccagcaggacaaguaguuuuugacuaaaguuucaggaaaagcuuccuuaacucuccuaggaacagaccacauaggauuaucucagaaugaaugaaugaaucuaaaguguuucuccugcuuuuaaaauguaugguccauuuuauuaauauauugcauuaaugguuaauaaaaugcuuauauuuaguaaucauacaauuccauuuacgcccauaaaagucuccacaagugaaaacgaucgaucuugauaacaaaguaagagauauaagaaaaaagcaauguuuuuuccuucucuagucucacacaacacuuaacccaacacuucugacaucugacguaugggaggguuuuccccacacaccaaguaauucugcagauucuccaucacauaccaccucgauguccuccaauucaauucugacacucuuagccuggagacagcgucagauccacugguugaaggccuagucccacaagccuacaaaugcccacuucagaugccaaucucaagccccagauggaggccugugcuccugacagaucagcuauaaacuaggguagccacaauucccuuaaauuaauuugcuagagcgguucacagaacucaggaaauacuuuacuuacacuuaccauuuacauaacagauauuacaaagaauacagaugaagagccagauggaagagacacauagggcgaggaucuucaaugcccuccccaggaacuccacccuccaggaaguuccacauguucagcuauccaaaaguuuccagaacccagucuuuuggguguuuauggaugcuuccuuacauaggcaugacugauuaaaucacuggcuauuggugaucaacucaaccuucugccucucucuuugggguuguggggugcaaaucccaaaccucuaauaaugugcuggucuuucuggugaccagcucccauccugaagcuauuuagggacccccagccacccaucaucucauuggcauaugaaagacacucaucacucuggagauuccaacggucuucgaagcuguguaccaggaaacaggauaauuaccaaauacauuucacaauaucacacaaagcaaaauuaaauuuuuccauuucagacccuaauacugcuacacggcaggaaucugacuuccuagcuagcaagaaagaauuuauaauaaaucaucagaaaauaaaauugucuuuaaagaaucuugaauuugaguaagcaccaaaaaucaaggaauacagcauuuggauccaaggugucaaaacucccugccugcucuagacuaccuugguuuaugccuacuaaccuggcauaauuauuaggagugcccacuucuacuuuaaaaaauggcacaguuuggacaacugguuauacaucacucuaugcagauaaaaaagauuuuucaacauuguuugacaaagaaacauuaaggcauucagaaacauuaggaugcaaagaggugguuugcacaaucugcuuuuacacucaccaauucuggaagaguuaauaaacauguuaacuuucacagcuauaaaguaauaaagauugaucaacauugaacauuuacgaaauuucuucagacauaaauguggagcuuggccuugcaaccuauauuugggaauuuccauuuccaccucuacccccagucuagggauccaugagaaaggcacagugauucagcauuucuaaggcuuucauuaaaaugugcuucagugcaaugaaaucaggagagggaaaaaaagguacauaacacagauauuaaaaacuucuuuacauaaaagcagaaaugaaauucuauacuuucuuacugaaacauuucuaaagcagcagaacuggcaagugucucucaucacuguuauuaagcaagucauccuaagauacagcagaaagcagauggaacacuuuuuaucaacuacuucaagagaugcuuaaaaacagaaguaaaagggaggucacagaacacaaaggguaauuucaaggcacccaccaaacaacaacacugucuauaccuguacgggagcacuuuuagaaucuugcuuaucucauuuuccugccuccuggaggauagaucaugucuuuucauccuuuuaaccuuuaucucuuaucuuugaauacuuagcauaccgcuugcauaugagaaaggugcaacaaauguuuauagaguuaaacuaauaagaaaaaugcuuucaaauacgauuucuguagaaacauucuuuucaaaguacaguauaaaagaaacccaacuauuccucuagguaagcgguggguacagguuuaacaaaccuuauuaucacggaagucagguauauuacagucaaaccacgucccaccaaagaaaacagccacauaagguuaaacuauaaggcaagcauuagucauagccucaaacaucugaguuauuaaaaagugccacugaaauuucaagucucugcugaggagggcuugagcauucuuugaaacaggcuuugaggcagcuguuuuuccuuccuccagcauccuaagcaaaggugcuggaguuugagaacuaaccacuuaacucuaaaaggucucauucauaaggaaagcuauaaaagccucaaugcauuuuaucaaaagggccuuggauuucucuucuuuaaagacaacacccauuucuccuaucaauaagacaaaugaguuagacaugaccuauuagucaccccauuaaguuauauaggagcuuauggagaaaagggcuggcugagaacagagacacauuuaucucacgguggguagcagccacuucaaaauaaugugaaagaaaguucaccucuccaguaauauucaaggugaagaaagcacuuucucagagaccuaacuuguaaaaaauaguaaaaauuaaacauucaggucaccugaauuuuauauuagcugcuuuacaacauaggaaaaucacccaaaagccuuaaauuucuagcuccccauuuguaaaauggggauaaauacuguuaccacucaccuauauuuuagaaaacuaauaaaaaacaaugauguaaacugcagauacuuucuuaaauucuagauguuuagacaguuaauugcuaacuguuguucucaccugaacaaguacagaucaaaaugaaacauuuaacauacagacucuauuuucugcucccgauaaacaacagaagaaccgauaauccauuguuuaaaucugcucgggguucaaaauaauauuaauucaaguaaagaauaguaacacagggaaaaagaucccuuaaacucuuuggauauuaaacauuugucuucuacugauaccuugguaaauaucaguuccacuuucugaacuaaccugaaaguaaagcaacugcucauaaucaaugcagaguagguacugaagaauuaugccaaucaaaauuggucuucauauuaugcaaauaauuugugucuagucaccauaaucuuuuuaaaugucaaauuguuuaccuauugaaaauacaacagaaaauuuuuuuuuccuccuacugaucaauuaaagaaacagacuguuuaaacacucaauuucuaaguggaaagacugauggagacacugcagccaaauagcuucuugaagcaaucuugcaugugcagauugaaagcaguuuuuauaucaugggagacaguuuuauaucaaggcagaauacugcacccuuacauaaagccucacagaaacaaguuagaaucauaaacacauucacuuaacuacuguucagugcccaauguaccugaaagauacauggauaucauuucagguaucagaaaauucuaguuccaguuuagucagagaagagaaacaacagucuuaucccaguagaucccaaguuaauuccuuccaguuucuccccuaucauaauauuaauugcuuucuuaauaaaaugcugcaguaaaauuugugaacucagauucuggcagaaaaucaaaucaaaggaaaacucuucaugauaguuacuuuugcauagccagccuccugccuaccuuauuauguuuuugcuggugucuugccuuugugucaagaacgugauaagggcuuuccgagucuugguugauguaauauaugagucuugaaggcagugugauuucuuucugcauugcauugcuguaacugauauuacugcugcuauucuguugcaauguauugucuucaucugccaggacucccaaauuuuuuucugcaguuucauuccaaugcggagcugguggagguaggggggugggggagcagaaaauacaaacauacacaaacacacacauauuuaccccauaaauacauaagcacuaaaaugcauuuuuccuuuaauuucaaacacaaaguuuucuauuuauaagcaguuaagaaguagagcuagaguaaagcaaguuauuucaacaauaaaauggccuggagaaguuaauaaauagccaauaaggcuuauacaacugugcacuauuuauuuugauuuaugucuuauauauacauuucuagucagacucaaaucuauacuucuaaguguugggggggggguagaaugaacuugagggaagaagagucauuaaaugaacauguucagggguccugcccccgaucuccaccccuucucugaguccacagaagcacaacucuacucugccuaguggcaucccauccaagagcuaagaacgcuccuaagauaacuugaguacugaauuuauggauaccgaauauuaaucgacucuuuuaacaaaauggacaauucccuucucuuuuaacuuuaagaugagcaaacauacuuugccauguagggauacagaugcuggcagcuucccaauuucuuuuuauuuuccugacaaagccagcuuucugcuuucagugacuuccaaucaucaauauauagaagaugguauuauauuaauuguucauuauaaugacaagcacuuugagaaaucagaaccaaaggucgugcaugaaguaugucuucagcaccuuaauucuuugguccccgaagugugccucccccaccuuaauuccaaccgcacugaaugcgccggauacgaaauuugaggaaacagcccauuaccacuauuaucacuacauccuccccgcauucacauuaagguuccaccacgcaaguagcaacuugcucccucgcuguauuucccauccacugguugccccuccgcaaguugcacagagaucgcugagggacccaggauccacuaaacaccucccaguggaaccaacaagaauuggaauggguuuuucgcgaaugcaacagaaauggacuuccaaaagugaacugggaugaauggggguuugggaacgagaaggguggaaagacaggcagggagggaaggaaaggccgagccggggacaagcccggagcacacggacccgcgcgcccuucgcuuuccucugcagggccccgcgggaaagccaacgcaaagggcacggggccauacccaccgcugggcgcagcagccccccaggcgcggggccgggacgaggcggcgagcggaggcagcaggagaaggacgagaagcaggcggcagggcggcgugcgggccggggcgcuggcaggcaccgagccggcggggccgcguugggggccgcaggaagcgccggcaaggcugcagcccgccaggggcggcugccgcgagcugcugccgggcggcuucauggcucauagcucccgggcgccgcuccguguggccggcgagagcgccgggcuagcugcggggcggccgcgggcggagccggucacgccggcucggcgcgcauggugccgcggcgggcagggggcuccgggcucggggcacggggcgcggggcucggggcugggcggcgcccccuuucccggcucgccuagccucgcagccacucccggggcgggacgcagaggaguccagggguccucgccgcuccgccaacuuggagccuccccagcggcuacucccucccccggcgggcgcggccgcuucagcgacugcgggggcugccgccgggccugaggaugcugaggcggcgcgcgggagcgagcggcgcggggacgcgcgggagcgagcggcgcggggacgcgcggagcgggcgugcgccccgccccccgagagcgcgcccgagcggggcuucgggugcugaugcuguugcuggaugcugugcugcugcuguugccuggcccggaacgcacugcgcaug

SEQ ID NO: 12725 - RNA, 74927 nt, Homo sapiens
cugcgcacucggcacugggcggcgcuggcuggcucccuggcugcggcuccucagucggcggcggcugcugcugccuguggcccgggcggcugggagaagcggaguguuggugagugacgcggcggagguguaguuugacgcgguguguuacgugggggagagaauaaaacuccagcgagauccgggccgugaacgaaagcagugacggaggagcuuguaccaccgguaagaggagcaggaggaggaggcaggagccagagagagccggggggacggaggggggacggggaggcgccggacacccgcgcuuggggccuuccccucgcaggaggggccgcgguaaagauggagccuccgcccgagccccacaacaucgccgccgcucgcagcgaacaaagaauaauggcggcggacuggagccagcggcggccggggcggcagcgacucugccugcagccagcggcggcgcucauggcggggggcggcgggcggcgggcggcgggcggggugggagccggcggccgggggugugugcgggcggccggccgcggcgagcuggcgcccgcguucccgccgccgccgccgggccgggcgcggagccgggaacccggagccgccccgggggaggccgcccgcucggcccggcgcugccccccgcgccgcucgcucguccggcccccgccgcccgccucgcccccggcccgacccggccgggccuccggggcagccgccgccuaggugccggugggggauggaggaggaagaaggcgacaguugagggcagaggaggugaaggugccugcugccuucccgguggcuucggugccugccaugcccgcuucgcaaggggaagagcugcaacgucugaccuacucuucucuccacucuuugugcaauaaaguucgaaacccaagguuuccucucgugcuguauuuuauucgugcccuuucccccccgcuccuacaccguugaggaaaugcugcuuucugcccuguguugcuuaguugagagaugagagcuugugcuuuuggggggaauuuuugacucccucaccccuuugcuuuuuuuuuuuuuuuaaagucagucauggaaaugcaugcuuuuugggagaaagggugcuaagaaaaacauuuauaauaacuuuuuaaacuguugggaucuuauaaaagggaagcugguguuugaaaacaguuucgguuuuaacccuuuuuaauaagguaaucaucacuugagaucuaucauucugaaacacuucguuggaacgaguaucagccgauguacucuuguuuuacaucauuucgcggggugcaaccuugccaaccgcguuugggucaucuggaucuccccucacccuccgucccacucccccuaccauauuucccacgaauuucugugugaacuuuaaugagagauugauuuaauacuacuacuaaaaauagacauuaaaguauccauuauuugucucaugcaguagguaacccccgucuugagauugacaauuuaagccacaagcuguauuuuuucuucgccuguugggaaaagaggacagcagaaaagucauugacacauuaaaaauuaaaagacaguuuuugaaggacgugcgguaugaccuauuuaaguuuguaauaccaucucaaguuauaauucuaaccucagcuggcgucuaacuucugaagguuuaguagaagauacuuuugauugcugccuauugaaaucuuuuacauuuauggcucauuucgugauuuaaaaguaaagccccgaacaguuauuuuagguggugcaaaagacgaacaaguuuguuuuaaaaauacuugucugucacuguaugauugcauugugauugauacguacaaaccuucugguuaagaacaaauauugauuggcagcagaagcacugucuuauuuuucuguauucuagucacuuuuccaaaacgugcuuugcuguauugcuucucuuuaaaagaccacauuggcaauuugucauuuccaagaaaauuaagaagaggcaauaaaggcagguuuucuauaaagauuggggaaaugauuuuauuuccgagcacugaaaaaauuauaguauugauaaugguagcuuaccauuuuuccuuuauguuguuccgcaagccacuaucaguagaguagaauuuuuuuucuuguuaagaauauaagucgggcgcgguggcugaggccuguaaucccagcacuuggggggucgaggcgggcggaucacuugaggucaggagugcaagaccagccuggccaacaugaugaaaccccaucucuacuaaaaauacaaaaauuagccgggugugguggcacgcgccuguaaucccagcuacucggggggcugggguugcagugaauugagaucgugccaugcacuucagccugggcgacacagcaagacuccgucucaaagaaaaaaaaaaaaaagaaagaauauaugacucuucauuugugagauuuuuaaaaaauuguucacugauggccgagugcgguggcucacaucuguaaucccagcacuuugggaagccgaggcaggcggcucacgaggucaagagaucgagaccauccuggcuaacauggugaaaccccgucucuacuaaaaauacaaaaauuagcugggugucguggcgcgugcuuguaaucccagcuacuaggguagcugaggcaggagaaucucuugagcccaggagguggagauugcagugagccgagaucgcgccacugcccuccagccuggugacagcgagaccccaucucaaaaaaaaaaaaguuuacugauaaguucuuucuuuagucuugcccgagagauauuuuaaauuguauuuuuuauuuuuauuuuuauuuauuuguuuuuuugagacggaguuuggcccuuauugcccaggcuggagugcagugggcuggucucggcucacucacugcaagcuccgccucccggguucaagcaauucuccugccccagccccccgaguagcugggauuacaggugugagccaccgcgcccggccuguuuuauuauuuauacauucauaauuugugauucuuagcaauuccaggugaaacuucaaacuuguauucauuaauacuugaacauucaccuggaacauguuacuaaauuguacuucugcacuguuccagccauggauaaaaauuacagcuggaucugcuugaaucuuuuuuuuuuuuucaugaacaccuacauuuagaaagcuaauaaauuacuugacagaguuugcuugaagaauguuaaaagaacacuucuuugggaauuuaaaacuuaaguguuaccuguuuugaaugauuuuuuuuuuguuuacauaaagagccugaagaaacuuagacaccugauccauaaaaauggcaccuuuuucuacuuucugaaacucauauucuugauuaggucucauuauuagaaauuuuggguucuucauagagaaguagcuuuauuucucucucauucuaagacauuugguuuuguuuguuuggauacaguaugguuaugggguuauaguaaaaccaaguaugucuuccucacguguuuuuaaauucuacuuuuuauaacagaaaauuauuuuuaaccuaaugcuuacaauauauuaccgaaauuuauaauuucauuuauuccauaaauagcuuaucagauaugaguuacauaaacuuguuuacagccagcuugugacauaguuuugcaaauaucuugauauaugguguaacuuugauggcuucuuuauugaauagagcucaaaucuaaauuuaagaauguaaugagaugucaagauggaaaaaugcaggauuuuuuuuuuucuuacccauguguaaacucaucuguacugcaguaucacuugagacagcaguuuaugguaauucaaauauuuauuuggcacucacugugacagagaauguaguugaaagagcaugagguuuggaaucauaggccuaggucugaauccaagcauugccacugcuauccuguacccacccuaaaggaauuuuguguccugaaggaaguuucuuaaucuuucucagccucaguuuccuuauauguaaaauuagaauacuacuacuuauuucauaagauugcgagauaaacauaaaguaccuuagggcuacaacuaaugauagcuagucccuuaagcuuuauuuuaacuuccuaccugugggcccuuaggcaaguuaucuuaacuucuuaauaccucacuuuccuuucugaucaguguagaacaacuaccucagaauuguggggguuaacuauaaaguaauacauacuaagucccaggcauugugcaagugucaagugcucaaguguugacaaggcuuuuuucuuuuguuuuaauuuuuuuuugagacggagucuugcucuguugcccaggauggugugcagugaugcagucucagcucacggcaaccucugcuuccuggauucaagugauucuccugccucagccucccuaguagcuggaacuacaggcaugcaccaccacgcccggcuaauuuuuguguuuuuaguagagacaggguuucaccauguuggucaggcuggucuugaaugccugggauuauaggcgugagccaccacgcccagcuggucuguuacuuuuuaaauuauuuauuauuacuauauguaauacagugggucagaagcuacaacaaauccaaagaugaauuacgcugucuuaucucuacccucaggaacuguuggggacacagugacuaaggcaaaauaugugucaaaagaaagcagucaaaggaaaaagggaucaccuuuggugaagugaggaguauauuuuuuauauuucuaauuugguuuuuugaauaaguaauucauucacaugaucuauaauucaaaacauaauaacagcaaaaugcccuacauucucuugcccuauuaccuaaguguuagcaauuuuuuauuuguccuuuaagagguguuuuaugcaaacacgagcaaauauguauguacagucucccccuuuuuguacaaaugguagcauacuagguauacgcucuccuauaucaugcuuuacccccaccacuuaauauggcuuagcaauuuuguaucagcacauaaagagcuucuucauuuuuuaacauacaauuggaagcauuuuauuauguaaguagacuguauuaaccaguuagugagcugcuuuuauucuuaggucuuauauuaccuuuuaaacuaagggaaacugccaucuugccuuuauuucuuuaaaugaaaaacuuucuauuugaaugaaaaauaaauaguuugugacaggaaauuguuauuuaaagucccucauuuccuguuuaacuccaguuuuuaaaaguuuuaguaaaaugaucaaaauguacaugaggaggcaagcaagccagguuaagaguuaacucacaaggugaauuuaacucuuuuguugagguucuuacaguucugaacagacuacuucuuucaauuauuauuuuggcccaaaagguuuuuauagcuuucuuucuuaaugagaaagaacauuucauauaguccgguguuuuuuuggguuuuuuuuaacagacagcucaugggauauuauuacccaguaaggcugauuacuauacuagauuucucccugcauucauuuauuuuuuacauacuuguuaacuuaccuugacgauuuucuaguauuucuuaauguaauuaugugaguuuuauauuuuguaccuaaauuuaaaaauagugagauucaccuauaugauugcugagaugauaaacuuuacugcauagaugauuuuuuuacccccguggggaaaccuuuggucaaccaguuggaccaaguaauacguauuucagccaaagcacaaaaugcguuucacuaccuuuuuuuuuuccucuagcuuuucgaaacagcauugagcuacaauacuuuuuuauuuauuuauuuauuuauuuauuuuuauuuauuuauuuuuuugaggcaagguuuggcucuaucacccaggcuggagugcaguggcacacacuuggcucacugcaaccucuguuuccuggcucaagccauccucccauuucagcuuccugagugagugggacaacaggcgcgcaccaccaggcccggcuaauuuuuuguagagacagaguuucgccauguugcccaggcuggucucaaacucaugagcucaagccauccaccugccucagccucccaaagaguugggauuacaagcgugagccaccaugcccgaaugcuguaguacauuuuaaauauacaugcuguuuguauuuaucuuuaaaauguacacacuaugacuuuuuugaguugauuaaacucagaaagugauuaauaauauagcagcaagggcacaaaucucuuuccagaaaacaucauuaaguaaagcugucaugggccagucgcgguggcugacgccugugugaucccagcacuuugggaggcugagguagguggaucaccugaggucaggaguucgagaccagccuggccaacauggugaaaccccgucucuacuaaaaauacaaaaauuagcugggcaugggggcaggcgccugcaaucccagcuacucaggaggcugaggcaggauaaucacuuggaccuggaaggcagagguugcagugagcugagauugcaccauugcacgccaggcugggcgacaagagcgaaacucugucuuaagaaaaaaacaaaagcugucaugguauauuucguuuuuuguauucccaaguugguguuuaugcguugaucauauauacaaaguuuuuaauguaagaauauuguuuugagguuuuacuaauauuugauuuaaaauauuacuaugugcuauuuggccaggcgugguggcucacgucuguaaucccggcacuuugggaggucgaggcgggcggaucacuugaggccaggaguuugagaccagccuggccaagauggugaaaccccaucucuacuaaaaauagaagaauuaucuggguauaguuguauacgccuguagucccagcugcuugggaggcugaggcaggagaauugcuugagcccuggaaguggagguugcagugagccaguaucaccccacugaacuccacucugggugacagagcaagaugccaucucauaaauaaaauauuacugugugcuauuuguaccugcuaaaugauuaaaauguuuacaaagugcuuuguuguuguuguuguuguugagacggagucuuucucuguugccaggcuggagugcaguggugcgaucucagcucacugcaaccuccgccuccuggguuaaagcgauuccccugccucagccucccaaguagcugggauuacaggcgccugccaccaugcccagcuaaagagacaggguuucaccauguuggccaggauggucucgaucuccuugaccucgugauccacccaccucugccucccaaaguggugggauuacaggcgugagccacugcgccuggccuacaaagugcuugucuuuacauauuuggggaugggggugggguagaucauugaaaucuguaaaggcagaacguuuuuuaucuggaacauaucuguagacuaacagaguuaaaugauuucccacagugucauggaaucaucaguggauugccucuugggguggaggcaaagaucauuaaagcagcaaacugauaaugugaacgugguuguuuuuucucugccaauuaaauauaugcuaguuuagucauuauagaagagccagaugcuggucagcuuguugaaguuguaaguagaaggugugguuuuaucacaucuguaaauguagguuuuugagacaaaacuuaaauaagaauagacguuaguuuuuauucacauucagaaugucugacuccccuuaauauauacacacucuugucuuaucuacuggguuuuuuuguuguuguuuuuuguuuugccuuuucucucucucuuuuuaagcucugccagacaaggcccuaugaagauagguuuuacagguugagaaucuuuuaucugaaauucuugggaccagaaguauuuccaguuuuggguuuuuucagauuuuagaauauuugcauauacauacauaaugagcuaucuuggggaugggacccaagucuaaacaugaaauuuguuucauauacacauuauacacauagccugaagguaauuuuauacaaaauuuuuaauaauuuugugcaugaaacaguuuugacugugaacuguuacaugaggucaggugugggaauuuuucauggcaucaugucagugcucaaaaaguuugagauuuuggauguuuuauuagggaugcuuacccuguauuauauuuugcccagauguuuccucauuugucuucuaggcuaccagaaagauguuagcuuagaaaaacguauucuggcguuuauuccaacagaugagaaggcaguuucuccagugaugaauaauuaccuauaauuuaauacgugcauuauacaucuccagugaugaaaaaucacuguguauuaaaaaauucuugaagcuagguacauaaucucaacuccuaaaaaagaaaauaaacaguaguacuccuugaugaacuuacagaugcuaaguugccuuuucuuagaguugaaauaaggugauaaaggaguuuaccgugagacuagcugugugaacaaagaugaaaaacacccuuucaguuuucuuccucuuggaugauucuaggaucucuaaaaaauaaucuuaaaaggggcgagguuuugagaggaugaggucuaaggaauugauggugaguuuuuucugaaagaagagaagugacauuugauuagauaagaaaggguuaaaagggaaguuauuaauaaaauaguuuaggaguagaguggaucugaaaguugacuuauaccaaugaugauagaaugugucuuuucccaaagguuagugcaucuucucugaaaugaagacguuucuuucaucaauuuuaagugaauuucuaaggaucugguuaucuacuugugaguuuuugguuguaacuguaugacaguacagauguaacuaaaaauguuuguaauuuacccaagguuaaauaaccauuauuuuugagggcuguuaucccuguugguauaaguaaguaguuggcaguaggggacacagaaauaccuuguuuuucaccacugaagugaaaauuacagauuauucugaauuauuuguacucuuuuuuuuuuuuuuugagaggaaucucgcucugucucccagccuggaaugcaguggugugaucucggcucacugcaaccuccgccuccuggguuccagcgauucugcugccccagccucccaaguagcugggauuacaagcaugugccaccauaccuggcuaauuuuuuuuuuuuuuuuuuguauuuuuaguagagacaggauuucaccauguuggccaagcuggucucgaacuccugaccuuaugugaucugccugccucagccuccgauuacaggcaugaaccaccgcccccagcccuauuuguacucuuaaaggggagucauuuucuuauaauaaguaucaguaguagcucuauuguuugcugugaucaauggugacaccuugacuuuauguauugccauuuaucaaucauuuauucagugaagauuuauugaccauugacuuuauuaugguuggugaaauaaucgcaagaaaauuuauucaguuagguauuuauaaaaauaccuagguauuaaaugaagauuguucuaguugauauaagcaauaaagccugacuauauggcuccuacccucaagaaucuuacgguauaguagggaugaugaaauaguguaagaaugauuuauaugugccagaguacaugacagaguuuuuacugucuugaagagcuacagaguucagaagagaaggggcuuagugaggaaaaguuuugugggagaaguagaauucaaguugaauacuaaagaacuucaguaaguacagauaaaauggaguguauucuaggcaguggaauggacaaaaaaaugaaaacauggacauauaaugaacuugacauacucauaaauuggugaagaaaguauuagauuauagaucuacauuuugaggaaugcugaguaugaggcagggagcuuugaguuucauguaagagaagguaagauauaaacaggaauacaaugauaaauugggcugaaauguagauuuccugacucccaauucuucuccuuaguguagacagagauauacagucaugcacuguauaagaacguuuuggugaaugacagauugcauauacaacagugguccugugcuaguguaagcaaaccuauuaagaacuucagauagguccuucaggagguauuccagaagaaggcauuguuaccauaggagaugacagcuccaugcaugugauugccccuugaagacauuccagugggacacguuguggagguggaaggcugugauguugacaaucuugacccuguguaggccuaggcuaacgugugaaugucuuuuuaacaaaaaauuuuaaaaaguggccgggaaugguggcucacgccuguaauccuagcacuuggggaggcugagucaggcggguugcuugagcccaggaguuucaagcagccugggcaaaauggcgaaauccugucucuacagagaauacaaaaauuaauuaacugggcuugguggugcaugccuguaaucccugcuacucacgaggccaaggcaggagaacccaagaggcagagauugcagugagcugauacugugccacugcacuccagccugggugacauagugagacccugugucaaaaaaauaaaguuuaacaaaaaaguuuaaaaaguaaaaaaaaaaaaaaaaaaaaaaaaaaaaggaaaaaaccuuagauucuuuuauugcuuuacuuuauuacuaaauuugcuuucacuuaaaaacccuuuagagaaaaaauauuuuuauacagcuguacaauuuauuuguguuuuaagcuauguguuauuacaaaagaguugacaaguuaaaaaaacuaaaaagcauaugaaguuacaguaagcuacgguuaauguauuacugaugaaagaaaauuuuguuuauauaaauuuaguguagccuggaugggcacaguggcucacaccuguaaucccagcacuuugggaggccaaggcagguggauuaccugagguuagaaguucgagaccagccuggccaacauggugaaacccuguuccuacuaaaagugcaaaaauuagccaggugugguggcaggcgcccguaaucccagcuacucaggaggcugaggcaggagaauagcuugaacccacagguggagcaugcagugagccgagaucgugccacugcacuccagccugggugacaagagcaagacuccaucucaaaaaaaaaaaaauuagccuaaguauacagugccuuugaagucuacaauaguguacaguaauguuguaggccuucacauuucucacacugauucacccagaccaacuucuaguccugcaagcuccguuugugauaagcacccuguacagauguaccauuuuuuaucuuuuauauuuuauaucuuuuauuuuuacuguaccuuuucuauguuuggauauguuucgauaacaaauacuuaccguuguguuacauuuccccacaguguucaguacaauaccaugcuguauggguuuguagccuauacuauguagccuugguacauaguaggcuauaccaucuagguuuuguuuucuaaccuaauuaacuaaugaugcauuucucagaacauauuaccaucaagugacacaugacuguauauguauuacaguuaaaaauuggacaucauagauucuuuuuuaaacagcuuuauugaaauauaauucacauacucuacaauacacccauuugguguguacaguucagugguuuucaguauauucacaaaguugugcaucuauuaccaccaucaguuuaggacauuuucauuaucccuaaaagaaaucuacacaucuccucucagccaucaccucuuaaucuccccauaccugcagcccuaggcaaccaccuaucaccuuugugucucuauagguuugcuuauucugggacauuguguauaaguggaaucauauagcauaauguccauugugaugagcugccuuuagcauaauguuuucaagguuuauucauguuguaguauguaucaguauucauuuuuauugccauaauaguccauuuuauggauauagaacauuuuauuugugaguucacggacauuggacuuuuugauuauuaugaaaaugcugccauaaacauucauuuauguugacuugccuucauuucucugaguauauacucaggaauggaauuuuaugguaacuguguuuaaccauuuaaggaacugccgggcuguuuuccaaucugcugcaccaccagcaguguauuaggguucaaauuuucccccaucuucacuaacacuuguuaucaucuguuuuuugggguuuuggguuuuuguuuuuguuuuuuuguuuauuucaauuauagccauucuacugagugcaaagagguagcucaguuugguuuugauuuguauuucccucacgacuaaugauaucaagcugcuuuucaugugcugauuuggccauuuguauaucuucuuugggaaaauuucuguucagaucuuuugcacauuuuaaaauucgguuggcuuuuuguuguaauaguuguuuauuauucuagauacaaaucucuugucagauacaugauuuacaaaaauuuucuccuguggguugucuucacuuucuugauggugucucuugaagcacaaaaguuuuuaauuuuuaugauuuccgguucaucuaauuuuucuuuucuuguuuguguuuugguguuauauuguguauaucauaaauucuuguuuauuauaaacauuuaaaaaauaucucugaucucugugaaggcccaggcaaacaagauaccauuauuuaaugaaaaauaacugaagcuacuaauguguauuuggaguuauaauccaccuaccucaggccuucccuuuauucuguguccauauccuucaguuuguagugacagaugaaagaagcaaagaugaaaaucgagaaauaauuuugagugaaacauuuuaauuugaagcacaguugucccuugguaucgauggggaauugguuccaggaccccuucagguaccaaauccacggaugcuugagucccuuauauaaagugguauaguauuugcauguaaucgacaaauauccucccauauacuuuaaaucaucucuagauuacuuauaauaccuuauacagugccugcccaucacuugacucuuauggguucagcauaggagucagcaugcagcaaauucaagcuuuacuucugggacuuggggauuuuuuucccccaaauaucuuugaucugcaguugguugaauccacagaugcugaaucuuuggauacagaggcccaguuguaacuaugauccaagaauuuguuauuuauuaugagagaauuuauuauaaugacugcgaugguaguuuauaacuuauaaacucuaccauauuugggaaauucacaguuacaaacauuuaccuaugaagggggagugaguagucauuccuucauuuuuuacaaauaagcugagucguggagaauuuaagugauguguguagaaacucacaguaaguaaggcguagucuucaucacucuuguaguacugcauuaucucuuuguaaaguuuucaggguuucuguuuuauuaaugguuauuaauuuuauuuauuuauuuauuuauuuauuuuugagauggagucugucaccaggcugaagugcaguggugcuaucuuggcucacugcagccucugccuccuggguucaagugauucuccugccucagccuaccgaguaacugggacuacaggugcaugccaccacacccagcuaauuuuuuuguauuuuuaguagagacaggguuucaccauguuggucaggaugguaucgauuucuugaccuugugaucugcccaccucagccucccagagugcuggggauuacaggcgugagccacggcgcccagccaaaauuuguuuuuuuguuuguuuguuuguuuuuugagacgaggucucgcuguguugugcaggcuggagugcaguggcaccaucucagcucacugcaagcucugccuccuggguucaugccauucuccugcuucagccuccugaguagcugggacuacaggggcccgccaccacgccuggcuaauuuuuuguauuuuuaguagagacagaguuucacuguggucucgaucuucugaccucaugaucugcccgccuuggccucccaaagugcugggauuacaggcgugagccacugcccggccaaaauuuuucuuuuuaagcaauauuaguuuaggcuuguaaguagcucacuuaggguaaauauucuagccaagaucaugaaaaaauacauugauuucauuauguucuuaaucagaucugcaucagauuaccauaaauaggcagcuauucuuucuuuuuuuccacaguucauuguauuccuaccauuuccaaauagaaguuuaugguuuuaaauuacugauguuaaguacuuguuuggaaggaauuuauaguuaaacuaguuauaauaauuuauaccugucaagcucuuucauauauaguacauauuuuaucucucauuaguuucuguaagcucuugagagaaagguucuuuuuuauuuccaccuuuuaaguucagggguacaugugcaggaugugcagguuuguuacauagguaaucgugugccauggugguuugcugcacacaucaucccaucacccagguauuaagcccagcauucaccagcuguucuuccugaugcucuuccuccucccacccccaacccucugacaggccccaguguguguuguccccccaaccaccgauguguccauguguucucaucauguaccucccacuuacaaaugagaacaugcgguauuugguuuucuguuccuguauuaguuugcugaggauaaaggccuccagcuccaucuauguucaugcaaaggacaugaucuuguucuuuauggcugcauaguauuucaugguguguauguaccacauuuucuuuagucugucauugaugggcauuuagguugauugcaugucuucgcuauugugaauagugcugcaguuaacauaugcgugcauguauuguuauaauagaaugauuuauauuccuuuggguauauauccaguaaggggauugcugggucaaaugguauuucugccucuagguuuuugagguauugccacacugucuuccacaaugguugaacuaacaccaccaacaauguagaagcauuccagagaaagguucuuuuauuuuuguuuuguuuuguucgagacagucucacucuguugcccagacuggagugcaguggcaugaucucggcucacugcaaccucugucuccuggguucaagugauucuccugccucagccuccugaguagcugggacuccagucaugugccaccaugcccggcuaauuuuuguauuuuuaguagagaugagguuucacuauguuggccagcuggucacgaacuucucaccucaagugauccacccgccuuggccucccaaagugcugggauuacagacgugagccacuccgccuggccuaauuccagagaaagguucuuauauguuuuaugcuauagucccauaguaugggacuacuacuauguaguaauuuucaguucugcugaaaaugcuguagucguuacuacguaguaggcgcagaauauuuguuuaaugagugauucucuauuaaagggucauaaauuugaaagguaaagguuaagaacaauuucucuuuagaguuguacagauuaaaggaagugaacuuuuuuuuuuuuuuuuugugagauggaguuucgcucuuucugcccaggcuagagugcaauggcgcaaucucggcucacugcaaccucugccuccuagguucaagcgauucuccugccucagccucccgaguagcugggauuacaggcgugcgccaccacgccuggcuaauuuuguauuuuuuuaguagagacaagguuucuccauguuggccaggcuggucuugaacucccgaccucaggugaucugcccgccuuggccucccaaagucuugggauuacaggcaugagccaccgcaccuggccaaacauauuuuucuuuaacugaggaaauuagauucauuguccaaagcuuaaaaggaagauuuucuacuuugaguuuuuauuaacucugauacuuuacuaugacaguacuuccagccucugagacaugagaaauagcgugagauuguaguaaucaaaaugaccuuaccagaaaucaccaccagguuggugaaaaacaguacaucuacacagaaggauggacuugauguugauucuuucaagauuaaagaugaagaugcccgaacuugaagcaagucuuuuaucaaaaccguacauaaagcaaaacacacuguaugauacuguaaugguggacacauaucauuacgcauuuaucuguagaaugugcaacaccaagagugaaccguaagauuaaaaaagaaacaacaacaauaggcugggcgcaguggcucaugcugguaaucccaacacuuugagaggcugaggugggcggaucaccugaggucaggaguuugagaccagccuggccaacguugugaaaccccaucucuacuaaaaauaaaaaaauuagcuggcugugguggcgggugccuguaaucccagcuacuugggagacugaggcaagagaaccgcuugaaccugggaagcggagguugcagugagcugagaucaugccacucacugcauuccagcuugggggacagugagacccuauaucaaaaaaaaaacaaaaaacaacaaaaacaaaucaaagccuguacauaaaguauguacuguugccugcaugccauuugucaguuuuaaagauuaaccauggucaguuuuuaaauguaguccaguauauccuugguaccuuugaguucuugggcuuuuuccuuugcuguuugacuaguaagcaaaauguaauaaaaguaauuagcauauugcauaauaguccacauaguuccauucccaaauauuacagagaacuccucauuuuuuguaauauuggaggcuguuauaacccugaagucuugaacauuccuuacaaaucucuugacaucuuuuguucuccaucugugaaguuagcuaacaccagaauuccuguauuaugacuccucccauaacaugugcugucucaccucaagaaaacugaauuuucacucuuccauguccaauuuguaaauaauucaccaagaauaacauuucaaaauuuaguucaaaauaacagauguuacuucauaaacuuauuuaaaaaacacuuggacauucaucucccauuuggauguagugauuuugacguaaucacuuugauuuucuuaaguaaauguaaguaggcuauacauauuuaacuucggggcauaguaacuuuuggguacuuacaguuucagcauugagcuaguuuacgaagcagaacuaacauuugaagacagcuucauucuuuagucaacauaaaaauuguuuuugucaaaguaacuguauguaggaaguaugugauccuuuuuuucuuaaaaaaaugagcuccaaauagccauuuaguaacacuucauguauagagguuucugugagaucaauucuuccaaguguucaaaguguaaaaagcugugaaacacccauuaaguggguguuuggaaugaaaggggaauggaaagagaugagauaaaaauauuaucuaaaauauugcauagucguggcugcugcuuugcuaagcaacacugucucuugguggucacauacaugaagacuuguuucaaauucaugaguauagucuuaccugaaggaaaacaaggcaaguaaacuuugcaaauacuuaauuucaaacaaacaaacaaaaaacuuuaagaaagcacuacagcuuucuuguugaaaggcgcuauagaguuagucacauauucugagauggcugucaaaccaugcaauauguuucuauauaucagaugauuuuuuuuuuuuuaaauugagauggagucucauucaccgugucacccaggaaggagugcaguggugcaaucucgacucacuacaacccccaccucccggguacagcauucuugugcuucagccuccugaguagcugggauuacaggugcacaccaccacgcccagcuaauuuuuguauuuuuaguagagacgggguuucacaauguuggccaggcagaucgcaaacugccucaaguaaucugcccgccuaggccucccaaagcgcagggauuacaggugugagccacugcaucuggcuggcauuauuucuaacacacuucuguuaaauacuuccuucaagaacaauaucuuugucauagaauaugcuacauuuuuuaaaaacaaauuuauuuaucaaggauggcauucaaauacccugguaauuacaaaacugcaaugauaaaauacaaaauauugaacuuaaacaguuucucugagcuaaauccaauaaauaaaucagggaauuuguuuucuuaaauaauauugaaaagauuccuggggccaggcccgguggcucacaccuguaaucccagcacuuugggaggcugaugcggguagaucaccuaaggucaggaguuugagaccagcguggccaacauggugaaacccugucucuacuaaaaauacaaaaauuagccaggugugguggugcacaucuguaaucccagcuacuugagaggcugaggcaggagaaucacuugaaccggggaggcagauguugcagugagccgagaucacuccauugcacuccagccugggcaaugagcaaaacucuguccccgccugccucccccgcucccccccaaaaagauuccuuuuugcuauuuauugcccuguuuuugaugacuaugguggugguuggguuauuuugguauuuacuauuaauacaguuuauaaaaguaaacaaauuuucaagcuugcuuuuauuuuugucauauaaguaauuuaaaucuuaucaaauucagaucacagaguuaacuucauguauaacuuuucuugcuuuguaauaucuagauuggaggcugaaauaaggauuuguucucuguuaaaagcagaaagaccuugguaggagcacagggaaaacucagcuugauaaagauaccaauuuauuuucauuuaucacauugucugcucugacuuguucccuuaaaauauuuauaaccuuuguuacagugugaucagucuaaucuaaaguuuauucaguugagguugaucuauguugaggaguguguguacauauauacauacauguauaugcauaugacauuugaauaugcuuuuuugccugucugguuucaaugaaagugugcuauauuuaacaccaauagacuauuauuagcaucagaaaccuggagcauugcuaaguuuccaguauugauuagauaacagcucaguucugccagguuggacauaugguaaagauaaaugacaaguauuuuaagguuaacccucccccgcuuaaaaaaaaaaggugcaggaaaaaaaguaggggaaaacaguagacagugcacccuaguuauugauucuuggaaagcuaaaaucuaucguguagcaccugaacauuauaacacuuuagaaaauuaagacauuugaaggauguaagaauguaucagcaaggcuuuggcuggggugcaguggcucacgccuguagucccaacacuuuaggagcccaaagcaggcagaucacaaggucaggaaaucgagaccguccuggcuaacacgaugaaacacaaaaaaauuagacgagcucacaccuguagucccaacacuuugggagccgaggugggcagaucacaaggucaggagaucgagaccauccuggcuaacauggugaaaccccaucucuacuaaaaauacaaaaaaauuggcacacaccuguagucccagcuacucgggaggcugaggcaggagaacugcuugaacccaaggggcggggguugcagugagcugagauugugccaccacacuccagccugggcgaaagagcgagacuccaucucaaaaaaaaaaaaaagagagaaaagaauguauuagcaaggcuuucaaacaguuacccuaaaaacuaaauacaggcacaacauaacuguguagacauaauuauguaucacauguagguacuuauagauauauuuaugcagaguauuuuuaguuaacauaucugacugugacaacaaaauagucauuuaguuugaaaaucaugugcccaaauauguguuuugcugugguuacccuggagacuuuggaguucugccaugugauuuccuuaaaucccuggaauuuuugauugcugagaauucaggaggaguugcccacuuguuagugugcagggaaauguguuuuucucauuucuaguugaggucauucuuuuuuuuuuuuuuuuuuuaaaccauagcauguguuccauuaguuaugaauguauuauuucuuuagagucaaaauucacaacucauuucuuugaauauuaucucugauccuagaugggaucaaaauugcccuagauuuaggaguuuuaaaaguuuacuagguuguggggaagauggguuuauuuuucauaaacuugaacuagaauguugacgauuauaaggacugggacacuuccuaaaggucaaaauauuuuaaggcgaaaguauguauucuuuccuuuugccuaaugauugaaagaaaaagugguaauaugcgcuugcuuucuauuaugagcuuuaauuuguaauuugaugaagauuuuuguuaacuugcuauagguagucagguaaggaaacaguggugccagaauuugucccugauucaguauaguucugugcaggucuugaguagaugaauuuaaaugcuacuuuauuaguaagaguuagauggucagccuuguacugagaaccuccaaccuucuucccagcuuuauuuuucuacacgcuucccaucaucugacuuacguguuuuacuuguuuacuagaauguaagcuacauacaagcagaguuuuuaaaauuuuuauucuguucauugcuuuauucugaguggcuauuaucguuuaccuuuuuuccuuguuuucuaugcaaagucucuuaucagccacuacuugcucauuuccauacagggcuauaguucaacccuuugcugauaccauuuuucuuauagaaaaaguucuuccaaaacuuaucaauacuguauucaucauuaaugccucuuuggaauucucucauucuccugacuauugcugaacauagucucuucuuuuaaaugcugaggaagcacucauuugacacuuugcugagauguuuaccuaaacuacauuuuaaacuuuuuaauuacuacuguuuuuacuguggaaaggggugugaaaguguuacagcccuuuacuauugggaaaucuaaucagauaaauuucgugaggcuaggauggaaaggaaaaacuuuacaaguuaagcaaagggacuguuaauuaacuguuuaauaacucuaacgacaguuaugaccagagcaacauaauagauaaaagacaaucuccacuaagagccuucauuggguaauaguaugacuuguaguuuuuuuaaaaaaugcuaauaaucucagguuguauuacagucucaugguuauacagauggaugggaauaucucuauuugccuaggaucaagaggcuaggugaccucuuacucaaugggucguucuuuguuauauguauuaguauauaguaaaaggaaauacuuccuuuaccauaaauguuauuuuauuacguggccauguaauuauggucucagcuccuaggaucagaggauuuaaacuuagaagacauuuuucggcugggcacagugacucaacaccugcaaucccagcacuuugggaggcugaggugggcggaucaggaggucaggagaucgagaccauccuggcugacacagugaagccccaucucuacuaaaaauauaaaaaauuagcuggcaugguggcgggugccuguagucccagcuacucaggaggcugaggcaagaggauugcuugaaccugggaggcggagguugcagugagccgagaucgagccauugcacuccagccugggcaacaagagcgaaacuccgucucaaaaaaaaaaaaaaaaaaaaaaaaauuaagaaggcuauccucuacccuaaaaaggauugguaggcugcuugaaugaaaugauaauaaaacaccaguuguuuaaauggggcuccuauacacacuuuguuuuaaaaagaaauaucgaguuguggagggaagaggaugaaaaacauuuugaguaugucuuuguaacuaaaauuuacuuggauucacuaauggcuuuguuccuuuauuguaauggaguaauauuuucuaaaacaaaaaguuguaaugguguucuauaccuuaaaugucaaaaaagauuaaguagucucaauguguuguaaauaaaaaugaaagaaauggucaaucugugcauuagauuguguuuaaucaaaugguaggguaaaacuacgcauaccagaugacagcauagcuuuaaaaauguggcuuggaauaaagucuuucaaaaaugguuguguauacccugucuacaaaggagguaugauacauuuguauuuaucuuuauucuagauaaaaugaugguuuacagggggagaaaaugaagaaaaaauugugaaugucuuuuuuuuuuuuuuuugguaagacagucuugcucugucacccaggcugcagugcaguggcgcgaucucggcuuacuacaaccuccgccucccggguucaagcaauucuccugccucagccucccaaauaucccaaguagcugggauuacaggcaccugccaccacgcccagcuaauuuuuuguauuuuuaguagagaccggguuucaccguguuggccaagcugaucucgaacuccugaucucaggugauccacccgccucggccuccccaagugcugggauuacaggcaugagccaccgcgcccggcugugaaugucugcucuuaauacuuugacucauuacugucauugaguguauucauuuguuuauuuuauuuuauuguuauugaaacuaguuuuuuguuuuuauaugccauuuucuucaagaugaaaauuacggauaacuuacagguagacuuuuuuuuuuuuuuuuuuuuuuuugagauggagugucacucugacaccgaggcuggagugcaguggcaccauguuggcucacugcaacuucugucuccuggguucaagcaauucuccugccucagccucccgaguaucugggauuacaggugcccacugccacacccggcuaguuuuuauguuuuuaguagagaugagguuucaccauguugaccaggcuggucuugaacuccugaccucaggcgauccacccgcuuuggccuccuaaagugcugggauuacaggcgugagccaucgcgccgggcccagguaaacuuuuguuguuguuguuuguuacauuugaugucuuucuuauuuugaguuuaaaagaccacaguuugcaaaauauaacucagugaauuaaucaguuauuauuugauaauuugauuauuugauaauaaccagaguuauuugauaauuuuuaaguuuucuuauaauuuagaaauacagggugaauaggcaaaauguaaacaaaaaugguaauuucauauaaaaaaguaucugguguuuaaaaaacuuuguaugcaucucaaaaucaugauuaaaguauaguuuuggcuuauuaaaguguuauauaugucuucugauauuaaaauuuguuuuaauuauccaaguaauccugaauccauucucaugggaagaaagauacuuaagucaauauuaaaauacugaaauaugugaagaguuaaaggugaaagucauucuguacaguucuacaaaauucuguuucucuguucagagcuacugcuuauaguuuaguguuuaaucuugcacaccuuuugcaugcauaaaccuuuacaacaauuuguuuuacuuuuuuaaaaaaauaaauggggcucuauuuuacaaugugucaauauauuaauuuuuuuucaugguuacaauuuuguaaugguucucuuaaugauggauaauuguuuucagggguuuuuuugcuaugauuuaaaaaauuuuacagugaauacuguugagcuacaucucuggauauuacuaucgauuauauggucagugcacuuguggcuuuaugaauauuuuaaauaauguagucaagucuguugaucuuuuuccuugucaucuguguuuuguggauuuugguauuuccaaacuauauucauuucuacagaguuauuuucauuuccauuuuuugaacugucacuuguaaaacacuuucuuuuuauagaaccuuaugagugauagcaagauguauuaguauguaauacauugugauggaguguaaugaucacaaggaucagugacaguuuugaugaccaauuucagaguuauaaaauaaaugaaauauauucuggaaaagucaugggcuuuuuguguuguuuguggaaucacuaaagguagucccucacuauuaacaaauuuguuuugacacauaauaugugaggcacugaauuauaauaggcacuagaaacauugccuauuuuccugaauccuuuagacaggauugcuuccccaguuaccagagauuucucuaaccuugauuuacaguagcuacugcugguaggaauugcucuccacuccacuuuugcugccauccaguguuacauuacccuacaaauauacuaagugcuuagcaaagcagaguccaaauguaagaucaauuuuugucuuacccagaauuuuacaauuaaaauauauaaauaaaagauuucucuguguguggauguauguguacaguauaguguugcaugcuauacauggggugagguaucagaaugcuuuuucaguguuuggcaccucuaauuuggcucuguggccauuuauuccaccuuucuaccuugaaauuccacaacuugggcucuugaaauuaccugguauggugcaaugcacguguauucucagcuacuccagaggcugaggcgggaggaucacuugagcccaggaguuugagguugagauugagaugaacugugagaacaugcuacugcacuccagucugggcaacagagcaagaccucaucucuaaaaaauuuugggcuugaaacgggcugauuuuguccuaccacuaguaaucacuuuuagaaguagcuuacaauugcuguuucuuccuucuuauggggggaaauacccuuauaggagguauuaugaagccaauaucuaauaaacucugucaucauuagcucacuuccacucuucugccaucucucuguaccugauuaguauaguuuugaaaaauuauaauuuugcuaccacugcaccucuccuuguuaguaggggagauuuauguaagagaagaaucuuuuauuucuagacaagguaauaucccauugggaagaaacagccaagggagaagaaauguuuuuuucuucuuugaagggacuagaacuuuuauagcucagcaaauuugaauaaguuugaugguaauucagcuacauuauauuuuagcuagauuucugaguucauuugguaaccuaaccaccacauauauaccuauuuauaacuugaaauuugccuuuaaagucacgaaagcacaaagcacuguggugcuuguaacacucuuccauauuauuauagguaacuaaaugaccauggaaucuggagccgagaaccagcagaguggagaugcagcuguaacagaagcugaaaaccaacaaaugacaguucaagcccagccacagauugccacauuagcccagguauaaaauacauggagagauuccaguuugugucucuuccuagaggaauacguuuccaagagaauuuaguuguuauuacauagauauacauagaaugagcagagauacucuuacaauaucaaaauuccuauuuacuuaguauuagaguauauuuagaaaugauaguauuaauucaauaacaguaaaauguauuauuaaacaauaauacaguauuuuuagugaaaugauccagaaauaauuacauuuuaaacuuauggguaaauggugcucucagauaagggaagaaaaccuuggcuauguaugacaacugcuuuuuuuauuuuuuuaauaugacacagauuuauuuuuuaacagugggaaugcagauaauaugaaagccuaaguuuauauaacuaaacuaaaaauuaggauaagcaaauaaauugacauguaaggaaauuuuaaggaugauagcaguuuuuguuuccuguauauuuuaaauauaauuucugauucuuucauuucaucuuucucuuuaacauccuaucuuuaagaauauuuucucucauucuuauguuuuuguuugcaugcauucuccucaacuauuuuauuaacagcuguuuacauagauaggaaugagaaaggugguuaacuuaaaaaacaaauagcagauacagaccugcuagguaauagugugauaccgucucuuucagaugaagguucccaggagaauauaauccuagcagaagcucugauauauguagcuucaguuucuccaagaguuuaaaaguuccuagagaagucaccuagcaagaaugaaucaugggaaauagaggacucaccacacuugggugucuggcugagguagugugagccagauacuggauuuccagcaagaauauagucagaaggagugagcuguucuguguuuucuccuaagaccaccaggguuuaccuccagccuucaggaauaagacaaagccaaauacaucuaauguacucauacgaggcaggcugcaggauugaaggggagagagccaggacuuccaucaauauagggucaacagauaagaaucugggcucaucuguauauuuugcccuuuagaaagaggaagacacaaugcuaggccgggcgcuguggcucacgccuauaauccaaacacuuuaggaggcugaggcgagcgaaucacuugaggucaggaguucaagacgagccuggccaacauggugaaaccccaucucuacuaaaaauacaaaaauuaaccaggcgugguagcacacaccuguaaauccagcgaccuuagaaggcugagggaggagaauugcuuaaguccgggaggcagagguugcagugaacugagauugcgccacugcauuccagccggggugacagaacaagauucccucucaaaaaaaaaaagaagaugcaaugccagcaggcuucuuuaugaugauagcccuuaacacaucuuaucucuggagucacacuauuuuguccagucugguuguccccagaguaggcuguauugugucauccugggaauuccuuucucccuacuuccauuuucucacaguuuguguuuuugauaugguaaagcauguuuuucagugguuuuaugagaaagaaagguuggcugaguaaagauagcauguuauaaaaauugaauguaugggccgggugugauggcucacaccuauaauccccacacuuugggaggccgaggcaggcggaucacgagguuaggagauugagaccauccuggcuaacacagugaagcccgucucuacuaaaaauacaaaaaaauuagcugggugugguuaugggcuccuguagucccagcuacucgggaggcugaggcaggagaaugucaugaacccgagaccgcaccacugcacuccagccugggugacagagcgagacuccaucucaaaaaguaaauaaauacaaauaaaaauugaauguacaugugccuuaacaucuagaagauguacaacaaaaauauuaaaagugauuagcuaugggugauaggaauauaaaggguuuuuauuuuauuuuuuauaucuguauuuuauaaauuuauaaugagaggagccauuauauaaaauuauuaguguagaaaagggauuauucauugaguuagcuagguauauuuucccuagagaagacucaggaaagagaacauaguaauugcuucaaauauuacaagagcauuuauauggaauugagaugagauacucugaauaagguuaugguucucaaacuucaguguacgggaaaguaugauuggguuccuguuagaguugacuuuacagaguauccugugugacucuaaugaagcuauuccauggaccacauuuugagaaucaaauaaaacuaagcaagauuuauaguggccagagagaaagugauuaauaaguaaggacuuuauuacuauccagagauggaagcuucugguuuuacccuauaugccaaagacacugucuuuauagggaucuuccccccaggcuucacagucacauauuucgcugccugcuaaaauaaacaucucuacaaauucagaugucagaguaguuucaucaucuuccauuacaaccccagucacccaaaagccuauccuuacuucuugcauucucuuuuucaauuaaggacagucugccaauucucuuucagacaugaaacauugggucaucugcaguuccucucucaccucuuuuaacuauucauaaagcccuuucuggacugcuuccaaauuuucauaaaaucacuucccucguucccaucucuacuacuacuaacugcccucuuuuuggccuucaucaucuuuccuuaacuacuucaugggcuuucuucguuggucuccccaccaccaguuuucccccugaaauauauaucuuucacacugccacuaaagugauuuuuuuuuuuuuuuuuugagauggaguuuuguucuuauugcccaggcuggagugcaauggcgcgaucucggcucacugcaaccucugcccccuggguuuaagcaguucugcuucagccucccaaguagcugggauuacaggcaccugccaccauaccuggcuaauuuuuuguauuuuuaguagagaugggguuucaccauguuggccaggcuggucucgaacucuagaccucagaugauccacccgccucggccucccaaagugcugggauuacaggcgugagccacauugcccggccuaaagugaucuaucuaaaagcaaacaucaccaugguauucaggaguucaaaagcccuucaguggcuucugcaauacccucaggauaaaaugcaguuucucugaggugacauaauacaggcuuuuugugacuagcacaucuagccccaccugccucuguuguuuucucucucccuacuucauacaucauacaguaacacacuuaugugcaccauuggugcugagcugcugguuaucccacucugccaugugugcuguuucucuuugcuuuugccacuacuccacucugugcuugaaauucugugacucuucccuguaaguaauaauaacaagucuaacuuuuuucuuuuguuuuaaauucacauucuucccugauagccuccccuucucuuagguuggguagaguaauucucaguguguccauuuuucuuuuagcaaaccucauuacuaaacugaauuguauugugucucuuuuccccauuccuucgcauacauacccccaauaauuuauuugaggucagagaccccuaucuuucucacuuuuguaguuucaguucuaacauuauuccuggaacauagguccccaauaacuguuuccugauuuagcaaauaaaauuccuauccuugaauguguucaagcauaggagcaauaaauaacaucugauagacauguaugauuuaaggacccuuuuaaccuggguauugacucauuaaaacugccuuaguucuagacuuaguaggucagguuugcuuaugcuugagagcaguuagauuuuagaacgugacuuauuuaacaugauauucuuuagaauuuuauguuucuucaaggauaguauaucuguugaccuugggugaacacuuaaucucauugagcaguuauuuguguuuuuaaaaauggagauccuuaucacccagucuucaguuucuucaaauagcaaaaucagaaauuggaaaugaaagcaggugggaaaauguaaagugccauacaaauaaagugauaucucauguucagagagucuguauuacauauuugguauaacaugggaauaguuuuuaauuuuuugucacuugggaagagcugaaaaggauagggguauaguuuuugguguuuuuuauaguguuuuuucuuaaagaauauuaaauuuagucauuacuuucauaucagugaaauacauaucuagcaaaaaggucacguuuuugcuucuaaaaaguuauuucauauugaacaugaguacugccaaagagugucugggaugauaauucuuuucuguguucaacaccauagguaucuaugccagcagcucaugcaacaucaucugcucccaccguaacucuaguacagcugcccaaugggcagacaguucaaguccauggagucauucaggcggcccagccaucaguuauucagucuccacaaguccaaacaguucagguauguguauaaaaaguucugcaucuauuuuaauaacuuuuguuuauagccauaucucucuccuuucacuaguuaugaaaauaaggacacaucuaguucaguuuauuuuauucacaguauaggaauaugcugcaucuguauagucaccuuauguauaggaacauauauacagaagaacaaacauaaaagaaaaugacuaauuucuuaagcugcagaggaaaaagaauugauuggggaaaauaaugaaguacaugagauaaaguggaaguguuugggagaaacuguaggacugaaguaccucagucgaggaaaauugagaugcaaaaauaguaacuaauuuucuaaaucugcaauuggagaaaaauauacccuugaucaaaaauuaauaaccuuaccuaagauauuauuugaccuuagagauuacauaaagcauuuguaaaaucagcugugcuuaggguuuucaguuacaguguguaacuuugaaauaauauauucagagguuacaucuuaagggucaggaauuauacuaugcauguuaucuaauucuuuggagagaucuuuccuuuggguuugauccacagguaauaaaggcacuguagaccuuugaaggugacuacucuguuuaacuguagggaaccgagagcaguauagaucauugcaauugagcuuauugaaaaaaaagacuugaacguucauucaaguaggccauaaccccagccucccauuucauauuuuuugcuucacagucuuccuguaaggacuuaaaaagacuuuucuccggaacacaggugaguccuagguccuagauuuggagagaacuauuauuagaaaggaaggugagaaauuauucuuuaugucuuuguccuuuuccucuauaaacauggaauuucaacacuugaacaaaaaccucagagaucuucugggucuaggccauacuuguuaccuccccagcccuuagucuguugcuuaauucuguuuaacauuucuccccucuuccuaaugguaguccagcauuuacuugaacacuuucagagaaaggaagcucaaucuccugagguaaccuguuuacaauuaggagugauugcuaaaauauucuucucugugaugauccaaaauauaucuuccuaaaacuuuuaccuagugaucccggguaaacacagguucuauucucggaaacuagauuagcaagucuaauuccuguucuauuggacugcuuccucuuccccaucccccgcacccuuccuauuuuuaagaaaauuuccagacuaaacaaacuauuuuucuuuagccauuuauuagaugguauaacucuguuuccucuucaccauccugguuguuuucuucugggugagcgcuguuauguuuucuuuacauauaguaaccagaacugauuaauauuuguagaggggagaagugcugucuuuguccuggaagcauucuauuaauguccucaguagaauuugucagccauuuuauacuauugagucaucgaacuucuauuaaccaccucuacuucauucugucuuugugcuuuugguucacuuugacacuuaagugggagcgugggggaggagaaguaauguuuuugugugaaaucaucaguuggaucaauuuccauaagacacugggaauggcauuuguuaacaaguaaaagauaguguugugcauguaaagaucuaagaacuugauauuucuaugaaaucacaaugacugagcaauaguccuuugccuuaguuuuuauuccauugagugcuaccuuaccauuguccauacugugccauuacuaauucccuaaccauaugcuccucuuaguaauagugagaaaacuugauuugcuagugaggagaccuagauuccagacccaguuuggacauuaauaagucaaauggccuugggcacaucuaccuuucucuuuuucacuuauagaagaucuuucuauaaagaacacaaaaauuacuuaaguuacagccacaaaauuugcuaagauuacuguuuuuuauuguaauauguguuauuguugauuguauucuugauuuuaaucuuuauucuggggcaacauaauuuggacaugaagauuuuauggccauuaaguauagaaauauucucuuuuuuuuauuugcuuguauucaucuuuaaggaacacauuuguccauuaagguccauuaaggugagcuguacuucuaauuuaagaguguguauuuauaaaagaaaaguuggacuuauugaacccuggauucuacaaauagagauacaaauauaauauuuuuuucuuuaaaaggccuaaacuauagaauaucuauuuuaauaguuaucuuagccaguuaauggugauuaguguuaacaacuaggaaauaguuuuuaucaaaagagaugaucaaacaaggagaggaucuucuagaugggagaccucauuaauauuccagaauaaaguuuccaaaauauacaagguacaguucucuuguugugagaauagauuauuacuuuaaauuaucauucauuccuacaacaaauguuuauuggugacaugcuaugucacuguucugcuugcuauaaaagacagcaaugagcaaauaauacuucucuguucucaagaagaucacauuuuaaugaaaagagacagacuaugaaaaaauaaauugugucagguuaggagaauuaacgagagagaugaauaaagccaggggaaagggauggagaaugauguggagggaaggguguucuacuuuauguaaugugcucagggaacacagcacagaccagaaggcaaugaaggaggcuaaggcaugcagaucgaaagguuuggaagugaggguauacuugggauaucaaggaauaacagaaagguauggcuggaauagaguaagugaggagggaagugauuggagaugcaauuuacaacguaaguuugucuccuuuaaaaugucaaaucuacguauuuuaaaacccuaggaauagaacuuuguaaauuguucaggagucuuccggaguuucagcagguauugaacuuauuucuuaaaaauacaaaauuguaaccccuuccuauuaacauggaauaaacugacuuagagccagggagaugaaaauaauaaacuagauaaaucucauugaaagcuugcauaauugguagaugcaaaugaaaaugauuauuuaguaagcauaccucaaaugcaccuaguuuuguuaucuacaugaaguuuucuuuuucaaugccagcaguuguuaaaucacauuucagaaaacccaagcuuagaaucugacuucuaaaugacuguuauaaaguguuaaaugaggucagacuccguggcucauuccuguaaucccagcacuuugggaggcugaggcgggcggaucacuugagcucaggaguucgagaucagccuggccaacauggcaaaacgccaucucuacuaaaaaugcaaaaauuagccaggcguggugguaggcaccuauagucccagcuacucgggaggcuaaggcacgagaaucacuugaacccuggagacggagguugcggugaaccaaaaucaugcugcuguacuccagccugagugacagagugagacucugucucaaaaaauaaaaguguuaaaugauuuuuaaugaagcauauuaugucauucucacuauccugaaaaauaauauuauuuaucuuuaagaaauauauaaauuuuuaauauuuaugcuuaucauaucucuuuaagaacucuuguuuuauaauacgaauacuuaaaauuuagaaauaagaaaaauguaugccuguguaaaauuuuucuuauuuauaagagauacaugcagaucaaaagaguuggaagaucauugaucuagacuuucaguaagcuucuugauccaaugaguaaaacacuguaucuaaggccaggugcaguggccuauaaucccagcccaggcaggaggauugcuuaaagccaggaguucaagaccagccugggcaacauagcaagacccugucucuacaaaaaaauuaaaaauuagcugggagugguagugcaugccugcaaucccagcuaacucaggagguugagucuggaggaucccuugagcccaugaguuugaggcugcagugggcugugaucgcaccacugcacuccagccucggugagugagugagauccugucucuuaaaaaaaaaaaaucuuaaaaaaaaaauauauauccaaaccaugagucucaacucuaccgagggauaguacuuaaguuuccaaaggaccauauauagguuuaggaaacaucgaauauuaccauuguuuugauugguucuaguuacuuuauaguuuauuuuaaaauuucaaauaaucgaaacgggguccuccaccuuuccaauauaaacagguaguauggguuuuaaauaaaccaaaguugagaaauacagaccuaaaacuuuauaucuacaagugguaguuuagcuuuuugaaaauuucuugacuuacaaguggccaaaauuaaagaccuauuuaaggaauucagaaagaaguuaauaagugauaggagaugagaauaaaaggaagggguuccaucauuggaaugugaugaugauacgugauguuuauaauugggauauaauuuuucauaugauguuuuuauucuguuauuuauaaaaauagauuuuugacaugauuuuuauugaucucaguuauguggguccaguauguuuuuuuuuuuuuaacaucaguuuuagguucacagcaaaauugagaggaagcuacagagauuaccuguauacucccuccccaacuccauggauagcuuccccuguucuuaacauccucccccagaacgguacauuuauguuauaauuugaugacccuacauuaacacaucauaauuacccagaguccauaguuuacauuaaacuucauucuuggcuugguauauucuguggcaguauuuuuauuauugauuaagugauagaucagggacuccauaggaauuagcuucauggcuuacuucucuucagaugguauucccaaagaggaaguguuguguuuauuucaguggucugaauucucuuuacauuuacaaaguugcaagcacuaaauagugauaaguuaauuccuucugugugaauugacaaaaucuuacaggucagagaaaggcaaccuuuuuuuuuuuuuucauuaagggccauagauccagaguuagaaaaaaaaaggacacagauuaaaaaacaacauuaauuuguuucauuucaaaacuauccuguggguaguuuauauggcauguuuuaauguuguuguuuuagugaguuccaacuuggaagggggguguucccuaaucacuauauguccuuaagagaagcauguaaggauggggcauaugagagucaagcaguggacacagaaagagccacagaggagcuaagugaauucugaguggcguauuaaugaagggaaacaacacuugucacaguacuaucaacuuugaguucagucuuguuauuccuugaauuucugauccuuuccucaggccuuuucauagcuccugaucuucuguaugugagaaaguuugugcagagacucuugugugugggcuaguuacagcagcuacugauuaacgugaaacuuuucugugugcuucuuuggcaguaauuacagcauuauuauucugcugagaaucacagacuaaauucagcauuacucaucuuuuuaucugucauuugugaauucauuauauguugccuauugauuuuuaggucuuucagauuguacuuagacuuuaaaguguuuggauggggcaaauuacuucauuauaaauauauuuuacuacaaguuacuaacuuuaccugguuucauuuuaaaugagcaugcauaucacaaagcccuguaaaaugaaugcccacuugggagaacuguuaggcucagaccacacauagaguacgcuuggaauuucucaaguacuucugaauauguuuucuuacugccauugccauacguuuugacguggagcugaccuacauagacccuuuugucuugguuaaguauaauucuuacucugaccgcauaaugugccccuaguucaggaaagagcauaacguuucugcugauuagagaaacuugggcaguguaaauuugacaaucaagcauacuuagguaagugaacucuucuagucuagaaaaggugugaaaaugccacugguugcugcuucugacaaaccugguuugagacuauaacagucugguuugagacuggaaccaccaggauuuugaugcugguaaggaugucuaaaauggagguuaaugacaguggcuccacuacuuccuagcuuugugacucgggugaguuacuucuuugugccuuaguucuuccaucuauggaauggauauaauaguauaguacccaucuggcgccuacauuacugugaguauuaaguaauguaguauauguaaaugcauuagcauaacaccuggcacauaggcaucuguaaauucuaguuucuaucauuaauaucccauguaaauuuuuuauucacuuaucuucauuacuuuucagucuagguauucuuaucagaaaagcauaguucuuuaccuugaauuuuuacuuaaaagugauuauagaaugcuaacuuugaaacauguuaggaguuuuuccuaacuugcuaggaacaacugucagggaugucaugauggaucgccagucuuacuguacaacuguaaauauauucauaaguguuuauacaguuaaauaauaauauuuguauagucacuauauagacuuaggaccaaauauuuagccauccauuuuauccuuuauaucagaaaccuuauuuuaguugguaguuuuguuccaacagauguaagaaaaaacugauaaguaauacugaugcauucaggauugauuacauggaguccugaaaaaaaaauuaaacugcagcuauuuuagguucucuaacuucaucguaguuuauaggguaaguaaagggaaggggaaagugauuggugugguugucucccauaagaacugauuuuuuucuacugaagcauguauaaaguuuauauaugacuuuuuauauuuguuuaauaaaaauuuuacaggaacuaaauuugauuaucaauaugaaguuuuucuuuaauuucagauuucaacuauugcagaaagugaagauucacaggagucaguggauaguguaacugauucccaaaagcgaagggaaauucuuucaaggaggccuuccuacagguauggaauuuaauaguuagaaucaaagauguggaggaagucuuagguaguugcagauaaagagaugucagaagaccaguuaguuguucacgucaguuccuuauagauuacuuuucuucaucuugaguuauuugucucaaauaaaguggaagcuuauccuacagaauaagaagagcacuuguuacucucaccaguccuaauuuuuuuuuuuucuguuucuguuucuguagacugugcuggcugucuuucuguuaaaaguuuggaauacaguugauaagguuauagcauuuuuuaguuauaagccaacucugaggcucuguuauuuaucuacuuaguaacacauugcaaaccauuuuuuaugccaugguacuuaacagauagcuauuaauuuaauaauugucucagggagaugcuuuacuaacauccccuaauuuuagcaguagcuuacuguaauuuuuguguucaguuauagauguugccuaguccaugccuugccuccaaggugaaccaaaaccauuuuuuaauguaaaaauuagcuccacauuaaauaucuucaggaagggcaguuccauaaaucuugauaaguuuacuucagcauugaagaaacuucagacucauaauuaucuuccuuguuaguguaaauuauuuuuuauauauuccuauuuuucaaagggaugguuuuuuccccccgcuuggcuauuaaacuaacccuuuucucuguccuuacaauuaaauuaagaauccuaagugacuagcaauaaauagauuuugaggucuaagaaauuuuauauuaccaguuuauguuauauguauuuauauucauaauuuauuuuaaguauagcuaguguuagauuuuaacuuugaaguauaucuccuguuaguauauaacacauuugauccugaagcaaauccaaccaaauacuacuaguaaaguaauuacacagguaaauauaaaagccaggauuauuauaguuuugguuuguaacuccuuuuuuuccuaugugauuggaaagacaaaggcauagaacaauaacuauaaauuuaugugacuaagcacaugauauaugaagaugucauuuuugacaauagcauaaagggacagaguuuauaacuaguuuguuacaaauuuaagauaucaaaaauuacuuggguuaggguuuuuagggguuuuuucccaccuuucagugugauuauguuauucauuugaaauaugguaugguuccuuuguuuuuggguuccauuuuagaguuucuccacccauccuuguugaucuuuauuuuuuuuucuaguaagugaaacauuuaacacuguaccaaaagucagaauugcacaaaaaaaguauacucaguagugccuccccauuccuucugucguuuucauuucuuuccuacccauccccaguaaauagcuaaaaccauuacucucucguuuauccauccugauuuuuuuccuugaacaaaugagcagauacaugucuguuuucauauuucccuuuuuuccuuacacaaaagauaugcuguauccauuauuuggauguaccauaguugauucaaccacuugccuuuauaugggcauauagauuguuuccaguauuuuuuuuccuuuuuauuuguuuuucuauuuuagaccuuggauauauggcuccaguauuuugcaguuacaaacagugccaaugggaauaaucuuaagcgaguuuauuuuaauauuguuggaauuggggugaauuccuggaaaugggauugaggcacgaacacccauauuuccuuaaauaucaacaauuccuuauaucgggauugugccaguuuuauacucccagcagcaauguaugagagugugguguuuuuuguuuuuguuuuuguuuuuuuuguagcuuugcuaacagauuuuguuaacacuuuuuuguuucccaaucugagaagugagaauuuaaaaaucagguuuugaucuuuuuucccuuuaguugauuguugacuuuuuacuuuccgacuuuguguauguguucuuugagaugcaaaagauuuuuuuuaauguagucagucuuauuauuacccuuaauugcacccuuccuuacauugagguuaaagauaauacaucuuuuuuuuuguuuuuguacauauuuggguuccuuuugacaucuagaucaaucccugacccaugaagaguuuauucauguaauuuauauauuuuaaacuucugcuggcugggugcaguggcucacaccuguaaucccagcacuucgggaggccaaggcggguggaucacaugaggucaggaguucgagaccauccuggccaacauggugaaaccccaucuacuaaaaauaccaaaaaaauuagccaggcgugguggcaggcgcccguagucccaccuacucuggaggcuguugcagaauugcuugaacccgggaggcggagguugcagugaaccaagaucgcgccacugcacuccagccuggcgacagagcaagacuccaucucaaaaaaaaaaaaaaaaaaaaaaccuucuguccuaagcacuagcagcuuucugugaguuuucucaucuuuaacuauauuuguauuuagccaguaaauuguacuuauauuuuuaauuauucuaguuuucuaauuuuguaggaaaauuuugaaugacuuaucuucugaugcaccaggagugccaaggauugaagaagagaagucugaagaggagacuucagcaccugccaucaccacuguaacggugccaacuccaauuuaccaaacuagcaguggacaguauagugaguaauagacaauuucuguuucuauugugaggagaaaaaagugaggagaaaaagcuaauaguugcauucucuucagagaaaccaauacaagugccaagucuucucaguuuugcugccauuauuauauuuccuuuacucuucacuaugcaaaggucuguaaugguaguauuuucuuuucuucagagaguuuuaguuaggauuagucaaguguauaaaccuuuuagauguccuuuuguuuuugugcagaugcauggaaagucugaaguuuuugaaccacuaauugagacccuagguuugaggccucauguguugagagaacauaaguuuuuuagauuaaaaaaaaucauuccuugaauauaucucgguauucauuuuaauaguuugucuugccuucugaaaguagcauuuuaaugucuucguauuuaauaauguuucaaguggggauaagcauggcuugguugagucagcacauucaauuauuccuuuucauaugaaagauaguaauauacuuuuuggcccacauaaagcaaaaauugcucuuacaaaauuauuuaaaaguuuucauuucuaugaugucucugucuggcacuuaggucugucuucuuaucuuucaccaaaaucuguuauaagacacuuuugaauuuuauuuuguuugaucaaaagcauuugugugaaugguacuuuuuucucuuuuucccuuuuuuuuuuuugccucucaaagugcuuuauucauucagugauuuuuuucauuuguauuuguuuauuaaaccuggugcugcccauuuauacccuuuuccccacccaccuuaguuucaaauuaaauguacacauugaaacuucuuuacugagauaguuuccuaaucccugagggaaucuguaucagaaauaugcauaaaaguuugaggccaggcacaguggcucaugccuguauucccagcacuuugggaagccaaaguggaaggaucacuugagccauccaggaguuuaagaccccaucccuauuuauaaaaauaauuuaaaaauuaagaaauaugcaugaaaguuugacccccauguuauuuuuuaguuccaguucaacuuuguuuugcguaacucuaauuugcauucccaucuguauuaaagacaaguucucaaguagcaaacuuuuuaacucugccaaggcugaaacuuuugagacuaaguagaaggaaggcauuuuugacuaagguuuuuauccacugugcucaauuagcuuagucaucuuuuuucuucuuaagaucuuuguggcagauauaaaguacaacucuuuaccuacaauucuguacguguauguguauuaucaguugaagccucauaccagaugcuuuuaguuauucaagauauguguucgaagacauugauacaugauguuuauuuuucuucuacuucagcauaccugagggauacaacauacuccugucaguaacagauucacuguuacagagauucucacuugaacuaggaagcaugcucuuuaggaaagaggccuaucagaaucuaaaaaggggaaaugaagguuagaaaaguaccagcacccccauagauguuuaauuugguacacucgucuccuccagcagcugaaaauugcuaguuuuaagagauugagccaggcgccguggcucucgccuguaaucccagcacgcugggaggccaaggugguggaucaugaggucaggaguucaagaccagccugcccaacauggugaaacccugccuccacuaaaaauacaaaaauuagccgggcauaguggcggacgccuguaaucccagcuacucgggaggcugagacaggagaauugcuugaacccaggaggcggagcuggcagugagcugagaucacaccacugcacuccagccuggguggcagagcaagauuccgucucaaaaaaaaaaaaaaaaaagagagauuaauacuuugaaauuuuuaaagcuuuguucauuauuuuuauccuguguccucucuguauauguacacauggcuuuggcuuugauggaacugauuuaacauuauauucuugauuuucauuaagagcaauauaauaaauacauauacagcaacauuuauauuucuuaacuuauaaaaugaacauaugguugucagaauucaccauagauauauaaacacacauaguuauauauuuuguuuaauagcugcauuguguuucacuguguaaauacagcacuuauuuaaacauucuccugcugaugaacauuuaggacauuucuauuguuucaaacagugcuacauaaauauccuaagaguggaauuaucgaccauccuggcuaacacggugaaaacccgucucuacuaaaaauacaaaaaauuagccgagcgagguggcgggcaccuguagucccagcuacucgggaggcugaggcaggagaauggugugaacccagagggcggagccugcagugagccgagauagcgccacugcauuccagccugggcaacagcgagacuccaucucaaaaaaaaaaaaaagaguggaauuaucaaauuaaagcauauccuccgcaaguacccuuccagguggaggcaugaauuuccacuccuuccuuaaauugguuauuuuauuaaauucaugcuguuacuagauuuaucuguuacuuauuaguucagugucccagauaguaaaaucuuauuagugauucugcucuuagauagaaaauguguaucugucauuuugaacuugaauuuuuuuguuucaguaaauaaaacuaugacucaugauguuucccucuuuauucuggcaacucagauucuuagcuaacuuucuguuuaauuguauucuuuucuuagucuagauuuucuucuacaauuguuuuauauaacuaaggauacauccguuacuugacuucugucuuuuuauuuuuguuuuaaugaauuguguuuuauugaaagcuaucucaaaucuuuuuggaauaauaaaguguauacauaaacauuauagagaaaaacuguguucaguaggauuagacuucaguuuccaaaguauuuucauauacaugaccucauuugauauuuacaacaauuguacuuaguggcuagaacccagaugcuuuuguuuuuagagaagagagaacagaaucaaauaacaguuuagugauggcugggcacaguggcucacgucugugaucccaacacuuggggaggccaaagugggaggacugcuugaggccaggaguucaagaucagccugggcaacauagcaaaacccugucucuacaaaaaaaugucuuuagaaaauuaguagggccugauguccugugcuagcuacuugggaggcugaggcaggaggaucacuugagcccaccaguuggaggcuacagugagcugugaucuugccacugcacuccagccuggaagacagaacaagacccugucucaaaagaaaaaaauuaaaacaaaaaacuguucagugauggaacucaaacuacaacccagucuugucauauaugguuuacuauuucuuucuucuucccaccuugaauucacugcucuguagccaagaagaaagugguauguuaaauacaguaggauucacucauuaacucuaaaugagaaauugugauuuguuucuguuaaccuucugauucuuucaaguaaucaugcaaaauuaaucuuagaauaguucuuacucauuuuucucccugccuaagauaaguaaaacuucugggauuagcuaaacuagauccaguguauaugccagcauuuuaauuuucacaagugucauuuugcuaaacuaaucacacuguagccauuaacucuucuuacuucuugaugaggcaguaaucaauuuuccauguacagaugucucaggauguuauuucccauagcugguggauaacugaucccaaacuaauucccuucuaauggacaguaacaugcuuaaucagacauguugacuuuccugcauuguuuacuuuuuucuuacucaguuaaaaucaguuuuguaguuuuauaugugauauugugauuuuugguccuucucuuucugaaaagcuugaccccuacagggagaauugucuagagaggauauugccaccuaucuaaaaaugcuucuuccaaauaaaucaucuaauuuuuaaauuaaauuuuucuauguacuguagcauaaaggugauuuaguuuuucauaaagugaaauaucuacuaguaugagcaaaaguugacugauuuauuguuuaacaaaugaaugacagguguggcuaauuagggcauaaacaacaaaggguucuauaugagaaugcuuggauauguauuaaauaauuuagaaaugacaguuaaaguuuuuuuucuaaaugaugaucuugagcucugauuuuaaaauuccaugagagacuguugauaauuaaguuccauaggauauuucaguuguuucauugaguggauuagauaccauuaaagaauuucuacaagaguuagggaauacaaugcacugaugaacugcuuuauuaguuauauguuaaaacaaccauuuauugggugccuauuucauggcugccacugugcuaaguguaugaaaguauauaagaaaauuccuacucuccagaaauuuauuuacuagugggacaaguauuaauacauuaugcaguuaaugcuaaaauaaaagaaaggaucacagaguggaaccucuucagaaccaaauaacuucagaaggaauuuaacauuuuuccacuuaaaaaaauuguuaacaggcauuauuauuauaaauuagaaugcaguucauagagugcauuucuauuguagaaguugaauauggguuuccugaggagcaaguuacuugaauauauuagacccuucuuggugauguuauuugcuguaacuucuccuagauuauuuuacaaauuauucuacauuggauguaauguuuuaaaagucuuauaugguauuaaacuuguaacaauaaaauccauuggcuuuuaguugccauuacccagggaggagcaauacagcuggcuaacaaugguaccgaugggguacagggccugcaaacauuaaccaugaccaaugcagcagccacucagccggguacuaccauucuacaguaugcacagaccacugauggacagcagaucuuagugcccagcaaccaaguuguuguucaagguaagggaauucagaauucacaggugugguaaauucuucaaaauacuaaaauuuuauaaacucacagaaaaaguaaguaucauauugcaaaccaccauucaaauguaguuaacauuucuucaauauugauaguauuuuucaugaacucuuccauuauuccaauuggaccaaaaugucauggcauaaaaacaacuauuuucaguuuuuaaaauauugcaucuaccuuuaacaucuuuugggguagaagaaacaggauagguuagaaggaaagaccaggaaaucaggaguuagaaaagauggauucuguaucuaacugcauggaucugcuaugaggccuugaguaaaagucagcugcucugagccucaggaaaguguuuuguuuuuuguuguuguuguuuuuguuuuuucaucuguaaaauaagaguugcacugaaucucuggaaacaaucuucagaaguucaggauucuguuucucugcuuccccccccccccccaaaagaaauuuaaaucuucugagaucaucaguuuuuauuauuauuauuauuauuuuuuucuagagacauggucucacuguguugcccaggcuagucuugaacuccgggccucaagcaauccuccuuucucaggcucccaaaguguugggaugccucugcacuugacucaguuuuuguuucaaaugaaaacauuauauuccacaggaucuuauaccaauaugcaaaucugcugcucuuuagagaaaaaguaguuguuaaauucucgacaaauuauagaaguugcuuuuuuuggcuuuuuuuuuuuuuuuuuuaguuuuuuuuuucuguuuauuucaggaaucuuuauggauagcaguuaaccauuuuucuuuggauuuguuugaauauuucaagaauauaguuaaugccagguuagaaauuugcugauugaggaaauaauaauaaauuuguuucugaaaauauuuuuauaaauaauaaugcauuuugccuguguuagguaaugacaguuguauccuuucaccauggauaauugaauaauccugaaacaccaacuggagagagucauaacuuauuuaaagagcccuaauguuuacagaauauauucuguuauuaaacgaguauuugaaaaagauacuauuuugcuuauugaugagaguaaaacaccuuuucacuuuacaugcagguacucaaaaauuguaaagcaggaugucagugaauuugaauucugaacgucaguuugaagaugguaacauguuuaguauauaaaucuuuuccacucaaaccauacauuuuaauugauauuaauaauuaauaugaauaauuuuauaaagaccuucaaauuuuuuuaaguaacauuagguuccuuauuaggagagcauauuauuacgcuguuuuuagaagcaguuugacaaauagugauuguguuuguuuuuacaaauggugaaucaguuagaaaaauaaaacuucaguuuauuuagccauuaucauuuacauuaaaacaauauguuuuucaaauaauauaauuggcaucaagugauacacuuuuucauacuuuuaguuuuguuuuaauucaaaauuuauaauaguugaccauaaugcuuuaucuucuuuuucauuuugcuauuuuaugaaaaaucauggucguuuuuaugucguggcaagagucuacuugaaauuuuuuaauaugaauuuaccaauaucaaaggaagacacugaggacuauacucuaucuaggaagaucauccaagcugugccccacuuaccuuuuagacuuaagguugguaagcauguuaacaacagaauagaacugcauucaaaugaaaaauaaaauguaagauccagcggacauagguuacuguaauaaauacauuacauugggaauuauuucuuaguaguggcgcgaagagugcugauucuuucaacgcuuuagccagaaucaucuuuucuuuuuuguuucccuuuuaguccaaaauacaugcuuagauugaugauugauacacauaauugaaucaaguugcaauguuucugucuuacaccaugcucacuguuuuuuucagcugccucuggagacguacaaacauaccagauucgcacagcacccacuagcacuauugccccuggaguuguuauggcauccuccccagcacuuccuacacagccugcugaagaagcagcacgaaagagagagguccgucuaaugaagaacagguacaaauacugcauuuacuuagauuguuauguguuaagugugucuucacauucugcuggauguguaucuuuacaucuacugguaauaggaucuuugcauugaauuuuuuuuuuccagcagaauuaauggaucuugcuaaauuuucuuuauuuaauaagcugcacuuauaagauagcuguaugauuaugggucaaucuuugaucguggaguaguuuucuuucaugcaguuuccccacaggagauuuaaugcacaacuucccuaugucugcacuccaaccaguuagccagguuauuuaaaaaugguuucuuuucauguauaguauuguucaagaagaucaagaguuucauauauguauauuaacuguguguuaaauuuuaucuauauuaaauuuacuugauauaaaguaaauguaugguggccaguucauguuuuaaugaauaauaucuuuacucaaaauaauaacauuuuaacaccuaaagauucuucaaaaauauguuaauucuaagaauaccauguuacggacaaaaaucuuaaaauauagucuucaaaaaaauacuacauucaaaaucugugaaauguugguaaagcaauucucagaaaguaacuuuauugcuguaaaugauuuugccgucaaaaacaauaaaaauaaguuacuaaauauugguuuagaacuuucauauagaagugaccgagacaaacaaaagaaaaugaaaauaagguuauguaaagguuuaaaaaguuugaaauuagugaaaguaucucacuguucaucccaggauacuucaaacacugauaaagugaaagaagcagggcuuccaaguccuagcccuaucccuccauuuugggagaagguauuaaccuucuguaccucaguuuuguaaaaugggauuccagcacacacccaaaguauuguuguaagagucaaguaagagaauccuuugaaagcacuuuguaacuguagugcucuguugaaauggguuugugugugugugugcaauuucacagcucagaucagcuuuuuuguuccuaaaauauucuuagcugucacaauguuaguaaauuauaucuaaacucugagaaauggcagagauuuuucugggauauuagaaaaagaguuggaaacaagccaagugacuuuuuuuuuuucucccgagaugaagucuugcucugucacccaggcaggagugcaauggugcaaucucagcucacugcagccuccaccuccuggguucaagcaauucuccugccucaaccucccgaguagcugggauuacaggugcccaccaccacgccuggcuaauuuuuguauuaguagagacaugauuucacuauuuuggccaggcuggucucgaacucuugaccuugugauccacccuccucggacuuccaaagugcugggauuacagguaugagccauggugcccagcccucaagugacuuuuauuugugcuccauccaucugugauuuugaguauuuaaguuuuacuaaagagaagcauaaaagcugcauucauaauucaaauauauuuuaaaauauaaauuaaaaucuguaaauaaaaauuaaaauauuuucaguuuuuaaaaauguuuauaaggaaaccuuuaacuuaaaauuagaagcaagucugaucaagaagucucaagcacaggcugaguaguaauauuuaagacaacacugcuuacuaaagaaaagaguucaaagcaaacauaggagcagaaucaaaaaauaaauccuuuugauuauaaaaaacaacagaaggacuucuguuuaugucuauguaguuuggcuguguggaacaaaauguuuacccccguugacuggcagaccaaauuuccuuuuuguucuauuuauuuuucuuucagauuuaugaccacugccaccaacaaguuaggaacagggcacacauaacuacaguuccuaccaggcuuugcuugccugagaucuucagggaaacuacccgacuuaccauggacucuuucauaacauuacuuugcuuagauauaguuacccuacucuuuaaaaaggaaacuucucauugauucugccauaguuccuuuuccccuuuguuaccagauuacugcugcuuuuacuuuuucagccuccauucacuggaaucuggcuucuaugacuagcauaccgcucauaugucuauaaaaagguacaaauucccucccacuuggcaaaucuaguauuuucuuucauuuaauuuuaacucuauggaguauuugacacuuucgacuucucauuacucuaaacucuuccuuggcuuacuucaccugguuuucuggcuacuuuucaaauuuuuccuuugaaccuucauccauacccauguauuucaggcauuacuuuauaugcugauacuucuuaauucuguauauucuggcuuugaccuuucugccgagugcuauuuauuaagcuccaguauauauuauuuuauuaauucuaccuacagugagguagaagcuuauccccacuuuagaggaggagaagguaaauaucagaaaauucaaauauuuugccaaaggucacacacuuuaugagauuaguagaacugaaauuugaacccauaucuggcaccaaaaccuguaaacaugcuacuucacugauuccaguaugcagccaucuucugcugugccucucaaaccagagcacauggcaguaugcuagggauguguagccuaaggaggugaacguggagugcuuuccuugaauguucauuuugcuaaaauauuugagagaaauaaaccuuauuuuuaagguaaaauaagaguuuuaaaagaaauuuauaccagcagugguuuugcugcacccccagagucuccauauuugguuuccucuucuaguguggcuauuucaguggaaaaguuaagagaagcacacuccuaagcaugcucacuaggaugaauuucccuuaugcacaucaaacacagccuaucuuaaaguuugauaggaaaagauuguaauccaaaaaauucaucacuauccaaauugccauuuauuucaagaugaagguaagugguaaacauucuaaaagaaaguguagacagcucuucuguuaauuuguguugcuacaguaacaaccacgaaucucagugucuuaaaauuucuuccucacuucuguuacauuuuggcagcugcaggucaguugcuguggcucuccuucaugugcccaucugggucuaggauccugggcuagauagagcagcacgucuuugagaaaagggcaaugcuuuugaaagcauuugcuugauuuuggugaacguuacaucuacucgugaucuguuagccacagcacaggcaaggacaagcccaaagucaguggagugggaaugaacucuuccuacaggaaguggagagugaaaaauugugaaaguaauacaaucuaucaccuuugccuuuauguaacuuuacauuguagggggauuuuaaaagcagauucccuaaaggcagaaguaacaaaggaaaagguuaaauggauuugaccauauaaaacuauaaacccccuauuuaggaaaguaaaagauaaaguagcaaacauuuuaacaaauaaugucagaagacuaaugaguugagggauauaaauaggcagauucuuagaaaauggauaggguaaaaaauuugaaaaauucuaaaaaaauuaaaauguauuugauaugaauuaaaauauauccauucaacuauauacaacuagccauuaagaguaaauaaagguguauuuuuauuaagaugggaagauguucucggacaaaagcagguuaccaaagaguauuuacauuacuaucagguuuuuuaaauuuauuauuacacaaguaaaacauguucauuauaaguaaauuaagaaacauuaccuaaaaauugaauuacuucuaauuucaccaucuaaaauguuaacauucuaaagucaguuuuuuuacucaaaccaguacaaagguaaauauacauuuuuaauauauuuuuaaguaauuuuaaacuuacaaaggaguuuuaaaaauacagaguuccggauacccuucauccagcuuucucuaaucuuaguauauuacauaaccaggguacauuuaucaaaaauaaaaguacauugguauaauaccauuaacugaauuauacauuuuauuuccccaguuuuuuuacuuacauaauccaguuuggguaccauaucgcauuuaauuauagucuccuucagucugugaaaguuuguuuccuugucuuugauggccuuguaacuuuugaagaguagugaucuguuuucuuuuagaauaucccucaguuugcauuuguccaguguuuucuauggauagauugagauaauagguuuuggggaggaauuccacagagguauagugugccuuucucauaacaucacauccgggagcacauacauaauuggcgauauuaacuuugaucacuugguuaaagugcuguccaggugucuccacuguugagcuaccauuuuucucuuuguccagcccauauucaaggggaggagaauuaaauuccaccuccuaaaagggagaauaugaaagaaauuuguggucauauguuaaaaccaccacaguaauuagguguauuuuagaagaaguacuuggaggcuaugcagauauauucuuuucucuuuaaaguuuugcccaccaguuuuagaauucaucaguaaaucuugucuacaguaauuauuacuauuugcuauucuaaugggaauuuuguauaucuccaucccuucuaauauauuuaacaacugaauucuauaaacaagauuuguuucuucuccacauuauuuauuuuaucaauacagacacauacuuugggaguuauaauccaauacuauuguuauuuauuauguuguucauauuguucuagcuuuggcuacugggaucuuuuauaagugucuucuguguccuuuugacaugccccauuuuuuucuuuuuaagcacaucuuuacuuucugagacuacaagauuguccagguucucaucuuguguuuucccuucccuagccuuggaaugagcuguuuuuccaaugaucucuaguuccuuuauuagaaaaugguggccaauauggugaaacccucucucuacuaaaaagagaaaauuuagccggggugguggugcacgcuuguaaucccagcuacucaggcggcugaggcagaagaauugugcgaaccugggagguggaaguugcagugagcugagauggcacuacuacuccagccugagugacagagugagacucugucucaaaaaaacaaacaaacaaacaaaaaaaaauauauauauauacauacacacacacauacaccuucauauaugcacacauucuuauuucuguaucuuuauauauaguuggcucuguuuuccauagcccacauucaagaaaaaaaguaacaauauaacaauuuuuuaaauaauacaaauaaaaaaguaaccuaguauaacaacuauuuacauaguauuuacauuguauuaaauauuauaaguaaucuagaggugauuuuaaguauauagggggauucauauagguuauaugcaaauauaaugccauuuuauauaagggacuugagcaucuguggauuuugauacucaugagaguuccugggaccaaucccccacagauacugagggacaacuauauacuuaaauaggaauacacacuaacauaucugacucuaagcuuuaaccacguggcucauuuuagacuucucuuugccuguuuguaacuucuuucuccgacagaaacuuggcuuauauguuuguuuaaaucuacuauacauacagaaaacuuguaagaauugauaauauguaccauugugagaaacaggauuaccaguuacagugcaguauuuauauacacuucuuuuuguuuuuggccuaauaguauuuagcaaaagugcuguuuucuaaaguuacuucacucugcuccuuucuccaccccuuucaaugagguuauaucauaugauuguaguacaguuagauuugucacaaucuucagucugggauuuucugacaucccuaaguuuuuauccuuaaauuugcauauacauaaguucacucuuugugcuguauaguuuuauggguuuugauagaugcagugucauguaucugucaccacaaugccauauggaacaauuauacuaguuaacuaacaguuauauaauacuaaguauucucuuauaucccuuugaagucagcuucccccacgcccugaaaaccaaugaacuguuuucuacccuuauaguucugccuauuccauaaucucuuauaaaugguaucuuaaauuauaauuuguagccuuuuagaucugguuccuucaucuagcaaaaugcauuuaagauuuauugauuuuguugcaugaaucaguaguugggacuuaucccagauaauuccauuuuauagauauacugugcuuuguuuauucacuuugaauuucaucccaguuauuuccaguuuuagagaaauaaaguuacuaucaacacauaaagguuuuuauaugaacuuuccauuaacaugaguaaauaucuaggaguaggcugguugcaugaaauguaacuaacuguauauuuaacuuuuuaaauaaacuguccaauuguuuuccaaaauggcuguaccauuuuauauucccaccaggaauguaugagaguucaguugcuuuguauccuugccaaaacuugacauugucagguuuauuguuugucccccagcucuagaacugguauaauggauaucuuaugguuuuaacuugcacuucacuagugacuuuuuuuuuuugagacggagucucccucugucaugucacccaggcuggagugcaguggcaccaugucggcucacuguaaccucugccuccuggguucaagagauucucgugccucagccucccugaguagucaggauuacaggcaccugccaccacgucugauuuuuuguauuuuuaguagagacaggguuucgccauguuggccaggcugguuuugaacuccugaccucagaugauccacccaccucggccucccaaaaugcugggauuacaggugugagcuacugugcccagccuucauuagugacuuuuaugugauuugcuaucuauauguuuucuuugaugaaaugucuauuuagaucuuuuagucauuucuauuguuuguuuucuuuuguuuucagagaccuuuuuuccaaauccuuugucagagcaaguauuuucuuucagucugcagcuuuuucuuuaauuuucuuaacauuaucuaucuuuugcagagcaaaagguugccauuuugaugaggcccauuuuaucaguuguguccuuuuguacaucaugcuugugguauuuaugaauuuucugccuggauaggcccagcccacuuacacacgucuaggagccuauggacaggcccauugguguccacauacaucaucuagggugccugaggauugguugguccugcccaccagcacccacugucuggaaucaugaaggccagcucgcucucacuaucacauuggccacccagaggccugcagauaggccugccuggccugcugccaccguaaaggccuuuguguccacauaccagccaaccugauguccccauccucagcaaagcuuuaucacagccuccacugacaaccgaagccuaagccacugaagaaaucauagaugccaugagagaaucauagauaccaccauugaugacaguaaaagaaaucauacagagacaacacaucugaacccaccuagaaucaaauccagagcacccuacccagcuaacacuacagcuacaucuacaguaaaagucuuucucuacaaaagccaguccauaaaauuggauaaagcagcaguugcacagauaucaagauaaggacacaagaaacauaaaauacugaggaaacacgauaccuccaaaggaacacaauaauuuuccacuaacagaucucaaagaaccagguaaucaauaaaaugccugaaaaggaauugaaaauaaugaucuuaagaaaacucagcaagaaacaacagaacacagauagacaauacaaauaaaucaggaaaacaauucaugaucugaaugagaaauuaaagagguaaauaguuaaagaaacaaauucuggaacugaagaauuuaauaaauaaaaaacagucgagcagaaagaauuucugaacuuuaagagagaggucuuuuaaaauaacccagucaaacacacacuaaaaaggaugaagaaagccuacauaggacaucauaaagcaaacaaauauuucaauuuugggagugccacaaggagaaaauauaggaaaaggcauagaaaaccuauuuaacaaaauaaucacugaagaccucccaugucuugagagagagauauauauccagauacaggaaggucauauguacuaaaacaguuuauccaaaaaggccuuucuaagacacacuauuuucaaacucaaaagucaaaaacaaagaaaaaauucuuauggaaccaaaaacagcccaaauagccaaagcauuccugaacuaaaagaacaacauggaaggcaucacacuaccugacuucaaaauauacuacaaagcuauaguaaccaaaacauaguauugauauaaaaacacauagaccaguggaacagaauaaagaacacagaauaaaucuacuuauuuacagcaaaugugccaagaacauacauuggggaaaggacacucucuucaaucaaugguauugggaaaccuggauaucugugugcagagaaugaaacuagauaccuaucaccauacccaaaaauccacuccaaguggauuaaauacuuaaacauaagaccccaaacucuuagacuacuagaagaaaacaugggggaaaugcuuccugacauuagacuuggcaaaaacuucauggcuaagacuccaaaagcacaagcaacaaaaagaaaaauaguuaaguggaaauauuaaacuaaaaagcuucugaacagcaaaggaaacagagugaagagacaaccugcagaaugggaggaauauuuacaaacuguucaucugacaagggacugauaaccaggauauauaaggaacucaaccgaacaggaaaacaaacaaaaauccuauuaaaaaguggacaaaaggucugaauagacauuucucaaaagaagacauacaaauggccaagaaauauauuugaaaagcucaacauuacuaauugucagauuaaaaccacaaugaaguaucauuagauagaaugguuauuaucaaaaagacaagaaguaacaaacugaugaggaugcagagaaaggugaacucuuccucuuuguguuaggaaguaucauuaguuagaauggcuauaaucaaaaagacaagaaguaaacacugaugaugcagagaaaggugaacucuuucuaacucuuuguguuagaauugucucaguguugaugagaauguacauuaaugcagccauuacggaaaacgguguggagguuucucaaaaaaacuaaaagggccaggcgugguggcucacgccuguaaucccagcacuuugggaggccaaggcggguggaucacaaggucaggagaucgagaccauccuggcuaacacggugaaacuccuucuuuacuaaaaauccaaaaauucagccaggcaugguggcgggugccuguagucccagcuacucgggaggcugaggcaggagaauggcgugaacccggaaggcagagcuugcagugagccgagaucgcaccaccgcacuacagccugggugacggaacgagacuccaucucaaaaaaaaaaaaaaggaaaaagaaaaaaacacacaaaaaauaaaagaaccacuauaugaucuagcaauccuacuacuggguaucuauucaaaagaaaggaaaccaguauugcaucacuucacaguagcuaagauagggaaucaaccuaaauauccaucaacauaugaauggauaaagaaaauugcaguauauauacacagugguauacugucaagccacuaaaaagaaugaaaauacaucauuuguggccauguggaugaacuugggggacauuauggguuaugcaaaauaacucaaacauggaaagauaaauaccacauguucucacucaugugggagcuaaaaauuuuuugagcuuauggaaguagagaguaaaauuguggguauuagagccugggaagggaaggugagauagggagcauggggagagguugguuaauggacacaaacuuacaucuagguugguagaaugauuucugguguucuguagcaccauagggugaauaugguuaaauacaacuuguguauuuucacaaagcuagaagugaggauuuugaauguucacaacccaacaaaaugauaaguuugaggugauggauaugcuaguuaccauaauuugaucauuacauacuguauacacauauuagaauauuacugcaucucauaaaugucuacaguuauuuuaugucaacuaaaaauaaaaaggaaaaaagaauucuuugccuaaaucaauaucacacagacuucguuuuccucuaaaaguguuauguuuuauguuagaguuuuauauuuagaucuauaauucccuccugaguuuacuuuuguauaaggugugaggaugugucgagauccauuuuuuuauauaggaacauccauuuguuccagaccauuuguugaaaagacuauucuuucucuauugaauugcccuugcucuuuuuuucaaaaauuaauugaccauauuugugugagucuguuucuuggauaucuuuccauugaucuuugugucuguccuuuagccaauaccauguugccuugaguucuguauaauaagucuugaauuugauaaugugaguccuccaacuuuguucuuaaaauuguuuggcuauucugguuccuuugcacuuuaauguauauuuuauaauccgcuuguugaugucuacggaaagugugcuagaauuuuaguuaggauuguguugugucuauagaucaaauugugaagaagucacaucuuagcaauacuuaguuuuugauuccaugaacacaauauaaucuaaucagcacauagauccuguacauaucuuacuggauuuauacccaaguaugaacuguuuucugguuuuuuuuuuuuuuguguguggggguggggggacaugugcuauuugaaaugguauauucaauuguucauugcugguauauggaaauaaaauuggcuucuguauauuuaccuuuuauccuaugaccauucuaaauuuacuuauuaguucuaggagcuuugucgggggggguguagauucuuugggauucucuacacaaauuaucaugucaccuacaaauauggacaguuuuaauuauuucuaaucugcaugccuuuuaauuuuuuuuccuuauugcaaugucuaggacuugugcuaugauguugaauaggaguggugagagaggacaucuuugcccuauucuugaucuuaggggguguauuaguuuucuauugcugcaugucacaaacugccacaaacuuacuggcuuaaacaacacaaauguauuguuuuccaguucuauaagaucagaggccuucauuggaucucacugggcuaaaaugaaggugucagcaggacugcauuccuuccuggagguucuaggugaaaauguguuucuuugccauuucuagcuucuagaggccacccacauuuuuugccucauggcccccuuucuccaucuucaacauaguguuaucucuguuccccuucugcagucacauuuucuucugcuuuccuguucuacuuuuaagaaugcuugugguuuaacugggcccacucaaguaacccaagauaauuuuccuauuuuaaggucagcuaauuaacaaccuuaauuccaucugcaaccuaauuccccuuugccauauaagguaacauacucacacacugcagagauuaguacauggacaccuuugggggaccuuaaguaauguaauagcuguagggucucuguaaaaagcucuucauuacauuuuuuuaaaaacucucuuugauuuuuaguuucugagaguuuucaucauaaauuguuguuuaaucuugucaaaugcuuuuccagaaucuacugaggugaucguguuguuucucuuauuuggucuguuauuagagugaauuacauucauacuccaauuuugagauaugcaugcauuccugggaugaacccccaauuggucaugaaguaucauuuauacauugcuggauucaauuugcuaauauuuuguugaggauuuuuaugucuacguuuauggcuaauaugggauuuuaguuucuuugccgugaguuuguuauuaggguaaugcugaccuuauaaaugagguggaagucuucccuucccuucucuuuuucuggaagagauuauaauauuuguauuauuuaagccuuauaugguugguagaauuugccagugaacccacauaggccuggaguuuucuauuuugagaaguuuuuuuuuuuuuuuuuuuuuuuuaauagauacgggaucauucagacuauuucuucuucagugaguuuuggaaguuuguguuuuuaagacauugguccauuucuucaaaguuaucaaauucaugaccauagaguuguuuguaguguuaguuuauuauucuuuuacuguaugggaugucaguagggauguccccccgcuucauuccuaauauuguuaauuuuugucuuuccucucucucuguauucgccaccccuaccccagccacccuccuuuuuuuuuaagucuggcuaaagguuuaucaauuuuguugauuguuuuuaagcaaccaaaauucuuaguuucauuaguuuucuccuuagaauuguauugauuuguacucugaucuuuguuauuuucuccugcuugcuuugguuuuuuuaguuguucucuuucuaguuucuuuuuucauuaacuguaaauuuuuuccuauuaauauauaccuuugucuuauuucaguuucuaagaaaacuucugcagguaucuaguuucuuaagacaauaguuggaucaguuuggcaaaucuuuuguaaagggccagauaguaaauauuucaggcuuugcagaccaaaugaucugucacaacuacucaacucugccguuguaauaccaaagcagcgauggauaauacugacuguguuccaguaaaacuuuauuuacaaaaacaagcagggaagcaaaguuuggcaacccuugauauaaauaauugauuuaagcccuuuuuuucuaacauaaguauuuaaggcuguaaauuuccauuuuagcauugguuuagcugugucccacaaauuuuggguugucauuuuuauuugcauucaguuuaaaaauuuuuuuauuuccuuugagacuucuuuuuugaccuauagacuuagaaauguuuaauauucaauuuccaaauaaucgaggaucuucccagguguuuuauggcccaagaacauacuuuguauuauuuuuauucucuuaaauuaucaaguaucauaucaaugucagauagguguaguugauuaugucauucagguguacuguaucauuuuuaauuuucuacuuauucugucaucucugagacucuacuuagucuaucaucacugacaggagaguguauuaaggcauucaucccuuuguucauuucuccuuucaguucuauuagcuuuugccucauacaggagaauuacaucuuccauuuagaauuaugucuucuuagaggauagaccucuuuauuauuauauaaugucuuucuuuaucccugacaauauuccuucuucagaagaaugcuuugucugauacuaauaaaacuaccccaguugguuuguuuuguuuuuguuuguugagacagaaucuugcucuguugcccaggcuggagugcaauggcaguggcacaaucuuggcucacugcaaccuccaccucccugauucaagugauucucgugccucagcuuccaaaauagcuaggauuacaggugugcgccaccacacccagcuaauuuuuguauuuuuaguagagacgggguuucgccauguuggccaggcuggucucaaacuccugaccucaaguuauccgcucaccucagccucccaaagugcugggauuacaggcgugaaccaccauucccagccuccuuuugauuaguauuugcauaauauauauccuucuccauccuuuuucuucucuguuuauauuugaagugggauucuuguagauggcauauacuuaggucuuccuuuuuuacugagcuacaugccuuuuaaaugguuuagaucagggauuggcaaacuauggcacaaguagaaauuuuuaauuuuacauuuauauauuuaauuuucaauugucuucauuuccuuauauaaauccauguuuuaaucuauuauauuucugccucaaaaacucuuuuuuacauuucuuagaaaauagaucuucuggcaaugaauucccucuaguuuuguuugaaaaaguuuauuucaucaucauauuugaaagauauuuuugcuggguauagaauucuggguuuaucauuuuuuucuuugaagugacagacuuuaaagaugucacuuaaggcugagguaggcggaucacaaggucuggaguuugagaccauccuggccaacauggugaaacccucucucuacuaaaaauacaaaaaaugagcugggcgugguggcacacgccuguagucccagcuacucgggaggcugaggcaggaaaaucacuuaaacccgggaggcagagguugcaguagcccagaucacgccacugcacuccagccuggcaacagagcaagacuccaucucaaaaaauaaaaaaagaugucacuuuuuuucuuaugauuuaaaugguuucugacaagaaaucuguguguauauaaugcuccuuuucuuccucugccucugauuugcagcaauucaaauauaauaugccuagggauuuucccucucuucccuccuuccucccccauccccaccauauuuaucuuauucuucuugugucuguggcuuggugucugucauuaauuuuagaaaauucuuggccaggugcaguggcucacgcauguaaucccagcacuuugggagaccaaggcaggcggaucacgaggucaggagauugagaacauccuggccaacauggugaaaccccgucucuacuaaaauacaaaaaauuagcuggccaugguggcgcaugccuguagucccagcugaggcugaggcaagggaauugcuugaaccugggagguggagguugcagugaguccagauugcaccacugcacuccagccuggcgacagagcaagacuccaucucaaaaaagaaaagaaaauucucagauauacuuucuucaaauauuuuuccguccuguccucccucuucuucugagauuacaguuauaaauauguuaggauguuggagacggucacacagcuuuuuguuguucugucuucaaguucacugauuguuuccucagcugugucaguuuuacuuaccagaacaucaaacauauucuuuaucuccauuuccauuugauuccuuuucauaauuuccaugccacugcugaaauaacccaucugaucuuacauguuauccaccauuccuauuagagccuuuaacauguuagucauacuuaaaauuuguaucaaggcugggugcgguggcucaugccuguaaucccagcacuuugggaggcugaggcaggaggauagcuugagcccaggaauucaagaccuguuuggaaaacauaggaagacacugucucuacaaaaaauaauaaaauaaauuagcugggcaugguggugcaugccuauggucccagcugcuggggagguugaggcaggaagaucacuugagccugggaggucaaggcugcagugagcccucauugugccacugcacuccagccugggcagcagagcaagaccccaucucaaaaaugaaaaauagaagcaaaugcuacuuuuuucugaauugauaguuacaugaggaugaagacaucaauggaauuacaauguacugccauuuggaguuaccuaaaaauaauaauagcuaacacaucuucaacaugcuaggcacuauauugugugcuuuacauauauuaacucauuugauccucacaaacuuuuuuuuuuuuuuuuuuuugagacggaaacaccuaucacccaggcuggagugcaguggcgcuaucuuggcucacugcaaucucugccuccuggguucaagcgauuuuccuaccucagccucccaaguagcugggauuacaggcaccugccaccauccccagcuaauuuuuguauuuuuaguagagacagaguuucgccauguuggccaggcuggucucaaacuccuggccucaagugaucugccugccucagccucccaaagcgcugggaccugggauuacaggggugagccaccacaccagcccucacaaaccuuuugagguagaaaauauuaccauguccuuuuuuacagucaggaaauuaagguuaaguaauaagauuguggcccuugaccacacagagcuaaaaaagaauuuacugguuuagauugagcagcuugcuaaagaauaauuuuuaauuauuuuuaaucuguguuagauuuuuuuaaauaauuucauuuuuaauugugguaaaaaauauaacaaaauugaccaucuuaaugaguuuuaaguauucaguucagucauguuaaguacauucauauuguggugcaguagauuuccagaacuuguucaucuugcaaaauugaaacucuguacccgguaaacaacaacuccccauuuccucguucccccagccccuggcagccacuaauguaaguccuguuucuaugaauuugauugacuuuagaugccucauaagagaaauuacacaauauuugucuuuuugagacuagcuugugucagcauaaugcccucaagguucaucuacguuuuggcaugcagagggccuuccuaaggcugaauaauauuaauauuacauuguauguauauaccacauuuugcuuaccacucaucugcugauggacauuugggcugcuuccaccucuuggcuauugugaauaaugcugcaaugaacaugaguguucagauaucucuucaauacccugauuucaguucuuuuggaucuguagcaaaaagugggauugcuggaucauaugguaaauuuuguucuuaauuuuuugaggaaccuccauuccauuuuccauagcagcugcaccauuuuacauuccuaccaacaguacacaagaguuccaguuuccucacauccucaucaacaauggguauuuucugcugguggugguuuuuugauaguagccauccuaaugguugugaggugauaccuagugguuuugauuugcauuucccuagugauuagugauguugagcaucuuuuuuuuuuuuuuuuuuuuucugagauggaggcucgcucuguugccuagguagagugccguggugcaaucucggcuuacugcaaccucugccucccggguuuaagugauucuccugccucagccuccugaguagcugggacuacaggcacccaccaccauaccuggcuaauuuuuguauuuuuaauagagauggaguuucaccauguuggccaggcuggucuugaacuccugaccucaugauccacccgccucugccucccaaagugcugggauuacaggcaugagccaccgcacccagccuauauugagcaucuuuuuauaggccauuuauauaucucuggagaaaucucuguucaagucccuaugcccauuuuuuaaauuggguuauuuugcuguugaguucaaaaguucuuuauauauucuagauuuuuuuuuucccuuucuuuugagacagcaucuugcugucucccaagcugugguauaguggcaugaucauggcucacugcagccucgaccucccggccuccaaccucagcuuccugaguagcugagacuacacgcacacaccaccuaacuaauuuuuaauugagacagguucuugguuugucacccagguuggaaugcagguggcaggaucacggcucacugcaaccuaagaccuccugggcuuaagcaguccucccaccucagcuuccugagcagcugggacuacaggcaugugccaccacacuuggcuaaauuuuuaaaaauuuuuuuuuagagacagggucuuaauauauugcccaggcuguucuugaacacauggguucaagagauucucccaccucagccucccaaagugcugggauuauaggcgugagccauacaccuugccuauucuagaucuuaaccccuuagcagauauaugauuugcagauauuucuucucauucuguagguugccuuuucacuauuuauugucuuucgaugugcagaaguuuuuuaguuggauauaguccuauuugucuauuuuugcuuuuguuaccucugcuuuugguguuguauuuaagauauuacugccaaauccaaugucagagaguguuuucuucuagaaguuuuauaguuuuaggucuuacgguuaggucuuugaucuauuuugaguuaauauuuguguacaacauaaggugcggcccaaccucacucuuuugcauguggauauccagguuucccagcaccauuuguugaagagacuguuagauuuuuuuaaaugcccugaaaugauuaguuuguaagauuuucuauuuaaaggauuguuacacauugaaauuuagcuuuaauguuuucuuaguuauugauauggauagaauuucaaguuuugcaggaauuaugcagaauauuuuaauuaauaguaagauguaauuuuuaaguggucauuuaggucuuguuuguuuauggaguuguuuuuuuguuuguuucuuugagacggagucucacucuugucacucaggcuggagugcaguggcgcaaucucagcuuacugcagccucugccucccagguucaagcgaugcccauggcucagccuuccaaguagcugggacuacaggcaugugccgccacaccccgcuaauuuuuguguuuauaguagagagggguuucaucauguuggccaggcugaucuuggacuccugaccucaggugaucucccugccuuggcccccgaaagugcugggauuacaggcgugagccgccacgccuggccagauuaaaauuuuaauauaagguaauuuccaaguaauucuguauaucuuuuccaaugcuuaauauauacuaaaauguugguugcugugagcuauuucuuuaaaaaagaaaaaaaaaagguaauccaaaauaaauauguggaaaucauuugcauaauuuuucccguccucuuuugcuuguagggaagcagcucgagagugucguagaaagaagaaagaauaugugaaauguuuagaaaacagaguggcagugcuugaaaaucaaaacaagacauugauugaggagcuaaaagcacuuaaggaccuuuacugccacaaaucagauuaauuugggauuuaaauuuucaccuguuaagguggaaaauggacuggcuuggccacaaccugaaagacaaaauaaacauuuuauuuucuaaacauuucuuuuuuucuaugcgcaaaacugccugaaagcaacuacagaauuucauucauuugugcuuuugcauuaaacugugaauguuccaacaccugccuccacuucuccccucaagaaauuuucaacgccaggaaucaugaagagacuucugcuuuucaacccccacccuccucaagaaguaauaauuuguuuacuuguaaauugaugggagaaaugaggaaaagaaaaucuuuuuaaaaaugauuucaagguuugugcugagcuccuugauugccuuagggacagaauuaccccagccucuugagcugaaguaaugugugggccgcaugcauaaaguaaguaaggugcaaugaagaaguguugauugccaaauugacauguugucacauucucauugugaauuauguaaaguuguuaagagacauacccucuaaaaaagaacuuuagcaugguauugaaggaauuagaaaugaauuuggagugcuuuuuauguauguugucuucuucaauacugaaaauuuguccuugguucuuaaaagcauucuguacuaauacagcucuuccauagggcaguuguugcuucuuaauucaguucuguauguguucaacauuuuugaauacauuaaaagaaguaaccaacugaacgacaaagcaugguauuugaauuuuaaauuaaagcaaaguaaauaaaaguacaaagcauauuuuaguuaguacuaaauucuuaguaaaaugcugaucaguaaaccaaucccuugaguuauauaacaagauuuuuaaauaaauguuauuguccucaccuucaaaaauauuuauauugucacucauuuacguaaaaagauauuucuaauuuacuguugcccauugcacuuacauaccaccaccaagaaagccuucaagaugucaaauaaagcaaagugauauauauuuguuuaugaaauguuacauguagaaaaauacugauuuuaaauauuuuccauauuaacaauuuaacagagaaucucuagugaauuuuuuaaaugaaagaaguuguaaggauauaaaaaguacaguguuagaugugcacaaggaaaguuauuuucagacauauuugaaugacugcuguacugcaauauuuggauugucauucuuacaaaacauuuuuuuguucucuuguaaaaagaguaguuauuaguucugcuuuagcuuuccaauaugcuguauagccuuugucauuuuauaauuuuaauuccugauuaaaacagucuguauuuguguauaucauacauuguuuucaauaccacuuuuaauuguuacucauuuuauucacuaagcucgauaaaucuaacaguuacucuuaaaaaaaaaaaaaaaagacuaagguggauuuuaaaaauuggaaacugacauaauguuagguuauaauuucucauuuggagccgggcgcaguggcucacgccuguaaucccagcacuuugggaggccaagguggguggaucaccuguggucaagaguucaagaccagccuggccaucauggugaaaccccaucucuacuaaaaauacaaaaauuagccaggcgugguggcuggcgccuguaaucccagcuacucaggagguugaggcagcagaauugcuugaacccaggaggcagaggguugcagugagccgagauagcaccauugcacuccagccugggcgacuccaucucaaaaaauaaaaauaaaaaaaaugucucauuugggaaggaaauuccuuuuaaaaaagaguugagacacuuagaaaacuaauguuuuauauuuagucaagaguuauuuaagaaagucaagcuuguuuaacaacaaaauaugaagauuuaaguguuaauugcuggauccauuuuaaaauaagauuuuaauuaacauuuguaaaugguauauuuucguuuguaacaaaccauugucuuuuuucaaggaugaacagaguuuaugaaggagcaucauucuaagaauuaagugauguagucuuuauguuuggacaguucaccagauucucaagaaggcuuucaaacaacuauaaaguuugauguuuguccugcugagcuaauggggaaaguuauagcauaaaaauuguguaaccgcauagauaugucauuuuuaaaaacugguuuaacagaaaucaagcaaagucacaaauauguucacaaguuggaauuauuuauugagucaaaaugucgaaucgaacauuuugaaugaaguaaguguuauaaaugaaaaauugccugauguuuagcaguuuguauucucuaaagcuuuuuuucaaaaguucaggcuuucuacuuacugggaaguuggugguccucuuagucccugauaaaucaaggcaaucacauucaugugagcuggaugaauuuauaaguuauaaagaccuuauccuucauaccuugaggaugauugcacugguuuugaagucaguugcuuaaugaugaggugagaaauguauccuguugcuaaaucugucuuagacccuuggugaaacuugaagauuucaguuuauaaagauaaaaucaagcaucuuuugugcaguuuucuuuuuuuaaugcaagaaugguggggagguuuguuuguaagcaugaaacuuugagaaucuuuauuaagaaaaugacauaauuuuuaaaaaccuuguagccaagaacauauguggccacauuaccaguaauaaauguuuuucucuuuauauuggccaaaagggaauaaaaaugucaucauaggaauuuguacauaugcuacugauuugccuagaaaauagcaaguuugauauugcucacuuugcaaauauagggccauguggcacuuuuaucuauaggacagauuaauaaaaaugaaguggggagggguuuauuuuugauauauuacucuuaugaguuuucaagcuuugauaauguuuaacugaaaaguggcuuagaaagggcuagauccaauguguucauuauuaaauaauugcuaucagauacaauuuuaaguucauucuuuuucaaacucaaguaccauauuggcaaccauaauauugucauaggugcucucuucauuuagauauucuugggggggguggcauuuguauaauauauguguacauauauauauauauauauauauauacauacaguauauaaucuaaagcucugagagcucuuaagucaggaaugcugaguauuauaguauauugaggucagaugaaauuuuacauuuuuguguguucuguugcauuccuucugguaguuucuaugacugcauuacuccagcacucaugauugauuuuaucuucuaauuuucuuccaaguauuuuauuuuuuauuaguuuucuuuggcuugauacuuuuaaauauguuacuagucacuugaaagccucucccccaaaaguauuugguuuguaugcuuugucuguggcagcuauaacagugguaagaacauuuugaagauagcuuuuuaaaggaaccacugauuuuuucaaaaaucauccugggggaggaauuuuggcauuucauuugagcagggauuuugucagaaaauguguuuugaugguaggucagcagcagugcuagucucugaaagcacaauaccagucaggcagccuaucccaucagaugucaucuggcugaaguuuaucucugucucucaggauaaaucccuguaggacaaaucccuacuaucauuucuaccuuuuggggugacauguggaaucauacaaaggcuuaggaagaaauacguuuguuuaaaccaggaugcuuuacuuacuugaagugacuucaaucuagauuucuuuuaauauuuaacaaauuuuuaauucuaugaucagccacagucagcuauuaccauaaauuggucucuguuuauuuugaagaucacggcugcuucauuuugcaggauuaaguagggcuaauguaucuuaaaguuaagaucuugaauuaaagugaguuuuagaaauaguguuacauaccuuuucaguuguuuucaagaggcuuuauuuuuguugccuuuguagcccugaaagcuguugguauauuuuuucccucauggacccaauagaaaaguuguauauuuauuuggauuauauuuacauucuguccuuuguaaauguuugguguaacuugcacuuuuuuaaaugacccaguuuggguauuagcaacuuaagaaauucccucaucaaguaauucucaacuuuuuagucuuucuccucucuucaaaucaugugacuuuuuaaauggaaguuuuucauugauuaaaauauuuuagcaccuaaaagcuagccuuaaaaacagcuguaaaagaaaaacaucaggaaauuagauaugacuagcccaguuaauuaaaagacgggcucaaaccuuguuuuauucuuuuucaucuuggaugaagauugaagggaaaauaacucaagugcauaauauuuauuuucaauuuuuaaugagacuuuauccucaucacaacauuaauacuguacauaguaugccaaaauauccauuaauuugucuagaauaguacaagacuuuuuaaagcaauuguccucacagagaccacauguaauauacugaaauauguucauuuuuaauggcuuuguuaacaucaaagaaaugcugccuaaauuugauuucagaugaggaaggagaaaguaaagugugcauaguaaggcuguaggugaagaguugugagauaaauaguucacucaguuguacaaagcacaacuagaacuuuuuguugggaggcuuacauacaucuugaauauucuuaauguaauaauguugacuauuaaguuggcuacacagucacuguauguacuaggaacugguuuccuugacauucuagaaucaauggcuaggagaggcauuaaucuuugaggggcugaacauaucaugaagcugagucaguauggaaaauuuucaaauaaacagggugcugaaguuccaucugucucaucugcuuaugauaaguucuuauugauuagugaauguagcuuaagccuuuguauguguccucagggggcagaccgacuuuaagagggaccagauaacguuugaauggagggauuauauuucagguguuuuagcuugaaauuuauuuuuuaaaaaaagaaaaauuuaaaaaauauauaaauaaaauagaacaaagccggugaugcaaguugauauuauaaacaggcaguuuuagcacagaaagaaaauacugaccugucugcauucugguacggugggugcaggucccagcuggguaugacaugauacauuuuuaauuauucucaccagcaaguaaaaggaaaaugaacaaucuuuuggaauugucuuugaaaaggaucaaagaguaggaaauucacauuugaccuaacauuacuugccuauagaaguauggcauuuccaagcuuuugucugaggagcaucucagagaagugagaguaaaucugaguuagcuuaaaaauugguagggaggaagaaaaucucugcaaauaaugauuuuauguuuguuggccaagugaaaugaucuaucauuguguuugggagguuuuauuuucuuauguuuuuaaaauugguaaaugcuuuauagauguauuuuuauccaagugccacuccaauuuguguauguaauaaaauuauuuauauuaaaagugggaaauaauugucaacauuuuuuuugaguauagauuuauuagggguggcaaagaagagugcuaguuagcaguuuuccauguaaaguuguccuugacugauuuguccacaugucaguuguaacucccccacucccugcaaaaggaauuauuucuaacccagauguaucacuugaaacuuuuuagaagcaaaauaaucagggaaguuccuagaaagguguuuggcuuuuugguuuuugaggguugggguaaagaagacuucccccacaacugucagcacaaaacaggguauugauuuuuaacucugauguuucuauuggaguugaauacuaaauaaauaacuauaaugagggaaauacauuucuaauaaaauucccuacauucuagaaacaucccuguuuuaauuuuuuuaucuaaaucuuuuugugcuuuauguguaaagaaaaaaauguacugaguuacaaugcauuuuauuaacacuauguacauaauagcugcuuuguguucagaauaguagcaguugcuuuguauauuaaagugauccuugugaauuugugaaauauugucauaaagugcuuuuucuuacuguaaucuuugugguaucaacugucauaaugcucuuuuuacacaaacauuuaugugcagucacauaaacaugcuuuuaaaaacucuguaagucucuuuuuuggggaugggaucucuauauuuuguuggguuuuuuuugcuaguagugugaagccauguuuuauuggacuuaaaguuacaauauauuacaagcuuguguuggaaggcagcaaaacuaauucagacaacaacaugucuucaguuacuggaucccuaauuuucaggacaaaaccuguuuuucaauaagauugaacagugccuauuuguggauuuggagauguuacugucaagaugacuaauggagacauacgaccagcugugucugaugucauaaaacacguguucacugaaaggacaauaagacuauauaccuucucagguccccuugcaauucuaaaacucugugaucauauaaauuggaaggaaaggggaggggauaugguuaaucuuugcuuaagcuguaagaauaaaaaaguuaucuccuauacuauuaacuucugaaauaaguucugagacgagacaucugaaaauaagcagcugcauuauuuguauguuucuucacugccaagauguguucaagccugcuauaccugccauuguauuggaaggcuuaaugaauuucauuuauuuucugcaacaacgauuacagaauuuauugcacaaaaugagacauuuugagagugauauuaauuacaugagggacaauaggcaugaacuaggauuguucuaagcaaaucggaaucgggucacccugccacguucaggugcuuggaccuucaggaaaagauugcccaucuugucauuugaccaggcacugaagugacaagaccauccuugagaagucacauccaaagauaaaauucugauccauuucuaguuuuaguguuucgccacugaagacuuaacauaugucuuuuacacucagguugcaaaacacaggcccaagacaaacuuaacuucucccccaaaucuuccuuccgcugguuuuuccaucucguaaguggugccacuauccaucuguuaaauuguuuaggggaaaccuagaaaagcacuaccuuaaucaguguuauccuucuucuuaacugugcguccuaauuucuccacaucuuucuuaagugcagugaccaaaccggaugagaauucuaacacgggccugacaucaaauggaaaggaaggauaauguccaggaguuggaauguuauccuuguuuuuaauuaagaugcaauucacauaaauuaacuuuuuaagugaacaauuaagugguaguacauccacaaugguguacaaccaccacuucuaucuagcuccaaaacauucucaucacuccaaaaguaaagucccguuacucuccauuuucuccucccaccgcccuugucccuggcaaccaccaaucugcuuccuguuucuuuggauuuacauccggguauuucaugugagacucauacacugugu

SEQ ID NO: 12726 - RNA, 45025 nt, Homo sapiens
uguaaccaaguuuagugagcaaacgaaagcugucagacucggaagaagaguugcuaauggagcgaacucuuuacuaauaacggcuuucuacagagaucauugacacagcuuccaguuacaaaugcccgugcgcuuccaguaggaccggaaagcucccagcagccagcgaugaaugaaaacccgagucugggauagcggcgugaggggcugggcagcugccaggcgggggcggggcagcaggucacgugccuggcuucgaggcgggcgccggagggggaacucugaccaugauugguuccuccuaaccaggugaccgcaggucgcguuccgguuggcaggcaccggccagggccagcggccuucagucgguaggcggcggcggaaggaggaggagcuccagccgcgcucucucccggcaguggcugugcuucacagcgcuuguuggguuccccaccccuuuuaaauaagccgggcuggucaccgcccucgcagacgagucagcuuaagggaggcggcggcagcgcggcggugggggugcggccgaggcccgagcccugcccggggccgggccgcggggcgggcgggcgaaccgcgggcgaggcggcgucugcuugcgcggugcagccccagcguagcccggggcugccggugccggccgcgccauuguugggggagggggcggcuguugagggcggcggaguagggggcgagcgaaggcgguggcagagaggagcggaggcuucccauggggaacacgcugaccuguugcgugucccccaaugccagccccaagcugggccggcgcgcggggucggcggagcuguacugcgcguccgacaucuacgaggcgguguccggggacgcgguggcgguagcgcccgcugugguggagccugccgaguuggauuucggagagggcgagggccaccaccugcagcacaucagcgaccgcgagaugcccgaagguaaggaggcggcggaugccauccgcccucgggcucaccucugcccgccuccucccccagagucccccgggaggcauccgccgccucgggcuccuuccugccgguagccggccccgggacgaaggcugguucugccucgcguccccaccccuuauucuugcccugcugcgucuggccaguuucuuuuccuccuccuuaccguaacgcccaguucuugcucccgcuucccauucucccaagccggcgugggacccucuaguccgccgcccuucuuguuuguagcucuguucauugucuggugggacuuugcuaagacuuuugggguauauuguuuuccuuuucucaauggaaacucaaauaccucaacuucggaguacucaucccauucccucccuuaacccauccagaugguaccuaagugaaggaaccagguaagggucugauuguuccuuccucccauccgugaagauagcugaugcccgcgacaguuuagacccagauguuugaggauuucuuaucuagacucaaaauagagguugccauaggagacacuauaugguauuccuaauagguuaagucggcgugaaagaagcugcuuuauuccuuccaacuauaauuugaacacagaaagaaagaaaauggggggaggggcguaaaaugacugugaagggugugagagguuauuaccaggggugcagacaaguuguuuuuuugagacggaaucucguuuugucgcccgcccaggcuggagugcaguggcgcgaucucggcucgcugcaaccuccgccucucgguuucaagcgauuccucugccucagccucccgaguagcugggauuacaggcgugcgccaccacgcccagcuaauuuuugaauuuuuaguagagacgggguuucaccauguuggucaggcuggucucuaacuccagaguucuugauccgcccgccucggccucccaaagugcugggauuacaggcgugagccaccgcgcccagagguuguuaacucaaaggaguuuagccacggaguucugauuacuuuaaaauucccacgguggcaaauacaucuccagccauucuccggugacuuaacagacuucaauaccuccuuguucuaaaagagagguggggugguucaugguuagaaguuucaaaagagacaaaguauaaauuuagacuuaauuuauaauguaaugguuuggaaguuaaaaugcuagacccugccugcucaagaguauuuguuuccgugguuccccuuccuuccucccaauccugccaauagaauccuggucaaagaugagaauguugggguucgucagacucuaaaccguugagguaggggugaggggagaggaaacguuuaguuuuuugccuuuagaauuuuggaaagagauaagucuagguaaaaauaauucuggguagcagcgugauucuugaauaaaaacuaauucuuuugaaguagaaaaacauuguaucauaaagauguuuaaauccagugggcucauuuguuucguauaaaugccagagauuucauuacuauagaagaaauguguuagaacucuuauauuuaaacuuugcuuggacucuuaauuucuuuaaaauaauaauuaagcuucaugauggacaugccuuuguaacuaggaacuacuuuacuuaccuuucggaauauucagacauugugaaagaaugaacaaauauauuaugugaguuaauugauuguaccuuuauacacaaagcauguaagugcuugugaaaacuuaaugcucucuuaguggugucagguaagccucugagugauuuuacacaccaguuaguagaugggugggugguguugggugagagccccaaauaaggcucccacccaguguacaugaaaauacauacuuucauguacauguaauuuagcccuuccaaaauaaggccuguuuauauuccccguguugcuaaugaagaaauaaagaguuagguauguagaaugacuauguaagacagccacugagcagaacuaagguucucaguucucagacugacauggaggugagauauaccaaguucaguucuuaaaaaacuuuuaaaaauccagaaugcaucauguauuuuacccauaaaauaguccuguuuuugagaacuuacuucggucuugauuaguuccuuucaaaguuuauuuuacacgauucagaggcaacacuuacaucucuuuuuuuuuuuuuuuuuuuuuuuuuuaagagaaagagucucacuguguugaccaggcuggccucgaacuccuggccugggcucaagcaguccucccaccucagccuccugaauagcugggaccacgggcgugugccaucuugccuggcuccaucuuaugucuauacauucauuucaguggauaagaauaaaaguagagguaacaaaauggccuaaauauacccaucaaauaaacagguugauaaauuuuaaagaguuuguucugguaacugugaauugaagcugagaaugcacuggacagaggaauauuagaagcuggcaagagggaagguaagguaccaggcauuaagcaugggaugaugauaaagagugcuaaaucagaaaaguuggaaaaagagaauuuguaagcacagaauuuaccauuguauguuaguaugacaguuacauuuuuauuucaauuugucucaaaauuuauuuuuguggcauucaauaaagugauaauagaaaucuccauuucggcauuugccuauuauucauaaguuuccauagaaacauggccagaacaccaaauauaaaguauagacacauugaaaguuugcuuuuaauaucuuuauuucagacaauuuuauaucagucucccuggaaacagaaauucuuacugagauguaaaacauuuggcugggcaugguggcucacgccuguaaucccagcacuucgggaggcugaggugggcggaucacgaggucaggaguucgagagcagccuggccaacauggugaaaccccgucucuacuaaaaauacaaaaauuagcugggugugguggcgggcaucuguaaucccagcuacucaggaggcuaaggcaggagaaucacuugaacccaggaggcagagguugcagugagcugagaucgugccacugcacucuagccuggacaguggagcaagacucugucucaaaacaaacaaacaaacaaaaaauuuagcuuuucuacaaugaagaauuauuuuuguuacuuagacaaaaaucauacauaaaugacgcucggcuuuguucuucaagcuauuucuuuuuuuuuuuuuuuuuuuuuugacagagcuucacucuugccuaggcuggagugcaauggcacaaacuugguucagugcaaccucuuccucccguguucaagugauucuccugccucagccucccaaguaguugggauuacaggcauaugccaccaugcccagcuaauuuuuguauuuuuaguagagacaggguuucaguauguuggccaggcuggucucgaacuccugaccucaagcgauccagcugccuuggccucccaaagugcugggaucauaggugugagccaccgcgccuggccuuuuuuuuuuuuuugagauggaguuucgcucuuguugcucaggcuggaguggaauggcgcgaucucggcucacuguaaccucugcgcccagaguucaagcaguucuccugcuucagccuccugaguagcugggauuacaggugugugccaccacgcccagcuaauuuuuuguguuuuuaguagagaugguuucaccauguuggccaggcuggucuggaacuccugaccucaggugauccaccugucucaaccucccaaagugcugggauuacaggugugagccaccacgccuggucucgucaagcuaagagaugcuccuaagaaccuaguaaacauuucagauagacucaaaguauuuucuacuaccuugccuuuauuuaacgguaugucuaacauaacugacgguaguaucaguaacacaaaauaagauacuaagaucuuauuguccgauuuuauuaguacucuugacuuuucauggagcauuuuauguucugacguuaggagcuuugcuaauuugcuggcuaaaggcgcucucugaagugacucuuucuauucuuuuccacugaugggugaagguagggaaagaauuggcaauguaauguggaaaaaccucugagcaacagaucuuuccucuuuccaguagcuauuuuaagcccucucuuuuuuuuuuuuuuuugcuuuuuugaauaauauguuugauguaaaagacauagagaauacagaaaagucauugauuaugguaugcauaugaauauaacauuuuauuuuagaaaaaugagaucauucuauaugagcugcuucauaacuuacagcagugaaauaaugucauaaauuccugaaucacugcuugacauccagagagugcuccaagauaucuuuccaugccaggacacccugcucuaucgcaugccuucuaguaacugcuuaauguaccaucagaugguuggaguaucauuuauuuaccuauccuuuaugauugggcaucuuuucuaguaacaucauacacagucucauuacauuugauuucaaggguaccgauaaaaacauauuuugaugacugaugccuuguaccucccuguagaauucaguuaaaucuauggguugagucauuuuguaguuaagauauuuuaguauuaaauguucuuaugggccaggugugguggcucacgccuguaaucccagcacuuugggaggccgaggcggguggaucacgaggucaggagaucgagaccauccuggcuaacacggugaaaccccgucucuacgaaaaauacaaaaaauuagccgggcgugguggcgggcgccuguagucccagcuacucgggaggcugaggcaggagaauggugugaacccaggaggcagagauugcagugagccgagaucacgccacugcacuccagccugggugacggagcgagacuccaucucaaaaaaaaaaaaaaaaaaaguucuuaugucaaauuggaguuagcauugacuuuucccuggacuuuagaauucaucauuuaauauuuuuuguuucuugguagccuaucuugcaucuuuaauucugaauagcuaccacuuuaaaagauuugaugcuuaccacuuuaaaagauuugauuagaugacaaaucaagagagaauguuagaagaaauauuaaaagaugugggaaaacugggagaaacuugacuaguuuugggugugcugaaacagauguuuauugaguaccuuuagguggccaggcuguguuccagauuuagggcagacagugguauacaagacagaaccucauccuaacucugauccuuacauucuggagggagcuagggauagauaauacaugaauaaucaagaauguuagguggugaggugcuagggagaaaaguaaaauagggucauggauuggggaggaggacaguuacauggggguuguggggaugaaagauggcugcucuccuuacgugaccugugagcaguccuaaagugagaagggagccuugugaggaugguuggugagagccagggguccacacagacaguuacuuuggaguuccuugaaugggagcaaacuuguuuuuggccaaggacagaaagacacaggguggcugcggaagagugaaaaggaugccaggacuaugguggguuaaggccauguguguauagugggccuuggcaaagaauauagacuuuaguugugauaggaaaccauuggaggauuauagccugggaaauauuuuuaauucuuuuuuuuuuuuuuugagauggaaucuucacugugucgcccagguugaaguacaguggcucaaucuuggcucacugcaaccuccgccuccuggguucaagcgauucuccugccucagccucccgaguagcuggggcuacaagcacgugccaccacacccggcucauuuuuuguauuuuuaauagagaugggguuucuccguguuagccaggauggucucgaucucccaaccucgugauccacccacccuggccucccaaggugcugggauuacaggugugagccaccaugcccggccaauauuuuuaauuguuuaagaaaaagaucagacgguggcucaugccuauaaucccagcaguuugggaagcagaggcaggaggauugcuugagcccaggagugggcugggacuagccuggacaacgugcugagacccugccucuacaaaaaguaaauuagccaggugugguggcacacacccauagucccagcuacucaagaagcugaggcaggagaaucuccugagcccaggaagucaaggcugcauugagcugugauugcuccacugcccuccagccugggugacagugagacugucucaaaaaaaaaaaaagaucagacuagcuguaaaaguagguagcaaagugaugaauagacaagucacagaaaaauaaaugcagaugauccuuaaacacagcuucacacuuaagagaaauacaaacgaaaacugugcugugauuucucuucuguugggagaagauccaaaaacuugacaauacauucuuugguguggcugcgaagaguugcauucguguauugcugguuaaaauguaaggugguuugacucccugaagaggaauuuggcauaaucucaaacauugcaaaugcauuuaauccagaaauccuacuucaaggaauuuauccugaaggcauaccccauaaauaugaaauaacaugugcauaagguuuuguugcauuauuuucaauagcuaaauauuggaaauaauaugucuaguaagaaauugguaaaauaaacuguuauauccacacagaggagaauuauggagcuguuaaaaaaaaaaaaaacucucuuuacugcuauggagugauacccagauauccaggauauguuacaugaaaaaaaacaaggaggagaauguacaguaauguaugaaauaauauguauuugcuuauuuaaaacaacaacacugaaaggaauucuuggugguggugugugacuguuuuucccuuaauuucagagguagccaaagugcauauuugcugaagauguuauuuugguaugggcuuuccaauaaaugcuaacuguucacuuuugcuuuuaauuugugaaaacuuuguuuuauaauuuauugugcauuaugugguauauagcaauugcuuuuuuuuuuuuuuuugagauggagucuaguucuguugcccaggcuggaguacaguggcacgagcucagcucacugcaaccuccaccuccuggguuccagcaguucuaaugccucagccuccugaguagcugggacuacaggcaugugccaccacgcccagcuaauuuuuauauuuuuaguagagaagggguuucgccaucuuggccaggcuggucuugaauuccugaccucaggugaucugcccaccucagccucccaaaaugcugggauuacaggugugagcuacugcgcccggcuuauagcaauugcucuugcauuucauuuuauucucacuauauuuugaguuagguaguauaagaauuauacuuguuuuacauaugagaagacaggcuuugagagguguaaauugaguuugccaagguuuuuuaauuuguuuuuuguuuuugagauggucuuucucuguugccgaggcuggagugcaguggugugaucauagcucacugcagccuccacuuccugggcucaagugauccucuugccucagccucccaaguagcugggacuaagaguuuuccaagguuuaaaaagauaagacuugguauggucagguguggugguggcucaugccuguacuacagcacuuugggaggcugagguggguggaucacgaggucaggagauggagaccauccuggccaacauggugaaaccccaucucuaauaaaaauacaaaaauuaguugggugugguggcacaugccuguagucccagcugccugggaggcugaagcagaaaaaucgcuucaacucaggaggcagagguugcagugagccgagaucaugccacugcacuccagccugggugguagagugagacuccgucucaaaaaaaaaaaaaaaaaaaaaaggcuugguagaucaagaauguaaauuucagauauauggcauauaggauuagaauuuauagaaugacucaugggcuucuuuggauacugccuuuuuuccaccuuuuuuucaguuaauuaagcuuuagaguuaaaauaauaacauuggauaaugaaaaaugaaauggagguacuuguaacccagacuuuuuuuuuuuuuuucuuuucucuguaugagacagggucacaacucugccugucgcccaggcuggagcacaguagugccauuagagcucacuguaaccucaaaucccugggcucaaguuauccugccacuucagccucccaaauagcuggaacuacaggcaugugccuccacacccaacuaaucuuuuaaaaaauuuuuguagagaugggggucucacuauguuauguugcccaggcuggucuugaacuguucucaagugauccuucugccucagccucccagagugcugggauuacaggugugagucacugcacuccacccagaaauacucuuaaaagucuaaaaaaggaguuaagugcuauuaagaaauacacaaagggagaaagguauacuauagcauaugaaaugucacagcucagucacgaucacuaaaacauagauugaggcgugaagguaaguuaaagcaagacugaacacugacauagaaggagguagagcaguguuucggaaaccagauuuaggauugucagaagcuaggaaagcaaaagcaaggcaugagugagcaugagacuggagcuuggcugguacugugugaccucagaugaggcagggcagcucaagacccaucagguaagacuuaccugauggguggaacgugugaacuuagauaaaaucucagcguuuacaucauaguugagagguuugaaauguuuguguuauggaccguaagacuaauacagugugcaguaugguagagcaggucaguaaaugcaguaagccuuuaaauaaacagaugcccagcaguuggcccagaaacugccaaugucuccuguuuaauugggauauauugaaaucaauauguugaacucaaucucuuucucugaaauaugcugcuucugucaguuacuuucuugguugcugcccucucccuuuaauauuuugacaagaaaaauaauuucuuuacaguuuacaauugcauaauuuuaacacuuuuagccuuuaguaauaaugcauuucauuuauucuaaguuccauauuuuuacauuuuuaauuaacaucugugaaauugagauggcugauagauucaaggagaagcaguguucaaugucaguggaucuuacagauuucuuccccugagggggguguuuauauuaagaccugaguuuaauuuuuuuuugucuuacuugccccccaucauacuaucaugcuuucgaauuaaguugcaauuuaaauugauaauacaaaacuggugggucuuaaaauacaauuuuauacauaaccccuaaccaugauaucaaaaacuauuucuucuaguuucaaacauucuuaggaguuuuuuguuuuuuuuuuuuuuguuuugagacagagucuugcucuguugccaggcuggagugcaguggcgccaucucggcucacugcaaccucugccuccugagcucaagcaauucuccugccucagccucgguggcagcuccuggcuggcuagcagugcuagaguacagcccugccuuucuccuuugguucuugggaagucccaagagaaauguaauugauuggccagcuguaagucacaugcccacccuaaaaccccugaguugagggagugccagcuuguuacuugggcuuauuuggcuuuuuucucuauaucuuaucauuucuguuauccuaguugccuuggauuuuuuuuuuuuuuuuugagauguagucuugcucuguugaccaggcuggggggcaguggugugaucuugguucacugcaaccucugccuccuggguucaagcgauucuucugcuucagccucccgaguagcugggacuagaggugcacgccaucacgccuggcugauuuuuuuguauuuuuaguagagaugggguuucacuggguuggucaggcuggucucgaacuccugaccucaugaucugccagccucagccucccaaaguauugggauuacaggcaugagccaccaugcccagccgccuuggauauuucuuauauuuacacaguagcacaucuugguuuucuuauauuuaaauacauaguagcacaucuugauuuggggcgggggaggugugugugugaagccugcuccucuuugauuuugguacuuaauuuuccuggacuucauugaaaauuccuaauuaaacuuuaucaugacauagguacugauucauaauauggcuucuucuguaaacauuaguuauuuuuuagauucaaaugguaguauauuugcuuucuuuuugaaaggaaguagucaugaauccuuuuagaagcuuuagguagaggcugggugugguggcucacgccuguaaucccagaacuuugggaggccgaggggggcagaucacaaggucaggaguuugagaccagccuggccagcauggugaaacccagucccuacuaaaaauacaaaaauuagccgggcauggugaugcgugccuguagucccagcuaguugggaggcugaggcaggagaaucacuugaacccgggagguggagguugcagugagccaagauugcaccacagcacuccagccugggcgaaagagugagacucuucucucggaaaaaaaaaaaaaggagcuuuagguagaggcagcugugaaagucucugccugucauuuugugcacaaaugauuuuauuuuuccaaauagcuuaaaauugucacgucaucuuuucaagauguggaaaaacuucaaacauaauuuuugugugggucuuuuacauaagaauaguuuccucuaaaagcaguuuaaaaaaguugagugaaggacuuuccauggagaacaaagcaguugguuuagguauguaaguuuuuagugaucuggcaguacuauuaaaauggaugauucauaauucauuuuaaccaggaagucccaaaauuauguucauauaagauucuaaccaaauuacuuggaagagagaaaaggauucuagguagauaaauuugugaaaugcugaguuagacaguaaucacuacuagacugauuaguuuuuaguauaucaaugugcguuuugauuuuguaagagccagggauagaguauauugucauuugaccacuaaaucgcuuuuuuaaaaguagagcaauuauauuaauauguaguuuugggaaauaucgccuuaacuguuacucuggaucuuggcccaguuucuuacaagauugguuaagauaaguggcuugaaauggaccuugcugggcugggcgcggugacucaccucuauaaucccagcaccuugggaggcugagguggguggaucaccuggggucaggaguuugagacgagccuggccaacaugguaaaaccccgucucuacuaaaaauacaaaaauuagccggcgugguggcaggcaccuguaaucccagcuauuugggauacugaggcaggagaauugcuugaauccuggaggcagagguugcagugagcugagaccgugccacugcacuccagccugggcaauagagugagacuccaucucaaaaaaaaaaaaaaaaaaaaagaccuugcugaagaauaucauagauuuuuauuuuuuccccucgugacaauuuuuauuaucccauauuauggcaaaguuuguuucaugaaaauucaagagucuguuuuguagucuugccuaaauauauuauccaacuuuggugcaagguggacuacaggcagguuuaucuugacauagauaggggcaaaauuuuuuagaaacagcccuaagaucugcuuuaaaacguacucuugaugaaacaccaaauuaaccaugcuguuagaaggaagaagugagaaauugagggcaaacguuaaucauuuucuaacauguuucuguauguuagaacacagaacuuccauucaguccucuuaaaucugccaugaugaauggccccccaaaaaaccacagcuaacuaaauuaguuuacuuguugaauggaguuagaauuagccguuuaauugucuaaagaacauuugccaaaaacaacucuuuguuuuaccauauuugauguauugagcuggugccugacaguaacuggccacagcaucacuugcuacuugagauuguucuugaaaugugcuaguaauagcaguagagaggagagugugguuauauuucuauuugauaaguugaaggaggaggacaugcguaugauucaucuaacauuuguaccagauuauuuaggcacagauuuuuuauuaaaagucucugacacagccugguuuuuguuccacguguguggagagauucuacaauuuugcauuccccaggaguauuuuuguauugucuuuauuuccuuuauauuuauuacuaaaaacuucucugaagacuguuaaaagugauuaaaauggauguguaucuauuucagaaaucaucuuuucuacucaccuaaagugucacgucuuuuuccuccucuucuauagauuuagcuuuggagucaaacccuucugaccauccaagggcaagcacaauuuuccugagcaaaucucaaacggaugguaagacaauacuguuuuuuccuuccaaggaaaagacugaaaacuguuucuauuuuauuggauguauuauagaagguauuuagaagaacugauguauuaguuuaaaauuuucuuuucauauguucacugauuuuaauaugugauauacuuuccuuuaguugugauuguuuaguaauaacauguagaccuauuuacagguuuugccaccuuuuuauaacacaauuaauuggccacaugauuuaguaacauggauuuuuuuuuuuuuuuuugagaggcuggagugccuuuauugcccaugcuggagugcaaugauguggccucagcucacugcagccuccaucucccacguucaagcaauucuccugccucagccucccaaguagcuaggacuacaggcaugagccaccauguccggcuaauuuuuguauuuuuaguagagaugggguuucaccauguuggccaggcuggucucaaacuccugaccucgugaucugcccuccucagccucccaaagugcugggauuacaggcgugagccaucuggccaguaucauggauuuaugcauauuucuccauacuucuuugaccucuuucccuugcuccaaaagaguacauuuuaaagaugaaugauaggauuuaagcugcagcuugguuucauuugaacaacaacaaaaaaucaguucguauacagggauugaaucugugauuuuggcuuccuuuuauacaaugcucuaaccacaugagccuaucacauucaaauuuaugcuacucagaacuuuuaagcuauuaacuuuuccauccuaauguaguguaaauauaaacaugccccaugguguuucccagaagguuagccucagcaagugaaacuuacguacauuuuccuuguccugcuuguuuuaggaugagaaucagaacuguuguauuuuucuguacuccuguuuaucuuccuuauaauuauguuaaauccuaauuuauuugcuaaaaagcuauauacaaccagguuuuucauuugauuucaacagcaagaauacaagaaguggggguucuauaauacuugaaguaauggagcacaacacaaagcaggggaguuguaagcagcauuuucgaagcucguguggacuuugucuugagcuggucauuucugguuaggauaguuguauuucucaguuucuuucagagccauaggcuucucacacagacagaguguggaagcaguaaaagaagagcuaucccaugcuccucuuucuucagugguaaggagugugugcuugugauacuugucuagcaucaaaggaagaggcaguauaggaaacaaagcgugguccaagucccucuuggagcuuuuauucuucuggccuuuguuaaaaugauuuuaugugcugaauauaccauguucaauuagguuaacauucauuuuaacauuuaaauuuaaggaaguuuacuuuccacuuguguaaagacccguuuauuuuuucaguaacauacuaguagaugaccaguaagugguucaggauguuugcagugauuguggugcagcuagagauuggcaccuagccagaaacugguucuuagagcugucagguguuagaucuugguaauuaaaguaagcuaccuguaaauguagaauuaaaaaauacugcuggaugaugguucagauaugcaacagggaaaccuauuagcuaaauuucucauuuagcauaauuuguuuugccccuuucuuuuuuauguagggauucuuucauuuccauguaauagaauaucugucaguucaaaaaguaaaacuaaguuuuuagauuuuauuuuaugggauucaucuugccagaugauuuaaaugaugaauuuuguuggaaauuauuuuuuaaauggaauuuuaucucauuuuguauauuguuaaucagaugauuagcaacuacuuuuauacuguggcauuuguaucagaauugaucagcuaauuuuuuuuauucuuagugcgagaaaagaggaagagcaaccauuugaaccauguaaguaaacaguuggaaagcuaagaaauuaacaguugaauuaaaaguaugucugucaugauuccauaaaaauauaauggggacccaauacuguuaguaugagccucuuuuuguggauuuucuaaaucauuucuauuuugcugagaaucagauuuaugcaggaaagucuuugacuuaguguacccaauuguuaaggguuucugacauuuaaguuaaauuucaauaguuugguugugguauaaauaucugccuuaaauauuuuugccuaaaguuuuuaaucuuuuuaaaaaucaaguaacaaaauuauaauagcuaaguucauuuuuagcacuauauguugacuuccugucauaacaagugaaaacuuagcuuccucacuccaccgugaccuuauuuucuucccucuauuucucccauauauaucacauuuuuaauuaaaucaguaauugauguuuacauuguuaugauuauacagauauuauucacugcugagucauauauuauucucacugucuucuccuuguacauccuuuguuucucuuaaauauuucugaaaucugggcgugucugcacgucucuuccuagccuccacuagcucacacagccaaaugcaguaguaacccuuggcuggucuccuugcuuucaugucuuuuuuuuuguguguguggaauuaauuuccugacuauauucauuuggcuguuuucuaacagcuauuuuuccccccaaauguuguagcauuugccacaugccuaucaaaaauguuuuccaucuacuaaaacacaucuguuccauuuuucucuuggagacagcuuuccucagccuuuugucauccucuucaaauauagacggguuuuuccuaagacuguucugugccuguuuuccugggauaucucucugaagucaucugggaucucacauaacuguccuuuuguguuggguccccuaaauccuagauucuguguuucccucuaucuuguuauccuuccuaguuuuaccggaguacauuuuccugggaaagggcccauagacagacauauuuagagaucuagccugucugaaaaccuccccuauuucuuucucucucucucuuuuuuuuuuuuuuuugagacaaagucuugcucuugucccccaggcuggagugcaguggugcgaucucagcucacugcaaccucugccucccggguucaagcgauucuccugugucagccucccaaguagcugguauuacaggcgccugccaccacgcccagcuaauuuuuguauuuuuaauagagacgggguuucaccauguuggccaggcuggucucgaacuccugaccucaggugaucugcccgccuuggccucccaaaguggggauuacaggcaugagccacugcaccuggccuuuuuuuuuuuuuuucuuuuuuucucuuuuuugagacagggucucacucuguugcccaagcuggagggcagugguguggucuuggcuuacugcauccuuaaccuacugggcucaagugauccucccaucucagccuuccgaguaacugggacuacaggcaugugccacuauguccagcuaauuuuuguauuuuucauagagaugggguuuugcccuguugcucaggcuggucucaaacuccuggccucaagccauccaccugcaucagccuuucaaaguguugggguuacaggugugagccacugcaccuagccaaagcuuccuauuucauaagaguauaaaaugcuagguucacucuaaauuucauaguucugaagacauuucucuauuauguucucauuauaguauucuugaaucuguugccauugugugauacaguucauguaaccaguuuuuacaugucuccggaagcuuuuuagugccuucuguaucccugagauccugaaauugcuuaauauggcuugcuauggaccuuuucuuuuuuccuuuuuuuugagacggagucuugcucuguugccaggcuugagugcaguggcgugaucucagcucacugcaauccccaccucccaaguucaagcaauucuccugccuuagccucccaaguagcugggacuacaggggcgugccaccaagccugacuaauuuuuuuguauuuuuaguaaagaagggauuuuaccauguuggccaggauggucuugaucuccugaccuugugaucugcccgccucggcgucccaaaguguugggauuacaggcaugagccaccgcacccggccuagaccuuuucuuuuuauugggaccaauaagucuguagacuaugucuucuagagaauuuuguuuucuuuguuccuucuuuuuccugauauucuuacuauucagaugcugagcuuauuagaccaguguuucugcauugaucuuuacuugucuccgcccccccccgcccccaccccaccccccccacccccccgcacucucccauuuucuaguuagucuuuuguucuacuucuugggcauucuuuuacuuuaugcucuaaccauucuauugaaucuuucaucuuuuugaagguauuuuaagaauuuuuuuaaguuuucauuugcuccugaauuuucaccacucccaugcauuccuuuuuccuauuguuuugcucucucuuguuggaggcuucccucacgugugauagucucuggcuuucucuaauuggaagcaggacuuuuguuaacugaugauucuuacugcaaggacauuggaggccaagcuagccuuuaauuuagaagaccucagucuguuaucuggugggucuugucuugucuuuucucucuucuuuuuuaucuccuuuccuuuccuuuccuccuuccuuuccccuuuccuuucuccuguccuauccuuuccuuugcuuuucuuucugagagagucucauucugucauccauacuggagugcaguggcgugaucucagcgcccucugccaagaugcaaccucuuccucccgaguucaagugauucuugugccucggucucuugaguggcugagauuacaggugugugccaccacgccuggcuaauuuuuuuuuuuuuaguagagacaggguuuugccguauuagccaagcuggucucgagcuccuggccucaaguucacccaccucagccucccaaagugcugggauuacaggugugagucacugugcccugcuggaugcgucuuuucugagacuguucaguuucuucagagaagaaucucccaauuuucuaccuggggaguacaagcauggcugcucauuuuccagaagcagaguuggaaaagggagguggaguuccacuucucaguguguaguuuuuuuucccauuucccagauuucaguccuacuauuucugagcccagaaccuucuauauuccuuauaagaugggaggacagguggaccugggacuccaacuacauauuuucagccgaccuugcuggcuuuuguuuuguguuucacucuaccuuccaaggugccaugugccucugaguuugaagucugccuuggguucuguaagacaaacuaacuugauccuguuccagucacucucuguaggcacuaaaguugugcuuccauaucaguuaccacuccuuugucuuuuucaucuuucaagauuuauuaaaagucaucugcuguggccgggugcgguggcucacgccuguaaucucagcacuuugggaggcugaggcgggaggaucacuugaggucaggaguuccagaccagccuugccaacauguugaaacuccguuucuacuaaaaauauaaaaauuagccgggugugguggugcacaccuguaaucccagcugcucgggaggcugaggcaggagaauugcuugaaccugggagguggaagcugcagugagccaagauugcaccacugcacuccagccugggcaacagagcaagacucuguuuaaaaaauaaauaaauaaauuuauaaacucugucucaaaaauaaaauaaaacaaauggaaauauuaucugcugucaauccuguugccugcuccuguguauaaccuuuauuuuaugucuuuaauucuaaugaaauuucaggagggcaaggaaauaaauuuauggucaaucugccauguuuaacccaaauuuagaaccuuuauuuaaaguguaaaucuaaguuuaaauucaacauaaugauacuaauccagacauuuuuuaguuauaauaagcauauuauacucuucuaguaaggccuuaggaauuguauucaaacucugcauccugcuauauugccccauuacugugcaacauagauggagguguuucauuaaugcacaaaaugucagaaauuuuuaaguuaauuaaaagucauuaauucuuuuuuuuuuuugagacggauucuguaguagcauuuaccucuuauuuuaaauggguuaaaauuagaggcaguaggcacaaugggaaaagucaguggauaggcauaggaguucaacagguacuuuaccuuuaagguuucaguugugacucaguagauuacuaaguaugauuauuuucuaucuuugcuauucucccuuaagucuacucaguaccccuucccuuucuuguuaaagauugucauuugugcagacuaaaugaagaugaaugauauauucuuugucccuauuuugugacuaccugaaaugacaucugugaacuuucaguaguguuuuguuguuuggauuuuuuuuaaguauuuauauuuuauauuauuauguuugucaauagaguuuguugagguuguaagucagcuuugguaaggcuuuagccuaaaauaaaggaaauuguugaguuuuccagcaacaugaugggggaauuaccuguugccagcuauaauugcuuugcucagaagcuuaauucugccacccccuagucucaagagauauagugauacucuugauaacaaaaaauuuggauaguugaaaguuaguggugugucucaugcuauauauugauuagcagagagguuucuucuuuuuuuuuuuuuuuuuuuuugagaccaagucucgcucugucacccaggcuggagugcaguggugcaaucuuggcucacuacaaccuccgccucccagguucaagugauucucuugccucggccucccgaguaguugggauuaugggagcccaccaccacgcuuggcuaauuuuuguauuuuuaguagagauaggguuucuccauguuggccuggcuggucucgaacuccugaccucaggugauccacccgccuuggccuuccaaagugcuggaauuacaggugugagccaccgugcccagccccaccuuccacuuugaaugaauguauuugaaugagucaguuuuuauuuuuuauacuguauguguuucuugagacaauaaaaguauauacauuagcacacauacacaguuaauguaaacuauauacauuaaauauaauagcuuaagaaacaugaguuuagauauaguugaaaacauuucuagguugaaggagaauuugguccuucaaauaguaauacuuuuuaaaaauagaauaucugggacuuuuuguuaguaagaauuaagugacugcaguaaaaacaucugaaacaaaaugcuguuacacuguauggauauuucugauuauuggcuacuggcgauuuuuuaaugcaugcauuuuuaaaagcaaugacuagaccuucucccugcccugucuuucauguauaugugugggauacugaugggagagugugacaacaugguaaaaacuaucauauuaauaggaagaaggaaggcucaucugaauuaguuuuuuuuuuaaguguuaaaauuauuaguauucugugguuuuaaaaaaaaaugcuacuguuacuuucagcuauucaaugacugggauuugguuacugaccuucuuaacauaguucaggcuguuucaguauuugacuguugcacucuucccaaauaaauggauacuucuaaaguguuuuaaagaugguuuauuuucuagagggcucaaaaaguucauagucaccuccuugauacaaaugcagauaaauucugcuaauuuguguguaguagcauuuaccuuccaaauuguaacugauuuaaauaauuugucaaacacuuguugaacuccuuaauuuguccccaauucugugcucagcagccagagguaugaggaggaagaguccuuccuucccuggagaagcuuacuuucuugugagggguuacuccacaagcaguugguaucauguaacaaguggugaauuagauggaugaauguaccaaaagggaaauguuuuuugguguggcugcgggcaaagggaucccagaaggcagauggggucaggcuuaucgggauaaggaggaagaacaagguauuccaggcagagcagcaugagugagucaggcaagugccaugaugccugucaaauaacuuauagaauaaaauuaauaacauuuugaaauggagaguguucucugagguucucauuugaauaauguaauggcaguuuuauuuaaauaugaagugcaaguuaaauuccuaaaguuguuuuugucaucuuuuuuguuuggaauauuaaagugauacuuuuucuucuccacauaagaaaacaggcccuuucacugagggugauggagcagcccuggcagacgaagccucugacugugaaacacuuguuucucauacugucuccugaacuaauacguuuaauauuaguaacuuaguaaauguaguauuaggcuuucauuuacuucaauaaaaugcucuuaugcaaauaugauuuaaggcauuacauuuuacuguagugaaggaauaauagaaaaucucagcugcuuuuuauugcuuaagaaaaaacacugaaaucuuauuguaaacuuuucccauuaauuuauacagggaaugcauaacagaugcuugccagguuugauuauagguaccacaagagcagcauuucauaacccauuccucaaacacugucugugggagagccuccacuggguuucccauagagcugcacaugauacuacacucaggcaguucauggaguguaagaaauaucuuaaugcuuuaucauuugacauuuuaaccaaggaaaaaccacacuuuuauagguuuaacuuacugugacauuuucuucuauuucccuuccccuucagguaucuccagggcagcuuacuaaaaaguauagcucaugcucaacaauauuucuagaugacagcacagucagccagccuaaucuuagaaccacaguaaaauggugaguacaacuaggcugccaagggcugagugacagacccccuuaugcuaaaagcauccuagccauccucgguaauuucagccauuugauuguccuuuucagcaaugaguuuaagaaaucggugucaacuauauauugauuucaaggaucuaaauaugaauuuuaauuuccuguuuuaaucuuaggcugcaugguggaagggaaagccaguuagugaagaagcaaucccagaaaaguguagcuauuuauuuaaugcauuuauguuaagacagugucgaacauaaugugagaaggagaggugcuuuuuauuggauguuucuggaaaaacguuaguuuguuaugaguuacaggucucaaacaauguguacugcuuugcaaacuacucuuggaagaaggaacagcuuguccucuacuggcaccauaguguaucugcauuuacauuuucccugucgugcaugagcaccucuugggcacaaucugagaugcacuuucagaacacccuaagaugaacuuuucaaguuuauuuaaaaaccaacaacaacagcaaacaacuccauugggguugucaggaaacuauuaacaucuccuuggauuaugagcguugauuuucagaacaccguugggaagugcuacacuagaauauuaauguccuuaucccuaauuuuacuuuuuagucuaaaaacauaacuagcuuauaaacuuaauuuuguuucuaauguacuagcuuuuuuuuuuaguuaauucaauugucaguaacuucuacuuuaaaagcagcaaauuuacacucauaauaaugucacuuuccucucucacuuaaaacaauaguugaaaucaaauuguguuucagcacaaacuggacucugacucugucuaaaguccugagcuuuggcaccuacugaguaaucauucaauguuuguauucagccaagguccuaaauccuugaguuaaaaaaccacuccacuuuggcuagagucccuggcuucuuuugaauucaaaagauucugauguuucuauaagauucaaaguaguuuuaaagauuaaccuugcucaaacaaguauaauagauuucaugcuuuuuuccccccauuuuagucuuaauuuuuagaugucuacuuuuggaaguacaguaaguuuuaauuuguucucaguaaguuuuagaaaugaucauuugguauauuucacuacugguuaaauaaagguuucacaaguauggcaaauugacuuuuaggaaagauuuugaaaaauguuuaucauggcuuacuagugcguuauucucauagguugggugagccauaucagaaucacuuacgcaacuuuuuucaaaauauauguccacaaacaaauucaucucaccuccaccuucccuugaucucuaggcagucacaagccuuuuaggaaaauggagaaggcaugugaggcauaauuacacagacaagcacaucccagaugauucuggucuuaacccuaacucagucauucccaaaauuugcagcacauuggaaucaucaccaggggaacuuuaaaaacaacccucaggcugggcguggugacugacaccuguaauccuagcacuuugggaggccaaggcggguagauugccugagcucaggaguuugagaccagccugggcaacacggugaaaccccauuucuaguaaaauacaaaaaaauuagccaagcgugguggcgugcaccuguaaucccagcuacuugggaggcugagacagaauagcuugaauccgggaagcggagguugcagugagccgagauugugccauuuuacuccagccugggcgacagagcaagacucugucucaaaaaaaaaacaaaacaaaacacacaaaaagacaacaaaaaacacuccucaugccccaagucauacccgaugccaauuaaaucagaaugucucaaguuggaaguuaggcaguuuuuaaagcuccucaggugauugcagugugcagaaaguuugagaaccacugcuuaauugaauguaggaggaugaacugcuucuauuuggugggaccuugggcaagucaguuuuaagccuugguucccauaucuguaaacuggguguuggauuaaaugucauguaagguuccgugguccuuuucagcauauaacuucaaauucuguaauguuaaaaucaauuuggacaugaaaauguuugaagcacuauagaaguauccaucuuagaugcuaauguuacagacuuuuuaaaaaagugcuaacauuguauggacuuaaaauucagauuugccuucccucaauuauuuugagccucaguuuagagacugagggcaaauggaagcauauaacuuaccuaagacaacuccuuguuuccugauacacaacaucuguggguaauuuaggaauacaguaacauauaucugaaaagucgugucuguucacuaauauuuuacuuaaaccaauguggaaauacuugccauuaauauuacacuuuguaguuuuaugcugcauuguuagcacugcuuauuucaggauagcuacaccuaucauugguuuugugugcacuuauuuacuaauaaauuuucuacuaaugaugcaaaauugaucauaaaugauuuuauuugguauaaaacacuuuuauuuacuuuaaggggaaauaaugaaagauggguggguaggugauaguuaauuaaaucaacugaaaugcagagccuaacagcuuaaaaagcaaaaaauaaaaauaaccaaaaaaccaaauaguuuaaauuuaagcauguauacaaauagguagaacuuguauaaaaugaaagguucuaugggcagaagagcaaauggggauauauguaauuauuuauauauuauaauaguccacagaaacauguauuuuaacagcauauuacuggguuuuuuuuuuuuuuugagacggagucucgcucugucgcccaggcuggagugcaguggcacgaucucggcucacugcaagcucugccucccggguucacgccauucucuugccucagccuccugaguagcugggaauacaggcgccugcuaccacgcccggcuaauuuuuuguauuuuuaguagagacgggguuucaccguguuagccaggauggucucgaucuccugaccucgugauccaccugccucggccucccaaagugcugggauuacaggcgugagccacugcgcccggccuuacuuagcauuuugguucguguauuuuugcugaaaggaacuaaaacaaggggaaaguacccauaugguacuguucugaacuagaggauuucagggccgcuaggaggguuccucccuucccucauuuaaaaaaugucuucaggccuaacaaauguuuaaaucaguuguuaaaaauaauuuuuuuuucccuucacagugugaccuuagcaauauauuaccacauaaagaacaggugagcuccuuuaaaaccugucuuguuauuccagcuaauuacuuugcaugauaucaaguucaguauuaggucauaacuauagacaucauaagcuauagauugcuauuacaguauugaacugaaucauuugugguuuuucugguccccaagaugguuucaauuauuaaauuacugaggaucccaaagaguauuuguuuauguugguuauauugauauuuauugcauuagaaauugaaguugagaauuuaaaaaaaaaaacccuauauuuaguuucaguuucucaacguuggcacuguugauauuuugagcuacauaagucuuuguuguggggacuguccuguguauuguaggauauuuaacagcugucccagguugugacaacaaaaauauaaccccugacugagaaucauauuguuaacauaaauaauauuuuuucaugaaaaauaacucucuucuacaacaacgaaguugaguaaaaugugucauguauuuauauauauacaacucucuaguguccagcuuaacagaaaacagcuggauucucaucucugucuuugcaauuaguuuuuuuuuuuaauuucaacuuuuauuuuagauacagugaguacauguguagguguauuacguggcuaauagugcacccugguagugagcuguaauuuguuuugaagaagugauaagaagaugaccuagccucacgcaaauauauaguugguaaaagguauauuuuuaaagcuuucagaugguuguggguauucuuuauuuuuuaguuuauuuuuauuugguuuuuuuugagacggagucuugucuguugcccaggcuggagugcaguggcacgaucucggcucacugcaaccuccacuucccaaguucaagcgauucuccugccucgggcucccgaguaggugggguuacaggcgcaugccaccacgccuggcuaauuuuuguauuuuuaguagagauggaguuuugccauguugaccaggcuggucuugaacucccgaccucaggugauccacccgccucagccucccaaagugcugggauuacaggcaugagccaccauacccggccaguauucuuuaauacuacccaacacuccacaagugcuaguuucuuaaaaugguuacaguggaauuuuguguuaucaaugaauuuuuuauuaguacucacccaucugucuuguacaauauauguaucauuuccccuuacuugguuuucuaauauuaugcauugguuauauggaaaauauugguucacaucucuucuuucuuuuuuuuuucuuuuuuuugagacagagucucauuccaucacccaggcuggagugcaguggugcagucucagcucacugcaaccuccgccucccggguucaagcgauucuccugucucaaccucccaaguagcugagauuacaaauacauaccaccauaccagcuaauuuuuuguauuuuuaguagagacaguguuucaccauguugcccaggcuggucuugaauuccugagcucaagcaauccgcacaccucagccucccaaagugcuaggauuacaggcgugagccaccauacccagccugguucacauuucuugacaguggcaaagcucacuuuuguuaguaucaccaccaauuguauuaaaaaaucuuuaaguauugagaagcuguuaaacucacauaauaagguacaaguuucuccaaauccugauuuuuaguuugaaagcuugaauuuuaucauugcaacaaauaguguuauuuucuugaagugacaggcuucauuuuuuuaaaacuuuuuauuuauuuaucuuuugagacugagucucacucuguugcccaggcuggagggcacuggugccaucuucgcucacuguaaccucugccuuccggguucaagugauucuccugccucagccuccugaguagccgggacugcgggcgccugucaccaugccuggcuaauuuuuguauuaguagagaugggguuucacccuguuggccaggcuggucucgaacuccugaccucaagugauccacccgccucagccucccaaggugcugggauuauaggcaugagccaccacaccuggccacuucuuucauuuuugagaaugacauuuguacuuucaaguaaaaaugauauucugugaaaaaaaaauggcuuguuuagcucacaauuaaaucacaagugcuuuuccuuaacacaacucuaccucgguaugcagaauuacuuuaugugaacuuucugcuuacuccagaauagugaaaagaaaggucaagauuuaauaauaccauuaauuuuuacugcuucagcaaggauauucaugagugaagcagguguuuuucuuaaacugcaagaggcaguaaagaguagcauaacuucuaguauaauuugguagcacugccuugauucaugcugagaagccagcaguuugcccacuuuugcuguuauacacucauuacaaaugucauacagucaaaaagcaagcaauaccuuaguauucuuuuuuuuuaaauuauuuuuauuucuaaauuuucaaucagcuuucucagguugaauaaguauucuuaaaagaacaguuuugaccucaaggaccucuuggaaaaggaucuagagggucuccagaaguccacagaccacacuuggagaaccacugguuuuauuaaaugagcacaauguauuaguuuuauaaacuuguaaagauuaucaaagccuugucucuuuuaaaauaaaaagacaauaagguuuuuaacucaucaaacuacuuaaacaaauacaugucaagaauguaauacggagaacuagaaaggaaaagccugggaaaucugaauuucauucacagucauuaaaguucuaaagaguuuauugcccaccacuacugcuguguaaaacguucuugaguuccaaugagggguuagaagagugaaaauauacuuuauuaccauugccuguuagggagggccaauacuuaaaggcaauucugaaucgucauuguagaaaagaccucacaguacagaaccucauaugcugaguaaaaagaggucaggaaauccucugaaggcuggcaucccggagaagaauuuguacaacucuuugcuuuggugaagcaaacaccaaagcaaacaggaggcaucucccgccacccccagcagacauuuuacucagauauuaacaauuccugaauuaacuucuucaaugcauauucuuauuuuauagagaugcaaauagaucccuggauauuuuugaugagagaucacauccacuuacaguaagugucacuuuuuuugagguaguauuuuucucucauagaguuguguuuauuucaugcugauauuuauaaauaguccuaacaaauauacaugaucucuaugaagauaauuagaaaacaauuuaaauuuaaaucaauuaaaaugguguaaacauuuaaaaauucacuuccucagguauaugauagccgcucguggcuaaugacuauugucuuggacagugaagccuuugagccuuaugguuacaggaaacuaaagauauuuuuucaggccgggcacgguggcucaugccuguaaucucagcacuuugggaggccgaggcaggcggaucacgaggucaggagaucaagaccauccuggcuaacacagugaaaccccgucucuacuaaaaauacaaaaaauuagccgggcacgguggcaggcgccuguagucccagcuacuugggaggcugaggcaggagaauggcgugaacguggaaggcggagcuugcagugagccaagaucgcuccacugcacuccagccugggcgacagugagacuccaucucaaaaaaaaaaaauuuuucaaaguguauuuaagagaauccuaacauaugauuaguaagacuuucgagccuacaaguaguuuacauuuugauagaauucuguggauagaaaguggaaaggaacauaaaaauuuucugaguugugccuguauuuuuccuuaaugauaaauggugaugaguauugaaucacuaugauauuuuaagauccaauuguuuauauuuuaaaaacuaaaagucaugucacucaaccagaauuauuuuaagggguacaugggcucaaacgucaacacugcuggucuuaggaguacuuaggccagcugggcaugguggcucaccccuguaaucccagcucuuugggaggccgaggugggcagaucaugaggucaggaguuugagaccagccuggccagcauggugaaacccugccucuguuaaaaauacaaaaaauuagccggacauguuggugcacgccuguaaucccagcuacucaggaggcugaggcaggagaaucacuugaaccugggagguggagguugcagugagccgagauugugccacugcauuccagccugggcgacagagcaagacugggucucaaaaaaaaaaaaaaaaguacuuaggccgggcguggugucucacgcguguaaucccagcacuuugggaggccaaggcagguggauugccugaggucaggaguuugagaccagccugaccaacauguugaaaccccgucucuacuaaaaauacaaaaacuagcugggcgugguggcgggugccuguaauccuagcuacucaggaggcugaggcaggagaaucacuuaaacccgggggguagagguugcagugagccaagaucaugccauugcacuccagccugggcaguaagagugaaacucagucucaaaaaaaaaaaaaaaaagcuuaaaauuuuuuucuucaguggauacuaacauugcaucuuuucuucuuucagcgagaaaaaguuccagaggaauacuuuaagcaugauccugagcacaaauuuauuuacagauuuguucguacucuuuuuagugcugcacagcuaacagcugaaugugcaauaguaacuuugguaagauauuucucauuuauaaagugucuuuagaaauuagucuuguacacaggguaugguccuauuuuucaaauaaaaauagguuccugaaauuaucaucagaacuuuaagagaaaccuaugaaaggaacauaaauacguacauucgcguuuaaucaucauuaugguugaacauguuuccauugcuuuucucaucacagaacaguugcuacaaaaggcagccggggagauuucugguuucucccccuacccaucaaugcacauguacacauucaguguguacacauacaaggcaugguggcagggcugggggugauggggagugguaacaaaaccaugugguucagagccagauacugauuccaguguaggucuaagccaagucccaggcucuauuccccagguauuuccgauauguguggugauugagaacuauugcccuaaauucuuuguuccuuggaugauggguuuuaaucaucucugccuaccucuugugccugcucgugauguugcccagcaaugugguaccagcaauacuuggacaaaggcuuugcugauuagcuuacuaagcuauagcuguguccuuaacuuuauguccuccauacagaauuccuaugguaagauuuuaucauugaauaauaaauccuauucaagugguuaggauuguuuuacuccuccccacagcaaaccuauagaggaaggucaacugcauggccuggagggaaagaauacuuaggucaguaccuacuccuuuagcauccaauuggaauuuaggagagaaggcuucugugcacuugaauagaagccccucaguggguacuggaucagacuuaggccuuuucauggagcuguaagccauuuggaacacuuagcacauacuguagagaagcaggaguggugcuuccagauguagagagacaggugauacaggagaggaagcuguacaggaagaggggaguucauuuuagaugguuuaagcucuaugugccugugagguagcagugacaguguccaauaaucauuugaauguaccggacuggagcaugaaucugagcuuagagguaaggaaugaagaguuauaguagcuguucaaauacagagaaagguugcagaaugaaaguggagaagcuaggcaugguagugcacaccuguagucccuguugcuggggaggcugaggugggaggaucacuugagugcaguaguuugaguccagcuugggcaacauagcaagacccccaucucuaaaaaaagaaaagaaaguggauagaagauagaucucuaaagacuguuagcauuuuugagggacaagcucccagauggaguggaaggaggaaacccaggagaagguaauaaaagaacagagaucaagauaagagaggcuauggucccaguguuaaaugcugccaagaaguuucugauucuguaaauauucacugggugccuacucugugccacuauucuuguuuuuuguuuuuguuuuuguuuuuguuuuguuuuguuuuaauuuuuuaguagaacuagagucuagcuauguugcccaggcuggucucagaacugaccucaggugauccugccagaguguugggauuacagacgugagcuaccaagugcuagaguagaggagaggcagauugaacaaaguucuugccuuuaugagcuuauguucuagugaggaagacauuuuuucagguagugguaaguagcaagaagaugaagcagcauaaagggauacagagugacaggaggggcucacuauuuuagauagaaugaucaggaagaaccucucuagaggugacauuugagcagugaccugaucaaagcaagaagguaaagagugcuggcauuacaggcagccagacaagugccaagacuagacaggaacauuuuguguguguguguguguguguucaaggaacaaacagcaaggugucccgugugguuggagugaguuggaaagaguggaggagguugaggucacauagggccuuuuggcuugcaggccacaggaagguuuuuuuuguuuuguuuuguuuuguuuuugagaugcggagucuugcuaugucacccaggcuguagugcaguggcucaaucuuggcucacugcaaccuccaccucccagguucaagcaauucucccugccucagccucccgaguaccugggcuuaccagugcccgucaccacgccuaauuuuuuuuuuuuuuuuuuaaguagagaccgggcuucgccauguuggucaggcuagucuugaacucccgaccucaggugauccgccuacuucggcaucccgaaguacugggauuacaagugugagccacugcgccuggccaggaagaaguuuuuauuccaguuugauggguacuuuagguagauuuugagcaggggagugaagugcucuuaagaaguuaugcugauggcuugaagagaguaggccauaauuggcagaauagaggcagagaagagaguuaagaagcaacgagggugauacaggugagcagugacaaauggcagcucagaaucaaaagcgagcagccuaccaaugaagguggacauagcaggaauugugcacagucuggugugggauaacuugaauguagguauuuggucucagcaacuaggugaauggaaaugcccuguacaauauuagggaagacuuggggaguggagcagugggaugaagagcucuggcuuguaagugugaagacucuggggaccuuggcaagaggagucucaggagagugacagcagcaagggacaaacaggaguggguuaaggagagaugggagaugagaagcugacaccaggacaugaugcuuugagcaaaugagaggacacauccggggaguuguggggagggggaugggaacaaaggaaacacguuggggaaaaucucuggcagagaaggagaaagccuucaaaaagacgcaguugcggggacaguguucugcacaagugggaggggaucaacugcacugauggaguuggcuuuagugggaagaaaagaacucucacacugacacaggagggcaagugguaucagugagcaucagcacaucaccagcuuacccguaaaggcaacaggaaguugagggauugucuauguuguuucccuguggucuaauuauucccauugagauuugaacccuguuaggauacugagagugcagaauuugggggaaagggaacagaaucucucuuaagaacaugucauguucaauauccauuuuugaaaacacaguccaguuuggagaacacugccagaucugaucugccuaucugauaaccuucagacaguaaauaagcucuguuaaaaugaacuuuuuucaggcuuggcacaguggcucacgccuguaaucccagcacuuugggaggcugaggugggcagaucacuugaggccaggaguuugagaccagccuggccaacauggugaaaccccgucucuacuaaaaauacaaaaauuagccaggcgugcuggcgggugcucagcuacuugggaggcugaggcaggagaaucgcuugaacccagggggcagagguugcaaugagccaagauugcaucacugcacuccagccuaaaaagauuucuuuuugucuugauacagaguucaaacagcauauagacauacucuuccacagagaacccuuugagguaacagcaaauuacagcuuaccucugaaaucuuuacucagcuguucacuuugcucaguucuuugaaggauguuugguagauguaaaauaauucaugaaauugucucauaaacugcuuggcagguuuagaggaauaccagggguccagagacauccuuuuguccaucuguguuccuuguggaggcacugaauacggggaauauuuuacagccuaaagaccugucaugcugcucugcacagcagccacuggguggcucucuugaccagcaguucuucaagcuagugccacaaaaggguuaguuacugugaaaaggagaagguaaaaaugugcucaguauuacuuggguuuuacauauuugagcauaauauagcuaccuguaaaauuacuaucuaccaugcaaguaugauacauuguaccugguaggcacucauuauuuauugaacaacucuauuauggguguggaggugauaagagugccucucuugaugaugcuguuugcugagauguccagucauuccugugacugggugggaaauguauaugggcagaauaggcagcagagauaucugaccuacaacugugauuuagugucuugcuuuggcugaguaagcaaagucucuguagaacauaagaauaaaaggcacuuauuuucuggucaaaaacaaaagaaauuugucagucaugaauucuuaucaaagcauuucggggccgggcgcgguggcuuacgccuguaaucccaacauuuugggaggaucugguggaucaccugagaucaggaguucgagaccaaccugaccaaaauggagaaaccccgucucuacugaaaauacaaaaauuagcugggcaugguggcgcaugccuguaaucccaccuagucgggaggccgaggcaggagaaucacuugaaccugggaggcggagguucugugagccgagaucgcaccauugcacuacagccugggcaacaagagugaaacuccgucucaaaaaaaaaaaaaaagcuuaucaaagcauuuaaacugaacuaaaaucaaagaccagugcucuauuuuacagguuuacuuagaaaggcuuuuaacuuaugcugaaaucgacauuugucccaccaacuggaaaaggauuguucugggagccauucuucuugccuccaagguuugggacgaucaggcuguauggaauguggacuacugccagauccucaaggacauuacaguugaggacaugugaguuuguaagguuuuggugaacuuucuaaccauuuuccaguaucuuauuccuauaaaguuaacaauuuaaggaauauuuuuaaagguuacauuaugcagauaauggaaauaggcauaagacuauaucugucuaucuuuaguauaacaguucacaauagagcaagacugucucaaaaaaaaaaaaacuaacuucauauuuuccaucauuacuugguagguuuugauguguaauaaucugcuugauaaauugaaaaauauuuuuugggugguuuuuggcaaaaaucuuacaaguauacuaccagaacaacauagcacaguaaauaucuuuauuuuauuuuauuuuuuguuuugagacggagucuugcucgguugccuaggcuggagugcagugaugcagucucggcucacugcaagcuccaccucccagguucaagcgauucuccugccucagcuuccugaguagcugggauuacagugggauuacaggcaugcgccaccaugccuggcuaauuuuuguauuuuuaguagagacgagguuucacuguguuggucaggcuggucuugaacuccugaccuugugauucgcccgccuccgucucccaaagagcugggauuacaggcaugaaccacuacgccuggccucuuuauggcuuuuaaaaaguuaucugccaguucaagcuccuuucucuuuuucauucauucauucauucauucauuuauaucuuuucaugugaccaguaggguauaaacagcccuuaaagggcauaugucuggccuuugaaauaauuguuuggccacuauuaggucuuagggccucuggacuauugagaaguuacguagcuucaaccugagucacacauuguauauuugcuuuugcuagucuuuccacauuuuaucugaaggucuguuuuuacagaagccuugagauaugaagaucccugugccccugaccccuccccauuaggaguguuuuuuguauuuagaaauuggucuccugaguuaggaagcuccagcguuccccucaggcggucugagaagcacugcuggggcaucauccaacgcucaccacacucgagaggcucccugggcacucggacaaccacagcaccacuuugggggccuugaguuaccuaugagagugcaaggauccuugcugagucauggaguuccucacagauggcaccaauaugacccugaaacagcagcuucaucaggguuccuuccaggcuggccucgugucggccgugaagggaagggccuuggagcuugguaggcaggcugagccagggaggcauuuccagcaaaggcucucagggugcccaccagacagugagaauggcuuuguggguggcauuuagaaaaauaugaaggagcaccucuugaugauguugagcagcagaggaagaucaaggucaugacaggcaguggcaagaguuuguuuuuauugccuuugcccauuacuccauaugacugucauucagaauuaccauaccauauauucacaacugaagugaggauacuugugacuaaaaaggaaccaguaauugugguagcuguugaaguggcuucuggugaaguugaccacuuuacuguuuaccgaacagcccuagugauauugcugguagccguuuuagcaaagggugugacagcaaaugaauuugaaacaaauggaaguacuuuuggaaauugcagaaacuaaagugacuuugaucacugcugucauccgucugcaaacugguuucuugaaggaagcaaaauuuauuauuaugaacacuuagcccuaccaugauggcagcuaaaauguucucaaaaccugcaacugaacugacuggugcucuaguucaagauacaguaucagagaaccugcagggaaaugugcagguuucuacagauguaagcuucaggagcagugguggcaggggccagcuccaagaagaccaguucuaaauagugcuguuuguguaugcccagggaagcaccaggagcuaugcuacaaacaggcugcuuuuguuuaugaucuuuggaaagcauuucaacaaacuguuuaauauacauuugucucaucccccugcuguugacuauuuguaguggucucauuuugagucuaaauugaaacaauuuuaaauuggugucuaucagguuuuucuuaaaaauuuucaacagcuacauguccuguuagaauauauuucccuuuaaaagaauaaguuaaacugagcagcugcuauucagacgguuugcugugccuguaaaggguaugcuauucagccaccuagccauuuaaaaaaaaacaaaaaaccuagaagaugcauauucuguaagcauaaugcuuuucuucagugauuaaaccucuauuaauauguguguuaauccuaugaaguacuauauuucuacacaguuaaaauguauuaguggaaaaaauauaaaagggauugugaagugcauuuauugcuguaguaaauuaaguccugguuagcugauuaucaaaacauuaucugauuuacauuucuauaggcuuauggacauaugaacaggaaauuaauuuuggaaguagguucaguuggguuuuuaagcucagcaaaugagaaaaccacaucucugcucauauuaacugcucuccauacaggagaucaucaagcauuuguugacuuacccaguggauaaaauauuaaaacuuugaaaccaagaaaccaaauauguuguuuagguauuuaucauuuuuauacaguuaacuccuuauagggauuacugugaaagugguuaagauuuucucuaguuuuauguuuauuugcuuaagcauuuggcaagggcagcuguguggucauguagccgacuacuacucccagcccuuuccucucccauugcauucagcucacuccuacauucuguucugaccaggacgguagauacugagcaccucaggguuucauucccaacucagaagaaacacugaguuuuuaaguccagugaccuaccauaagucauaucauaaaauggguuuagucuagccaagacauccaccuuugaucuuucugccuuccaaaguuuaaagaguauccucacccugucauagugacaauuucucaccuucauaauauuaaagugagcagaaacuugcauuaugcccuuugacauagccucaugcgccgggacagggggaggggauucccuuccccuguaauguagcuugcuuauuuauuuauuugagaugaauccuuguugccucaagaguuuuucccccucagagauaauagcaguggcucuugauggauccauuuguugccguggugauaugccuacuccuuuuguuggugcuucucuacuucaauaagccccuuccuguuaucagccuggugaaaaugucugcaaguucuucagagcuaauaaacagcauacaucauuccuuucaucugaucacuauaguggggccuugugagugagcgugaaguaugaauuguacagcugcacuaauggaacucugaagaaugaggcccgagucagcagcacaagugcaucggaggccguaaccuucaaccuucaucccaguuccagagugcugggaugcagaagggaccacaaguaacuguaccuuaugugaacauuaguauguuaauacaacuggguagccuauauuuuaaaauagaguuuagagccauucuagucucuuagaaugauauuuuugaagauagcccaguugacugacauuguccugugcugguucuguuguguucuuccuccuccaggaaugaaauggaaaggcauuuucuggagcuucuucaguuuaauauuaauguuccugccaguguuuaugccaaauacuacuuugaccuucgcuccuuagcagaugacaacaaccugaauuuucuauuugcuccucuuagcaaagaaagagcacagaaccuagagguaaggcuaugaagucacuaagugagguuuuccaucagccaccaaagccaacaucugugacuaaaucauauuaaguagugauuaggaaaauggaaagcuuuaaaauuaacuaacacugaagagcuuauuagcccuuuggcgucagauuuccugugucuuguaugguuuauacaaggaucaacauuauuuaaaaauuauacauauuaacucuucugugaccauaauucagaauauuuuaaaucaaauuuaaucuguuguuaaugagguuuccuuuugaacuucuacccuuucacauaaccauacaugaauaauuuuuuuagcugggcacuguggcucaugucuguaaucccagcacuuugggaggcugaggugggcagaucacuugaggucaggaguucaagaccagccuggcgaacauggugaaacccugucccuacuaaaaauacacacacaggccgggcgcgguggcuuacgccuguaagcccagcacuuugggaggccgaggagggcagaucaccugagguugggaguucaagaccagccugaccaacauggagaaaccccgucucuacuaaaaauacaaaauuagccggccgugguggcgcaugccuguaaucccagcuacucgggaggcugaggcaggagaaucgcuugaacccgggaggcggagguuguggugagcugaaaucgugccauugcacuccagccugggcaacaagagcgaaacuccaucucaaaaaaaaaaaaaaaaaguacacacacacaaaaauacaggcaugggggugcaugccuguaaucccagcuacuugggaggcugaggcaugagcaucgcuugaaccugggaggcggagguugcagugagccaagauugcaccgcugcacucuagccuaggugacggagugagauugugucuccaaaaaaaaaaaauuuuuucuuugcgacuguauuccuaauuuuaucuacauacauaauucacuugccacucuugacugucuuacuuacuguuugcaaauucaugucaugguuuauguaucacagugcagucccaugaguuuuuuagacaaaggauuaguggauaagccaagagaccuauacccuucacuguauaggaugcagguguuucaaaugcuggauguaagugguaggcaugguggcucacaccuguaauuccagcauuuugggaggccgaggcagguggaucacuugagaucaggacuucaagaccagccuuaccaacacagagaaacccggucucuacuaaaaauucaaaaauuagccgggcgugguggcagacgcccaguuacucaggaggcugaggcaugagaauugcuugaacccgggaggcggaggcugcagugagccgagaucaugccacugcacuccagccugggcgauagagcaagacccuugucucaaaaaaaaaaaaauaauaauguaggaaguacauggguuuuuaauagaaaugguaacuuuauggggcaaaguaauauuuauggcuuaugacucuuggugaguauacagcagaauuacaacugaaauggacacauauuuuaaacuaacacuuucugugguaccuuggugguacuuuagaauaauauguauuucuaggcugggcucaguggcacaugccugagaguggcucaugccucagaggcucauuccucccagcacuuugggaggccgaggcaggcgggaucaccugaggucaggaguuugagaccagccuggccaacauggugaaacccugucucuacuaaaaauacaaaaaauuagcuggguaugguggcacaugccuguaauccuagcuacuugggaggcugaggcaggagaaucgcuugaaccugggagauagagguugcaaugagcugagaucacuccagccugggcaacgagcgaaacucugccucaaaaaaaaaaaagaaaaaaauaauaauauguauuucuaccauaauuaacgugcaugugaaguaauaccuuuuggcgcgucagucaucagaccgcucauauguuccaguauaguccagcacacaccugccucauuaaaaugugcuuugaguauauaauagcuaauaaggauuggguagaauuugaauagcugaauaaacauuuuuuugcacaaguguacguuuguuauauuuaaggaauaaguuaacagauaacagaugcuauugcuguuaggagcccuaucacaauaccuuugauaucuuugggaauccaguuuuuuaauaauauaauaaauuccccuuuguucucugggaaucuaaccauagcccuuaaaggauauuaccuuggugaacugucaggaaguaguguccccacaaccuggcaguguaaaacucagccaaaguagcuguaacugugaacuaucuaaaggaguccacauguguggcuuucacaauggugcucuuucaaaggcgggaacccuuuuuaaaauuguaccuguuuucuauuugauugacuuuccuaggcuauuucuagauugugugaagacaaagacuuguguagagccgcuaugagaaggucuuucagugcugauaacuucauugguauucagcgcucuaaagccauccucucuuaaaaggagaaaugagggguuauaacgucaugggaccuucaucuacaaagacuggagaaauaccaccuuuccugcucaaaaaccagcaaaauuaguguuuucaucaaaaggaaagaucucaaauucaagagacucauggacaacaaggauuauacuccacaggaaagaaugggaccuugucaaugcaacaaaacacucuucuguccuuuuuaauguaaacagaguuacaaaaaccacuccaaagugaaggcucccauccuacacacagauauuugcuuacugugugggccgauagcugugaacuauguaagguuuuuuaaacaauaguuuaaauuuuuagacuuuaaagacacuaaccauauaacuuuuauguuucuuccaguuucucucccuccccccgcauuuugcugcauaugccuuuaaaaucaaugcaguauuaccauuaaaacaugggacucuaacuaaagccacuuaggagcagacagcagcguuguuagguacugaaggguucuuccucccuacuguuaccauugaagcugcuagucauuggcaaucauuuuaaaccaaaaagcugcuggauaacauuugucauucauauucuuugcaagcauuacuuuagcauuuuagcauguuuggggucauaaacagaggaaguaucaguuauugauaucuacuucuauuggaguccauguugcauuucuugugaacuauaaauggugcuucucauuuucugauaauuuuucucuugcuaaauaaauguauuaaaagauauuuucauaaugccaaccaacauggugguucagugacgaugagaaaaagugaagcaguuuuaagcuugaauauaguuugggcccuccaaggcacugcagcaugaguauaaaugcuauaaaccuuuaaaaaacaugauuugaaaguuuuuuguuuuguuuuguuuguuuuuaaagagaugggggucuuacugcguuguccaggcuggagugcaguggcuuuucacaggugcaaucauugugcacucacugcagccuagaacuuccuggucucaagccauccucuagccucagccacacaaguagcugggacuacaagugcaacuggcaccugucuccugaauauuaagcuuuuaauuuuuuguuucggucacucuugauagcagacauugacugaaacaaaaaauuaaaagcuuuauauucaaaauuugcaaaaugaagcugggugugguggugcacgccuauagucccagcuacuugggaggcugaggcuggaggauugcuugaggucaaguauuggaggcugcaguguaccaugauggugccuauaggaauagcuacuacacuccaaccuggacaacguuaucaagaccccaucucuuagaaaaaugcaaaauuaaaugcaaaagaaaugggcugggcauagugauucaugccuguaaucucaguacccugggaggcugagguggaaggauugcuugagugcaggaguucaagaccagucuaggcaacauagugagacccugccuguaaaaaaaaauaauaaaaauaguuggauaugguggcaugugucuguagucccagccacucuggaggcuaaggugggaggaucaguagagcccaggaggucaaggcugcagugggccaugaucaugucacugcucuccaaccugggcgacauccagacccugucucaaagaaaaaagcagaagaaaaauguucagacaagguuuuguaaagguuuguagcauuuauauuucuacaaguaucaaagcuuaaaauuacacugaacuuuuggaauaccuuguaucuccauaaaaugcccucuuuuuaaaaguaguuacccgcagagcugugcucuauaugcuuugauuaccgcaguuucuuuaaaggaagauuuugaagagcaguguuaauuaacauguaauaaaaggaauuggacccuaauuauagaaggugauaugaacagcuguuuuaucauccuacaugcuaccaagcuguaggugucccauuaaguccugcuauuuaagaaauacuuacauaacccuuaggaacucuucaggcuuuaaaaggcaaggagcaaauaauuuuaggagaccgauaaugucaccuaaauuugaaauacuaagaagagguuaguguucucaacuaugugaaaucuguuucuccuacuuucucaaaucuaauccuaggaaucuugcuuauaaacaaagcauuucugggacaggaguacuuccucuauuauagcaaugcuucacaucauauugugcugcaguuuccaucauuuuuaaaggacagagacauaaaugauaaauaaugguauacaaauauuacaaucuaccaccucaaaaaaacaaauauuguuuauggaauucagaguuuggagauucaaguauugauugcaguuuuauuuugaaaagaaugcuacaauuuaugugguuuuuauuucucauguuuauauuaaaagcuaauaaacucuauuuuaauuaaaaua

SEQ ID NO: 12727 - RNA, 7313 nt, Homo sapiens
uuuuuauugucuuuaccauuacuuuaaugcauuuuaaaauuuaucuacauuaauugggaacaaagaaaaauagacauuucuuuguuuuucauaaauaacuaaucuucauauuugauaaaaaucucaaaugauuauuuuaccuucccacaaauauaauacauacaaaauuuuucugaaguaaggucaacaaauuaaguaucuugagacuaacauaaccacauacaacugcuguuucuacugacucccaggaacgaagcagaaacaaaaacucaucaagcugcucuggguuuccuuuuguaaguguuacagauucagaacuguaaucauguaucaucugccaguaauaacauauggauucaaauugauugucuacaaauaaaguaucgcuggcucuaguguaacuucuggauuuaacauaacagugacuacagcaugggauaggcacuauacauauauggaaaucauaaacaguaucgaaugcccuggacuucaacuacugacucgguaugugccucauuuggcucaguaauaaauucaccugcaccaaacccguaucaaaagucaccaaaucucucauauauauauauaauauauauuauguauauauacaacccacaaaacauacauacuauacauaguuuguaacaacaugaagucauacugucuuaaaaugaugcacucacagacagacacuauccuggcugaaauaaauccuauugucaucaggcugcuagcuuuugagagucuugacucagguuagcuacuuauauucugccuacucuucacccuucuuuaacgucuuggcaguucuuucagaaccacccuccgcaauccagacagauuuguuucccaggaucacuugauuggacuuuggaaacaagaaagagcaugcagagggagcaggcaauucuuagccacugucccucacaccugccuauacgugugaugugcucuguccuguuggccacauuuaguguuagaaagcaguuauucaaagcucugucccuccuaccccccuugggcuuucuguagagcacaaaagugaaagaagcuucuuuggcugggguagcaguucauuaaaauauacaacuacauuuccuagcucugggguucccauucuguacuggagagugcaggucacggaugcuguuauuaagguuuggugugugauccaugagguuuucuccuggcagccggugucaggauuagcgcagcuccagcccaggaggcaacagccuaaugaauaccaacuuugaaacagugcugucggcacguuauuuaagcuuguacaugcccacaauuacacacaacacacacaugggccuuggucacuggcaauggucaugagaaaauaugagaaagguuugcaaggaaaaccaauaaggcaccaagaaaaauuauuuccagucaauuuuaccauuucaaaaugugagaaggaaaaucauagaaauuaaaaagauuuccuaaaaucuggucagcuaauucacugagaggucccauuaguuccuuuagacaaccuaccugaauggaauccuuacccccuaagcuaugaagugaggcauugcuuaaaaucaaacugaaagggacagcccugaagcuguacacauaagagacuccaaugggcccuaaguccuccccagcuccacaaagcuggcugugaagaaguugcugaacuacuccauaaccuuuuauuuuacaguugcuuucaugagcaugacuuguuuccauaaucacaugcaaauugggggaaguaacuauauggauggaaacaggggguggcuguaaguagauccaguuucucuccccugggguggcugaucucaguaagacuuagggaugcaggugggcuuuuaucuuugucucucuuaggggaugagggaagagagggacagcagaggugagaacagagacaaagaagugcuucugaaaguuggucuggaauuagaccccaaagauccugacuaauauugccccccacuugggcuuagcguccuuuguuuuaacuggcuuauuuuuaaaguaaauuaguuguucagcauguugcuaaaacaaaacaaaaaaaaauucuaaaaaugaauuaaaucacuuucauccacuucaucccacaacuuuuggauacacugugcaucauuuccagauuucuccacaaagaaggagggacaacccaaaugaggcacaaugacugaaggcagcagagcagucugucuacuuucugggaagacauaugaaaugagggaaaaggucaaggugaucagaaaagguucucucauuugaaaaacaggagaggaauuggcauucagucaagggaucuauuucaagauucuaggaagaggcuucuuccuagaagaauaaauagaggaauaaaauaggcacaaaguucuguagcuauuuguacgagguuuuguagaauccacugaaauuuuaauucagaggauaaauuggguaagagcagugcauuuuaauaaaugugaaguuuuugagaguccuuacaacuuuaauacuagguuucuucccaccaguaaaguguuuaaauucccccugggaacuaugcauuugucuauuuaacauccaugaaguaaaaauuguccuaggcuuaaauuuuacuuuuccaacuuugguauaagugaauuacaaaugccuacacucaaguuguuuuccuagacaggauuuucucaaauguuaauugcucuggccauuuuagcuuccuaaauuuaguccccaauccuggucauugguauuuugcuggcugaggcacugucaccccccuuccccaguaauggccccacacucuucaugaaugaaugcuuaaacagauuaggaaagcaaacagaauuuucuaauagcaaagaaaccucuguguguauguucaucaauauaagcguucauaaugaaugaaggaauaguuaaacagauuaguaaagcaaaccaaauucucuaauugcaaagugugugugugugugaucaucaauauacaggcuuucucagaagaggaagaaaacuauagagguagcacuauacugaucuauauuuuaaaagguugugcaagcauguuaugcaucucuuuuguuuucagagacggcagagagcaacgucuugcugcucuuggaauaucuggcuauaaacuaguccaaaguccaggaacacuuauuuucccuuauuugggccaauguuuguucacagguagccagccucccucccccaguucaagcacuucauucaagggugggugugguuucuaaucacagcucuccaggagaggaggaauaagaaaagcaaaaaggcuguuuaacaugauaaagggggaggggggaggggggaggggguggagcaaauaaguguuggaaauuuacuuauuagaaguauauccauuucaguccuuacauuuaaaaaggagcccccuuuagcaacugucgcuaaguauuguccagagggaguggguuuauacuuuuaccaaaauuauaacacaaguuccuuaaaaaaaaaaaaaaaaaaaaaaaaaggggaucacugaagcuuaagaaccacccacuaccucucaggcacaaagcugccaucucaccagccuaaaauucaagcuccaccaaucaccaucgcuuaggcucucacuacugcaaauauuuaugccagauccucuauaaugcuaccucuaacuuauucaagacacaacgauggugcuguuaggagugagaauuauuacaagcacuacagaaaagaaacugaaccucccucuauaaacaaagcuaaggcugaacacaaaaccgcuaagcacucccuaaccuugucacuuuggggaggcccugagcucauuaugcuccccuccuagguaugaccuggggcuauaaacugcagcucaccuuaaagaaucauggacacuuuaagcaguggaaggagaagcuggcugaaaaagcacacccaacaacuucccagucacagcaaccgaaacguucacuguucacauuuuuuuuuaaagacacacguauaggaaauauauuuucccaauugagaccacacaguucaaagaaaccugaaccaaguggaacuucauuacaacgccaaccuuaggauuguaaagcccccaaagcaaagguaaauuguugccaaaaugcaacaaaguuacaaauuaagaaaaauacauauaaauuaaaaagaggguucccauaaagaaggcaguaagaaacgcaaaauagaauacacgugagcugggccccuuggagaagaccugggacagguucuuccucgaaaacgccccucuucccucucuccaagucgccgcgggagggggcaacagcaccaugaagguaaacggaagugaccuuggcaaaacuaccaaacaaaacgccccccuccccucagcucuccggccgagucccucggcggcagccuccuacacgugcgacagggacaccugcuugugguagguggcggcggggcccggcggcccgguccugccugugagcgcggcgcucgccucgggguaguccccugcggccauggcgcccccgcucuuguggccgcgccgcgggcggcagcagcagcggcuggugaaacgccgccacgacuccaccgucuugcccgaccagauccagacgcccgacgugaugcccaccaccaggcacaugaaguacuugagcaugagcacccaguacucgggcuuggcgcgcggcuggccggugucguggcccgggcaggcgcaggugagcgccgccucccagcucucgcgguagugcugcucguacagguagcaggccaccacaaugcuggcggggaccguguagagcagcgugaagaugccgaugcggaucaugagcuucuccagcuuguccgucuuggugccgcccugcuugaugacgcugcggaugcggaagagcgacacgaagcccgccagcaggaagagcgugcccaccagcagguagagcaccagcgggcccagcacgaagccgcgcagcgaguucagguucugguugcccacguagcagaugccggccacuggguccccguccacggagcucagcgccagugccgugauggacuugacgcuggggaugagccacgcagccagguggaaguacugcgcguagcccgcgauggccucguugccccacuucaugccggcggccaggaaccaggugagcgacaggaugacccaccagauggagcuggccaugccgaagaaguagaccaggaggaagacgauggugcacagugcagggcccguggucucguaguggaugugguugugcucgcggcugcaggccacgcuggcauggcccacgaccagacgcaccaggaagcccagcgacacgcacagguagcaggcugacaggaagaugauggggcgcucaggauagcggaagcguuccaugucgaugaggaagguggccacugugguggacguggagaugaagcacagcaccgaccacaggccuauccagaagguggcgaacgugcgcucgucggcacugaaggacggcugguagcaggguaccgcgcaguugggcaccuggcccguccgcaccuuguuguagagcgggugugacuccuucagaaugggcacgaagggcucgcgacacuugcacacgaacgggcccccagcggggcauucgccccccgaggccggcgccccuggcgggccuggaagggugggcuuggcugggaaaggccuggggggcgccgugguggccucgcugcgguuguaauccaugcagaggaccucggcgucgcggcccagcaccgggaggcggucgcagcucaugcgcucgggccaggcgaagccguacuggcgcaucagcggcgagcagccggccuuggcgcgcucgcacaccgagcggcagggcggcagcggcuugugguagucgggcagacagaugggcguguacauagagcauaggaagaagcgcagguccggcgagcauuggaucuccaccagcggccagaacuggugcaccuccaggcccgccucguccugcgugucgugguugaacugguugggcaugugcgucagguuguagccgaugccgcggcacaugggcaccgugauuuccuggcacaccggggccuuggacgcggcggccgcccggcccaccagcugcgcuaggagcagcagcaacagcgagggcggcgcggaugggucaggccgagccaucgcccccucccuccccucgccuccagcagcccgcgagggacgcacacaggcagaggaauccgggccggggcuucucccuccggcgucucguguguggcgccggggcuggcaaccuguugguugcuuuuuccuuuaaagaaaaccguccaaagauaaacugcuucgggaaggcgcugccuccgcuggcagcgcuccgcuccucgccggauagggcuggggagagacgguuagggcucggauuccagggaaaggacucuuuaaaaaagaagggggagaagaaagauugcaaccacucccuguuggagaggcgucaacaguucgguccccgcgagcugucuccaaaucucuuaaguuaaccccuuuccuuuccuccccgcuccgccuccuguaaccaaacuaccgacucccccacccucucuuuccaagcugggcccuucaggcagugcccggagaccagaacccucagcuucccggaaaagggcacaggaaacgggagaagaacagggagaaagggaagguucucaccuccacggaucccgccgagaagagcagacaguccccagccagccuggguccuccgucccugggucacuccgcugagaagcgcgacucagagccgggcuggcgcccggaaaguuuagcgacaggcuggguacccguggcagcggcacauggcagcaggugggggcgacucagaguggggggcgcccccagaacaggggcggcgcaggccggucacucgcccucuccuccucgggagccccccgcaugauccagacggagccgggcaggggcaggccgugcguucuccccggggccgggagccggacggagggcgagcgcgccuggcagcaccugggcgggaggaaggcgggaggcgggggccgugggaccccgccgccucacagcaccgcgagcagccggcgcuggccaggccgggacugcauggugagcgccggccgccgcgucccgcccgccgcucgccuccuccccugcagggggcuccgcgcuccaguggacuccugggggcgguggcgacgcucucgggacgugcccugcucggcuccucccccgcgcucucgcacccuuucgcccaccucuggcgagcacggaaccgcgcgcggcggcgaccacagcggacucacggccgcaggcuggcugcccucucccg

SEQ ID NO: 12728 - RNA, 731 nt, Homo sapiens
uuuuuuuuuuuuuuuuuuuugaacugguaauagaauuuauucaaaugugccuuaauauaggcgcuggggcuugcccauggugcucucgauauauaaggcccggacauucugccaguuuuucuugagcaaugacaccaagaaguugacagccaggugaauguuauacacaagcucaucggcugucaucuucacgugaccaacagcuacagccagacauaacaccuucuucauuuggaacuugauuguggacuucaccucacccacuuuggccaccauguuuucguugugugugagcagggaagggaacuuuccugccuuauuuagaccugggccgaggauucguggaaucugcuugaucagagacucugaggccaaaaacgcaucauacuucuuggccagcuucuugaccaguuuuuuauucuuuuugaguuuuuucagcgccucgauguccaugugggggauauccacggccuuagccucgucacagugcugcuggucccccaggacacacacacacaacuuagggcggggaguggacuuaagucugacggugcccgagaagcacuuguccuucugggggucauaguucuucaagcugaucugcaacuccaccgucuccaggaacuugcggcgcuugcgcugguuccggugcaggacuucccgcaccgccucguacaggguguugcgagagacugcugcucauggcuucucacgccgcgcuaaccggaaaa

SEQ ID NO: 12729 - RNA, 742 nt, Homo sapiens
aggccccagggggauuuggcacggguacuccugugagcugcugcucuugugguuggugagacugccugggucuagagugcagagcuccucuguggccgcgaggacgucacuauaccuaaagcaccaaagggaaaaagugcaggaugggaaaaaaagucauucauccauauaguagaaaagcagcucaaauuaugagagaggcccacaaauaagaaaaaaaggaaaaauugaagaaugaaaaggccuuguguuucaaucuuauuggugaaaaacugcaaugguuucaaaaucaucuugaucccccccaaaaaaagauauucaaacaaagaugcuugugaacuaacugaaagguacuuaaauuaaauugauuuagcagugaguuggagcagauugaguuacauaacaguaucagggacaagcaggacaggcagcacuguucccaggacaccaucaucaagcagacgauggagcgggagggacagcaguauaaaggauguggcuuugagauuccagacauucuaaaugcaaguaaucugaaaacauuuagggaaugggacuuugaucugaagaaauugccaaauauuaaaaugagaaaaaucugugcuaaugaugcaauucccaagaagugcaagaggaaaacuauuauaacuacagaccaagauuuaguggaauuggaacuaaacgaugaaucaaaugacucagaagaggaaaugacuggauuagccuaaucaucuucacuuga

SEQ ID NO: 12730 - RNA, 1835 nt, Homo sapiens
caaucuuacauuacuuuuaguauguuccauuuagaaaggcaaggaagauauauaauuuccaagagauuucuaccuuucuuuuucuuuuaaauguuguuuuauggggacuuuucacugaauuguacuccuuauucccuaaucaugugggauaaacacccagcaaauguuaauaaaaacgguacuauuaaacuugccaguagauagucuauaauaaaaauccaaagacuauucauaauggaaauuuuaaauacuugauguuauuuuuagguucuuagaaacauuucuguauggacgugaaaauucauuaauaauauugagacuuuguuaauauucuaaaaauauuuaugaacuuuuuguuuauuuuauauaauauugaggcuuuguuuccaguccaagacaauucucaaguguguuguuuuuauuuaaacaaauuuuuauucagcaguaggucauuaaucaguguuuauucaugugaaguuaaauugaagcuaaaguauauagacugagcaaaugugauaguguacuucuacauguagauuuuuggauccaaaucgauauacacagaaaaaaaugacuaugagucaugcacuuacaagugaaaaguaauaauucugcuugaaguaugaucuguuugauguguuauguagccacccaaguggcuuuaucuuuaauuaaauuccuuuagucuucaaagagaauuccuuuuuaggcauaguuuucaaaguggaagaaguucuugcuuauaaaacaucauugaauauaaaguacugagcugacugaauccuaguuaugccaguuauugcaguguuuacugcaguaaauugagaauuccuguaaaguggcaugaagaaaucuugaaaacaacacuguauuuuguauuccuacuuuccauuaauuccuguauuuuugaggaauaaaacuguaccagugugagcucauucuuuuuuuguuuguuuaauuggacuuuucccugcuacaauucaguaacuuugaauccucauauauuuuuuauuuauuuauuuuuaaauuuuuguagagacagugucucucugucacccaggcugaaaugcaguggcacgacuguacuccucuagucuccuuauagucuagagauaauguuuaaaaacuucucauauuuugcuaaaagaauuugucuuuuuucuacucuuucuuucuguaauuggccuagguuagcuauaugaaacauuuaggucacaaguguggaaauaauuuauuauuugacccuacuucaggguucuccccucucucaaaauacuguugguagucuuuucacuuuauuuaagcaucaaguauaaaucugcugucuuucugauaauguuuuccuaguuuguuucuuugcucugcauuuaagagagcugggauuauccagauuccaguuaaaagaauaaauuuaauguucaggggcagauuuggauaggauauuuuccauggcauauauggaauauauguaugcauucuagaauauaaaucagaaucuggagcaguauuuuaggggauaggaauucagauuuggccuuuaaucuuuaaugcacauucucaggaggaagagugguucuuauauagauuaucaguuucaacucugagcguugagauuagauuagcaaauuuuuuauuuuucuuuagaaaguuugucaaaaauuuuuugaaauaugugaccuauguauuaauuuguaaaggucugauuauuaacugucuggaccaacucaguaacuauugacuugguaauuaucucacuguguacaugcaccuuuugaggaugauggcuuuuacuguauuucaugauguccaagggaucagauugcauuuaauuaaug

SEQ ID NO: 12731 - RNA, 462 nt, Homo sapiens
ucuuuuuuuuuuuuuugcuauuuuauaacuuuauuugauguauuugaugaucagagauuaguucuuguccacauugacugucuguagauuuuugaaagugguaacagguacauagguaaccaaaguauagagcuuauuuggugaaucuucacccucauuacguuuucuggacaaccgcacauggauucccuauaggacauuccuuauuccuuuggcccagacagcuuuguugagccugguaucaaugcguacaucuggaguucccaucuccuucauggcaaauuuccgaaucucuuugagugcccgaggagcacgcuucuugaagcccucuccauggaugcgcuugugaauguugaugguauguucuugggucaccaccucguugauggcagaagggcccuuuuucuucucgccacccuucuuugcgggagacauucugccgggucuaaguuggaaaggaag

SEQ ID NO: 12732 - RNA, 1207 nt, Homo sapiens
ccuggguguucucgggaccccucugugugugcgugugcggcuucgcuggcuuagggguggcucgcuggggcgccacggaagguaaggggaaugccuccucucucggcgcagagcagagcuugugcggauggggaacggccgcgacucgcggccaacccuggcguuuucuucgccgcugugucggauguggcgcguggaggagucgcuggagaaaugccggucagaggacagaaaggcgaccugacggcggggagggaaaggcggucgagcccagaagaacgaagcgagcgaucgaggggcacggaggucuccucggcccgcucgguccccucggccguguggguccggucggucgucucggggcugccuucugcccgccggggcugcacgucuguuggcguggucaugccugagccacccguccacggcuucgcggcggggcagguccacgccccaggcgucugccaggugggccagcagcagcugggaaagguggcggugcgcgcgcucgucccagugcacgccgucggggagccggugccgcguggcguggcggaaguggaaaugcagguccagcacgucaaagccgcgccucgccgccucggcggagcuguagaaguuggccuccaucacgucuucgcgcaggcgggcgcggcggagcuggcgcgcgcaugggaggcagcuucccgagauggucucggccacgggcauggccguguuccacaacagaaggcaggacgugggcagcgcccaguccaaccgcacgaacaggcucuccacgucacgccgguagcuccuggggaagccccggccaucccuggcgaggucccagaggcaggaguucaugaccaccacguccggggcgggcucggcccuacgcagcuccuccacgacgcgcuccgcguagugcgaauacacgcgcgugaggaaguagaagcgcaccaggugguggcccgagcggaacuggcgcaccucgcgguaguggcggucguagugcaugcggccacugcugcagcccaccagcagcaugucgcgcucgaagcucaguucgcccuuggccuucagcugacuggaggacagcaggcaguccuucugaagcaggagcaccagguccuuguacacggccagcuggaccgagucccccaugaccaccacgaacuuguugugcagcagcugccggacuucgcaggcucgcagcugggccaug

SEQ ID NO: 12733 - RNA, 1117 nt, Homo sapiens
uacuugauuuacaacagauuuuuuccagaucauacaaaaggccauacaguaaguauagaaguagguauggggagggcuuacuaauaucaaauaggcaaggccuuagugagugggcaggauaccaccugagaguggccagauguggggagguuacucugcucugggugcucucauucaugaaucgacaaggauacauuagauuauuuugaaacauuuuuuuaagaagcagaauucuuuaauaauuccuuccuagacauugaauauacuuauaaaauuaaagacuuggggaaggagacacugagagacuugccaguuugguuccucaugaacaaaagaggacaguuugauaacuaccagaauagaauaucccuaguuuuaaaauagugagaaucucugaaguucaucaacaucuuaagaugcacuuacuugaaaguuugagauucuguuuaucauuugaaaacacauuuugcuuuaauucuuucuuugacauguuguuuuuucauaucaagaaauauaugaacaaaauaauaaccuuuugacccugaccuugcugggugaauuagcucugaaacacucucuacaaccaguaaugcauuugucccacauuucauucugauagaaaaugaacaccauagcaccaaacaaaaauccgaggcguuagauaaugucuggauuaaauaauuuaagacucucuaggauuuugguugucauuuuuuauuuauaacagacuuuaagucacuuucuguugccucauaggucacauuuuagacagguuugugucuguuccuugcaucugaauuccugauuguaaagacaccuaugaggucucuuaguuuuugucauucauuuucuugguuuaucaccccucccuucuuuuuguuguuuuucccugacuguuaagcaguuucaucuuugcuuuuguuaaauauuugacagcaguuaguuuguguuaagcucuugaaacuugugauuguacuuucuguguagauauacauguaauuauuuuuuauuuuucaaucauagauucaagcuuccuucuuuuuuaccacaaaucauuaaaguuauuuguguuuccauauaccugugucuuguauaaaauuggcuuauucugugcugu

SEQ ID NO: 12734 - RNA, 1345 nt, Homo sapiens
ggaggcgcgaccgggaugaacauuuuuuuagccacaccuccagacgguucuucagcccgcugaaguucaaaaacuaccguuucaguuggauucagggcaaggggaggccgguaagucgcccaaaaauaaagugaaugagaagcagaaguuguuaauacuauaucccccggcaggugcuaaccgcacgccgacccgacugcagcgcgggaacggaaggaggaaacggaagauuugaaaagauucugccgcccccagaaacugugcgacccgugcccucgcagccacccccaagaagcuccgucuuuaccaacgcgagcagcgcagcagcuucuccaggcggucgagcgcggcgcgacugugggcccaggcaccgcgaccauccgguuccauggcgggcgcggaacgaggcucguucccggagcggauccucggcugccgguuccucggcugccgauuauccggcaucgucccgccuucggaugaaaggcuccucgcagagcgggaagcaaggaagccucgggaaaccacagggaagcugcaggccagcgacucgaaaccggccaagcucuucccgcgucugggacggcgggccgccagaggggcggggcgcgcggggaggggcggggcacggcggccgcaaugcucccaaaauagggacucgcagggcacaggggcggggccgcgagagccagccgcuggccgagugggcgggaccuagggguggggcuggaggcugaaacuugccaaagucccggcgugugggacuuaggggaggggccgcgagagccgugggaccgagggggcggggccggacggcugaaacuugccaaagucccggcgcgcggguccuaggggcggagccgcgagaacacgccggggacagagggggcggggccuaggagccucggggcgggacaggacggucgaaaccgaaguccuggcgcgcggggcccaggggcggggccuaggggccucggggcaggacaggacggcugaaaccgaggucccggcgcgcggggcccaggcgccgugcagugagagcacgccgcuugaccgaaggggcggggccugaaggcugagcgcagucgcgaggcuguaguuggcaggagagcgggcggggccugaagccccucugggcugccuggacggaugaaguccagguggaaagccagucgacguuucccgggagcuacgacuccagggacccucauccgagcuuaaccguuggaacaaucacaaacccagaaacuuuuagcugaguguuauuuauaaaaagcgcuguuuugacugcuguuggacuuggaaaagcuuugcccacgauacugaagguaccacucuuuguucc

SEQ ID NO: 12735 - RNA, 803 nt, Homo sapiens
aagauggccaagcaugugcccaauucaguguuguguaugugucuggguaacacauacacccauugcagucagucacuuguuugcagaagcaauuuucagaaagguuguaaugaacaaaauguuucagauauuuuggaggauagacugugcagugaccuccacauaugaaauaggaaacccuccagauuacagggaggaaaauugcaugaagaagcaugguaugcccaugaaucacauggcucagcagauuaucaaagaagacuuuaccacauuugauuauauaccauauaucaaugaaagcaacuugagagauuugaauagaaaauuuccucaaguuaaaaacugcaaagcuaaaauugaacuacuugggugcuaugauucaccaaaacaacuuguuauugaaaaccccuguuaagggaaugacccugacuuugagaugguauaccagcaaugugucaggugcugcagagcauucuuggaaaaggcccaccgaggcugggcuuaugcccugcugcagccaacagugacaagaccccaccugagguucugcauuucucagucagugugcuaaagugcaauaauguucuacagcuugauaccccagcucuuccuucaguugacuuacuguuucuuaucuuaaaaaauaauuguagauggaaaucaguuguguuuggcugaacaauaaauaaaaauauuugauucagacaguuuaugggguauauuaagcauucuuggacuaguugaaccuuucacuuuggcccaauuacaagacuaguggaacauacaacauauagggcaauaaa

SEQ ID NO: 12736 - RNA, 75311 nt, Homo sapiens
uucccccgaaggugucuuauaucaaauagaugaacuucaaguuguggaauguaaaucuuuuauuaaaacaguugucuuuccacaguaguaaagcuuuggcacauacaguauaaaaaauaaucacccaccauaauuauaccaaauuccucuuaucaacugcauacuaaguguuuucaauacaauuuuuuccguauaaaaauacugggaaaaauugauaaauaacagguaagagaaagauauuucuaggcaauuacuaggaucauuuggaaaaagugaguacuguggauauuuaaaauaucacaguaacaagaucaugcuuguuccuacaguauugcgggccagacacuuaagugaaagcagaaguguuugggugacuuuccuacuuaaaauuuuggucauaucauuucaaaacauuugcaucuugguuggcugcauaugcuuuccuauugaucccaaaccaaaucuuagaaucacuucauuuaaaauacugagcgguauugaauacuucgaagcagaacaggcaaugugcagcccucauuuaugagaaaacccucaggaaacucccagggugaugcuuggagaagcugugaguugagcugaagcuggagaacuuccuccagagcaaagggcuuaagaaagaaagaagaacucuaagcugggucugcuaacaucacuccaguuuagauggaucuuggcagagagacaugcuuguuccucuggauuggaaagaugauuuacucucgggaaucuucucugucagccuguacaucuaaaggcaugaagcacucaauugggcaauuaacauucuguuaaaaaggaagaaggaaaaaaaaauuaguggcaaauacuguaaaguguacagaaaaaaaaaugcggggagguggggacucaugacagcugcuuauagauaggauaauauuucuuccuaguuucaagaaccuagcagcauacugggcaauaggagauguucaagaguuacauaaauuauaacuuaaacuauauuauggaauacaguguuucacuuaagucauuuaugaguuguuuuuuuuuuuaauuaauuaaaacacuugguucauucugaagaaagauaccuguagaaagagacugucuaguaugagggaacacacuugugcugcuaaugcacuuacaguguuuguucucugaugguaucucugagaauacugguuguaggacuggccaguagugccuucgggacuggguucacccccaggucugcggcaguugucacagcgccagcccugagagaguagaggcaugaagucaaaugggguuuaugauaaccugaggacaucguaauuuaguguuugaguuaaagaaaaaugucacaucauaugcacuggcaaaauauaagcaguuaaucacuaagcaagcuuugaugaugauuucaugcauuuauaacucuuaauacauuuuggcuuauuaccauaucuuauaccuacaucugucucucuauguuguuucuuucuccugaaaugucucuucucuuccuauucaaaccuugcccaucugcugaggcucauuccaaucccaacuuccucaacaaguucucugcacuagaugauagaaaagguuuucaaagaauccuagcgauuuuaaaagggacuugagaucacaugaagaaacguucucauuuuauagguaaggaaacagagacccagaggagaggagugacuugcuuagagggagcagggaagucacacaguggaccacugguggaguugggccugccgcccaggagguggggugaccuggccauguucuuucuaaugcaccacuuugccacucucuuccuaaacuucccuaggcagugacaugguagccugucaccuggccggagauggcaugggagauggaaacgggaccaagcugagccagugaggcuccugccugaaguuuuuacuggaaaugggaggacacacauguucucuuucacuacuguucuuaagcuggcaggggguaaagcaagcucauggaggucagucaucaauggcaccaucagcagagaccccgcugaagcacgaagccagugcaugggaaggcacgcggagcaagagggaguccgggcgccauugcuggagcagccccugaagccgguggguccugggacuguuccauugugugggccauuuuugcuugaguuggacuuuuuucuuacaacuaaaaugcagcccuaaauaauacagucacuuucuuuuuuauauuagaauuuaaauauuuuagacauauuucucuguuuaagcacauaugccccuuaauaccuaacacaauaccagugacuaccuccuuacagaaucacugaaucuugcuuucauaugagaaagugaacaguuuccacuccugucuuaaauguuucauuuagcacuugagaauagaauaagugucgcacaugaaagguuucaugugcauaaauaaugagaagaugcugaagugagaccaaaaucaacuucccagcaaauucauucuccaucacacaauuucauaccagaaugacugaguucuaaggucauacaaucacagucguuguaaguguuaaugggagagagagagagagagagacagagagagauacugaauucaaucuaaauuccaaucuccaauucuccuccaucagaauugggagcaccucccuccccauguaaucacugggggugaaacaagaucauaguaguuuccaugggcugccccugguggagccaagacaggccccugaacaccccugcugccagauuaauuuucccaaagacuauuuuccaucauguuucuuugcaucuuggauaccuguaauugguuaaugcauuuggcauuaaccaaugagucucacccuugagugugaagcaugccccucacccaccaggauuuggggaguugcugggagggcaugucuucguugaaaacaaagggcugucacauuccauugcuuuugaguuacacauaauuucauuuugaaauuugaaaucauauuagagaaaggcuuauuauuuuuuguuauacugggcauauuuuagaaaugguugagaaguacuggcuuaaauaauggguugccaaggcccuccauaagccacuucuucccaucuauuuucuuaccagaagacagcaggcagaggguuggcucaccaaagcccaccugggccagcuccuuucuaucccagggggugugucucucugcuuucuccccucccaacuaaaccuuagucaucguaaaccucagccaguucaugcuucucuuucuugcuaauuccagccuacccagaacuguauuugucagacccacuuagaacuuaauuagcuugacuuugaaauguaugcuaauuuaacaucuucaacuauaucauuaagagccaagccauuucucauuuccucuguuuuuccuauacuacuuagcacagugcuagaccuauaacaagcaucuguucugaaucaagagagagguuaaaagaaguggcauuuucuuacaucugagauauuauucaaaauauuuaacaacguugccaugggacaccuguccaucagaauggaguuggaggccuagagcuacacugcacuuaacacuuugcugaaaaauagaagcagccugagaauaguaggggaggggagggucucaggcugcccaggauggggagaaccggcugaaaugaaacacauucuauuuaccacuaauuaauuugaauaguaucucugcuucacuauuuuucaguguaaauaguaucucugacaugcuagggagcuuaggaaaaugauucuaacaucauauaaaugacagguguugcuauuaagaaugacucaagacuuguguuuuugguacucuacaugccauucauucauucuuucuacuaagaguaauagaaagaaugaauggcauguaagguagacauagagcugcucuagagcucuaugucagcaguuguaugccaacaggaaaugugguauuuuaauacuuccgaagggucucugccccuccuguguguacgacacauccuugcaggagcccacccuuuaucuuaucuaacuuguagggagccuggcacauccagucuuacccgcuggccuccaaagcaugugcaggagcaaauggcaccgagauauuccuucugccacuguucuccuacgugguaugucuucccaucaucauaacacguugccucaucugcauauagacacaagacagaugcacgcauaagcugagaacaauacugcagacuugaucuagggguggguucuauuucuguccuaaauuuguaucaucacagcgcaaacaccacauauuuaugugaaucaucccuaagagcaguacugcuauacagaucuuaggguggcacuuccaaaaauuagaccuaauacacuggaaaggguccaacgggaagauggaaaucauauuuuaaaaguugaaucuacagaccaauaaagcuucuuuguagcauuuuacugcagauaauggucaaaauacucagguuggacaagugcuaaaguguccuguaauaacauuaaaucaugacucauuuuugaagcuugucuccacuuucccaaaucaaaagauuaagaaacccacuguucacuccucaaggagaccuaaagucuccaaucauuucugugaaugagaguuacagccugauaaugaaagugagaaugcuuaauaaggcacuaaaaaugaucugugaugacauacgagggucacacuugaauucuccuuuuccguucccaagacaugugcagcucaucaucuggccauuuucucccugacggucccacuucucuccaaucuuguaguucacaccauugucauggcaccauccuguagggguggggaaagucaggaccaaaaaguuauuuguauauucugacucacaagacaguaggugaacugggacgugucacagggucuucagaaccaugaucuggaaaaauagcaaguuaaagauaaaaaccccuauaaugggccauuuauuuuauuuauuuauuuacuuuuuauuuuuuuuuuuuuuuuugagacaaagucuuucucugucgcccagacuggagugaaguggugcaaucucggcucacuguaaccuccaucuccuggguucaugcaguuauccugccucagccuccugaguagcugggauuacaggcacuccccacagugcuauuuuuuuuuuuuuuuuuuuuuuuguauuuuuuguagagaugggguuuuaccauguuggguaggcuggucucaaacucgugagcucaggugauccacccgccucagccuccaaaagugcugggauuacaggugugagccaccacaccuggccaaugggccauuucuuugguugaauuuuaaaauauuauuuuuuaucauuuaccauuuucuagggcauuuuaagacccaauuuauucugccacaaucaugucaucagaauagucaaaugaaaugacuuucauuugaauucucacuauuaagauuuaaaauuguggaaaacuaaagugggauuggaguagacuguuaggaauagauccuagaugaaaaaucacuuuuggauuugcagaaacccuggauacaaaguaguucaauuaaccauaaaacaaggaucagcugaucucuacacgccaccaccuguuucauguacaugggaagaguaaaaaaugaacccggauaaaauaaaacaaaagcaaacaaaaugcuaaaucauugguuauuauccacaucaaauaagucugguucuguggaauaucuaaaagucacaguuuuaugccuuuaacuacuauacauaagggaugacuuuuuaaccuccagggcuuauacaacaaaacacaccucagaagcuuauauaacaauauacuacuuuuuccauuuuaucaacaauucagccugccuuaagcuacaaaguaaaauaauuagacaacugugauaucaaaacaaagauuauguaaguugagccaaagagucacauaaaugaacuugacauccccgcucccacaauugcaccuaagugcucaaacagguaauaaacauacaaacuuaaacguaguucgauuucaggaguuaaaaaccaucuacuugaagucaaauauuaaaauuuccagcuccuaaacagcaugugauguuuuuaguguuuuucauuuucagauggucaaacauggaagucuauauugaaaacacuggcuggcuuuuacaacuucagucuggauuaaaugauuucaaguauacaaguuaaguaaaauacuuugaaaaucucuuuuaccaagucuuauauucuaauuccacaggauaugauuucuguaugucuauaggaggcuuauuuauaggcauaacggucaacaccuauaaaaaugaaccaauugucaauaaucaucacaucuccuaaacacaaagaauaaaugaaagguuuauaaauucuaauccuaaucucaaagcauaauagauauuuccuaggcacauuuuaacuuaaaaaauuugaaaauuaaaacguauuagaauuugaaaaucaaacauuuaucaauucaaguugauuuuuaaugaucuaaaagcagauuaucuguuuuuucuuucauauuucuagcaacguucaagcuaccugggcuaugugugugacgcaaaagugugugcauggguacuaugauaugugcauguuugguuuauguugaaggaggcuguuuuugagucuaaauguucaccucugaucucauucaacacugaagauuaaaagagauuugagguuuuucugugucucuaauacucuuaaauagaccugguuccaaaagucuuuauccauuuguuuucacagaaaauuucaaaaaucaaauuagcaccauaaucuuauguguaauuaauaguuguauuggcauacaacccuugaaaugaagcaauguccaacaaguaaaauuucccaucauuuuucuaugaugcaaaauauuacuucgagucaaacaguauucucuuguuugcuucauguuuggaagaaccugugucuuccaaacaugcuuccuuggcacaugagugcaugcauggaacuugaggagacaaacacggaaguggauggacaaagcaacuacucacuagaugaaucacaucugaaaugaccacuuccaaagccuaagcacuggcacaacaguuuaaagccugauucagacauucguucccacucaucuccaacggcauaaugggaaacuguguaggggucaaagcacgagucauccguagguugguucaagccuucguugacuaugaagaaaaggaagaaaaagcaaaaagagacaucuuauuaaucgauuuggaccauaagaagaaaaucgaaugacuguauacaaugacuuaaucuaaaacaagaauuccaggaggauuaagaggcauucaucuguucuaucaaggcauuaacugcucuaaaaaaccaugguuagaugugacaccugucacaggcacccgacaggaagcccaucuuuuauuuuucccuugcuucuaagauaauugccauuucuguugaaacuacuucauagaacauggaacagaucuugaggcaauugaagcuaguggagaacuuuagugggaugcaaagacuaaugaugccucuccauugguaccugagugaccuugggccagcuauuuaauaccacucugccuugcuucccucaucugcaauacuagcguaauaauaaaaauaucuauaccuccuggggaaucuugugaagauuauauaaggccaugaauucaaaacauugacccuuuuccaagacuuagaaaauguucacuaaauaaagaauaauuauuaaaggcugucuuuugcuuauaaugcaaaagucuuagcauuuuaauauaccauuauaauguaauuuucacuuuuauuauuguaauuuuugcauaauagugcagaaagccuagauuuuggacauuguuauuauaguggugagacagcuuuaucagugaggucaacuguuccaaauaagaaaaugcccuuggaauauagaugauuuaggaauaaguaagggagucucuucauguuaccuaagaucuuaucucuuuaugauuuggaaaagcuuauuuuaaaaaaaucuaugcaaacaaagcaugcuucaaauuauucccuaaaaauuagauaaacuaauuugacuuaaaaucccacuguguauuuuucuuuuuacagugcaaaacucaaaagcucaaaagcaguagauauuugaggugccuaauuuuuaaaaggugucacccuuaaagaaaauagcguuuuggagaacugguaagucugagacgucucaaagcugggagaaccugguuagaauguagaauacugcugcugggaauaaggaguuuaaaagaaaaauggaaggaacuuaaauuguuacuagggguuucuauacucaaaagagccaggaguucaaauuccauccuaacuaaaguuaaagagauggaaucuuuaaaaaaaaaaaaaaaaaaugacuuagaaaagcacaaagaccuuuuugcucuugaaaauucuguucacguggcauucuacuaguaaaaccacaaaaggcaaagauaagcauuacuguggauauguaauacaacaaacacaaaauaaucuccucccaaccucucuccagccaaaugcucaacugcuuaauucacaggaauuuauacauguaaaguagcacagucuucuaucagaugagggaaggggcuaaaauuaaacaacuggccuuaggaauaaaaucugucacuuggcauagacaggacuuagcacucucuguugguguggaguagagaacucuccuguuggaagauuggggauucacgguuuugauuauccccuaucucaugugccuuggugaauuuucagcugcugcaaauugagcagccagguggcacgcuauugauuuaaaaggauuucccaggugcuacaaagaagaguuaaugaucuuuuaaccucuauagaagcuuuuaaccuguauagucagaaaaaaaaauggaaauaacauuggaaaaaaauggaaauaacauuggaauaacauucucugcagacagaaaugcacaauguugguagcauuuuauaucaggagcaaaagccaacuguccccaugucugcagaagggguauuuucuuuauagguaaucguuucaguauuuaaucacucaagaggacagcagcauggugagauggagagggucugggaaaagacaucaggaaaccugugcccuauaucaacucagauacucagaaguaaggacucagaguguuguacuaaauaauauuugaaaucccuuccagaucuauaaucauaucaccauuugagagucugucaauuacguaugcauuuugugaagacaacaggauauggcaggaggugggggagagauuaauuuaauauaaaguugcucauuuauuucauguugauguguugcauuaaaucccaaagauaaaaagacaauggcaacaaagguacagucaacagaaaagcccaucucugguguacagcagaggggagccugugucuaaauaguacguguuuacauaccagaguugcccacgguaacaaccucuucccgaaccuuaugccucugcuggucuuucagugccuccacuaugacguuguagguggcaccucuggugaggccugucagaguggcacugguagaaguuccaggaacccugaacugcaauuaucgguacauccaaagcagagagaaagcauuauagugaggaaugacacgggcucuccucuuaccaauaacccucacuguuuaaacaaagcaaaggaagacaaaaaacaaaaaacaaaaaaaaaaaaaagagggaggguauagugguccuaaccagcugaggagagaaauggaacaaggauaggggccaucguuccugccagauuuuccugccaacaaucuaccuacgugcuccguaguuaacaggagcccucgacaauacuagagacggccugccauugaucuugcuucagucgcaggucugcauaagcccucuggaagcccuggccauguuugcuucacauaaaaccuggacacugcgcuauaugggagacacggucaugcuccuccaggugacaucugaccccaguguggaguccuuaaaacaguugggcaaauccucaaacucauguuucuaagcucauaaauuuccuacaguguugucaguuuuuaaauucugccacuuucuaaaaguaacaacacaauaaaaauugauacugucagugggccggguguaguggguggcucaugcuuguagucccagcacuuugggaggccaaggcgggcggaucacgaggucaggagaucgagaccauccuggccaacaucgugaaaccccgucucuacuaaaaauacaaaaauuagcugggugcgguggcacaugccuguaaucccagcuauuugggaggcugaggcaggagaauugcuugaaccugggaggcagagguugcagugagccgagaucacgccacugcacuccagccagggccauagagcaagacuccaucucggggaaaaaaaaaaauggauacugucaacacaaauuaaauaauauacguuuuagagaaucaaucacuuaucagcugcuaugcacagcuucgccuguuuuuuuuuuucuuuagauauguuguagauagugggguucuucaaggacaaaucguaaagguaguguuuuagacuucugcacacaaauggaaauucagguagaauaucuuucuuuucuagaaucaucuaucuuacucaaaaaggaaccucaaaugugugagaauaagagaaauaguuucauuuucucuaugaaauaaaagcuagugacucucugguauguccuccaaaguagagccauauugggauuuaaaaaaaaaaaaaagcagggcuuaaaugugccaucuucuaagagguucuaaaaguggagccacuuuuuuuuuuuuuuuuuuuucaagagacgagguuucaccauguuggccaggcuggucuugaacuccuaaccucaaaugauccaccugccucggccucccaaagugcugggauuacaggcgugagccaucacacccggccaugaagccacuuuuuauucgagggcuggucacuucaguuaccuaacuuauuccuuucugugcugccccaugagaagugaagagaacaauuaauuaccuguaaggguucuucaucagugccaacaggaugacaugaaaugauguacucagaaguguccuggaauggggcccaugagaugguugucugagagagagcuucuuguccuguagaggcauuuggauugagucccggaccguguggguacaggugauagucuacaucuucccuggggaugugaccaauuuggauuuccucaccuacauucggcggguauggucuuggccuaugccuuauggggguggccguugugggcggugugguccgccuaaaaccauguuccucaaagaucauuuguugcccaacacuggguugcugaccagaagugccaggaagcugaauaccauuuccagugucauacccagggugggugacgaaaggggucuuuugaacuguggaaggaacauccaagaucucugguccaugaagauugggguguggaaggguuaccaguuggggaagcucgucuagccgagagagguuagagccaaaaaagcaaagcgcauuaagcuccaggaaguagcagcaaugauaauaaucgauucaggcaacaaugacuguucaucaauuugauaaaagccaccagaaaaugagcaguucugagaucacaaaacacuuuuuccagaaagaaaucuuuaggauuuuucucaaagguuucuuuauaguuuagaaagaaaaaaguguuaguaugaauuuaucauacacacagcuuuaaaccgcugagccccguagaagcugccucugcucaaauuagaccuaauggaacugaaaugugcagucuuucucuuucucucuuucuuuuuuaaauuugagaagcaaguuguaggaaguagaauccagacuaaucauaucagugucauaaguaugagaauuacagagguuuggcucaacaguuuuucaugguuugaaaugguaaaaauagauaaaacacacauguucauuuuugaaauuuuccuauaucaggaauacacauuuucuugaaauuaacugaaacuggaugcaaaaguaagacauuauuuagcucuaaguuguagaaaccaaauaaagauaaaugugagagguuucucucccuccuuuaaaaaaggaaacauuuuaaaauucaacagaagguauaaaagaagagcaaugauagcucuucuuuuacauuuuaacaucuuguuugaauuuuuaaaaggugaauaacaaggcuuuauauugaguggcuguaguaaagaaaaaaaauaaaaccaaacucugcagugcauguuaaauuauuucuccuauuaaagaauacaauauauacacuaugcuguuagauaaaaaaaaucacaagaaaugcaucaaaacauggagaaccuuuucauauugcaagauugcucauuuguuauuaguuuuguccuaucuuucuccuuguuaccugcaagauacucuuaccugucuuuuuccuuccaaucaggggcucgcucuucugauuauucuucagggcaaugacauaaauuguauauucgguucccgguuccaggccugaagggagaauagaaccaucacauuaugucaaugggcucagcuagucaaguggaagucggucucaccagcagacgcuacugggagcaggcacuuccucuccagcuggcuguuggccucuugaagguaaaaucgacuucacuuuuccuccauaaacacccaaauauccugcauauaaaguccgcaucgcaaacuaauuaucuuacuaucauaucugacgccugaauagacauuuuuuggcuaacuuuuccaggguauucuuuuuuuuuuuuuuuuuuuuuuuuuugagauggagucuggcucugucacccaggcuggagugcaguggugcuaucucggcucacugcaagcuccgcuucccagguucagccauucuccugccucagccacccgaguagcugggacuacaggcacccaucaccacgccuggcuaauuuuguuuuuguauuuuuaguagagaugggguuucaccguguuagccaggauggucucgaucuccugaccuugugaucugccugccucggccucccaaagugcugggauuacaggcgugagccaccgcgccuggccuuuccaggguauucuuuuaacguggucuuauuugccuuuuugaauuuaagaaaaucuaucagcaucauauaccaccacuggaauauaaauuugaaagagaguccugcagauuauauacaugaaucuacuuaggccuaauaaccaagcaguccucaguggcagaucaaugaaaagugaaacuaaaggcaagugaaggguaggagagauuggccaguguuugugcagccucugugggaagugucuaguucaauuccucucaugucugcuucuauuuuccuguuccccccaauucuaaaaagccagugucuccuucuaaugucuguauguucugugggaauuuuaaaguccaggugauacucuauacagacugauaugguuuggcucugugucugcauccaaaucucaucuggaauuguaauccccauguauugaggagaggaggugauuggaucauggggugguucccccaggcuguucucaugauagugaguucucacaagaucugauaguuuuguaaguaucuggaaguuccuccugugugcuucucucuccugcugccauguaagacaugccugcuuuuccuuccaccaugauuguacauuuucugaggccuccccagccaugcggaacugugagucaauuaaaccucuuuauagcaguaugaaaacagacuaauacagauaguuuaaauauuucaucucuugggcaaaaauaauacuagaggcuuauagucuuucccaccaagguagacaacucuuauuccccauuccaggcauucuuccaaugugggugguugggacugcucugccucaagaccuauccugugauaguggucaacaaggucaauggcagguggugcacuggcaaguccugcaagauugccauaucuauagagagcugaguguaaugacagaaucacaaucagcuaguaugcuuugaaaaauaucuuucuccaggacugaauugacagguaucuggcaaacuugcagcgaaaggaaaacaugagucuagucaugccauuaguacagucuugaaauugcauuuuccuucacucaugccuuuugggauguauuaggcucuaccacuccuacacagagaaugcuuuuugagguuaucaggaacagaguuucgcauucucaugacacaguaucaaagacgcugugggaguuugcuaaggacuucauguguccuagguaguaagaaggaaaaugacagcauggaagcagcaauaccaguaauaguagccucugugacaccagggcggggccgagggaccacuucucugggaggagacccaggcuucucauacuugaugauguagccgguaauccuggcacguggcggcugccaugauaccagcaaggaauugggugugguggccaggaaacgcagguuggauggugcaucaauggcugaaagaaaacaaaauuaagucucuaagaaggcaaauaaccaagaaaauuacucccacacuuuucucccgagccguucuaaacacacuuaaaagaaucugagaauacuguaaaccggaaacaagauucucuggaaucuauaauacaaaaauauacgccucacauuuguuuuuugaguucaugaaacugauugcauacaagucaauggcauuuccucaguagaagguauaguuaccaguggaggcgucgaugaccacaggggagcuccgagcauugucauucaagguguacagguagaucuuguagucagugccugguuguaaaccugggauuugagaagagaugauuuuuaacaguucuugcuuuuuacuaggagaauucucaagcuagccugcaauuuuucuggguucuucuaucaucccauauuuauauagacuaccaaagugguccacauuugaacaguaaaguagagcaugcuauggauguuaacuguuaacaagaaacauaucucgaaagugaaucacugauacagacaaggacacugguaaaguaaauucuggaaugcaaaaaugcuauguuggaagaggcccucuugcagaaugggggucagccacuuauugagguuuucucuuuaccguaaucagauggucaauaguugagccuuggaaucacaauuuuaaaaagcuaaaaaagaccucagauauugaauauucuucgguuacaauuuuggccuuuauuaagugguauuguuuacuuuuauauuaacuaugcuuuuuaaugcuaagaucuauacaucacuguuuuuuauuucuuuuaguuuuaaaccuuauguuacaauuuuuuaaauaagaaagggcacaaugauggaagaucaaacuuguugauugacacuuacgcaauuuccaugacaaauauuacacaaaaucaggcauucaaaggacaaaacuauuucugaucauagcaugaaaauaacguucuaaaacuggguuaugaugauaacacugaaaauaaauuuuaucagugucagucguagaacaguuaauaagcccguuuacauuguggguauuuguuaacaaaugugguuagugcaaugaguucccugaccugugaugguguagcuucugacaucuggcuugaugguucucuggauuggagucuggccauuggcuggaacggcaucaacuuggaagccagugaucgucucagucuugguucuccagcuaauggugaugguggucucaguagcaucugucacacgagcccuucuuggugggcugacaucugcacaggagcauagcuagagauuagugccugcuuggcucauccauguaaaguuuugguauuuuaaaacguuuccuugguauauaucaaauucauccauuucaagaaauauauaacuaguaauguguagauuaucuccuuuggcauucagagagaaaggucaacuguaauuagaaaauaggaaaauaucuaccucucagacauuuuauuuugaagagcugaaaagcuuuauagauacuaccagugguucccagggcuggcuuuauaguaucuacaaauacuucaauaaauauuaaaauuauuaauguauuauaauguaaaaauaugugugguaggaguuacaauaacauggccagcuaacaauuuuguguguguguguguguaugugugugugagagagagagagagugugugugugugugugugugugugugugucuaauauuacggcaaguauuuuguauuuucucucaacagguacaaugccaucccucuuuuauaaaugauaaaacuuugacacuuuaccugacuuuugaaaaggcauacaucaagguauugauauaacagaagacuagaaucuaagccugauuugguccaaugguuacugugcugugauauaauuuggauauuugucccuguccaaaucucuguugaguuguaaucuccaaugcuggagguggggccuggugagagguguuuggaucaugggggcagaucccuuguggcuuggugcccucuuuaugacagugaguucucaagagacugggucauuuaaauguauaagguccuccccccccaacucucucucucucucggucuugcuuuugccacagccaugugaugugccugcucccccuuggccuuccaccaugaguaagcuucccaaggccucccuagaagccaagaagauaccagcaccaugcuuccuguaaagccugcuggccugugggccaauuaagccucuuuucuuuagaaauuacccagucuccgguauuucuuuauaguaaugcaagaauggccuaauaugcauuguuaagauauagcagaagccaguggggucuccccaagcuuagcucuaugaaaacaaauucuaacaaguagagcauaaacuagaugucagucauaguccauaauaucaacauuauaagcuuaugaagugauuccauuuuaugggucaguagaccccuuucugaaggaguauaaaagaugacagucaugcgucaaaaaggcaaucaaauugauuuucaaauuaggacucauuccacuguuaacauauaaaucuaaaaaauuauuuauuuuauuuauuuuauuuuuuuuaagagacagggccuugcuauuugcccggguaggucucaaacuccuggccucaagugacgcucccgccucagcuucccaaagugcuuggauuuuagacaugagccacugaaccccacugauuuaccauucuuuaauuuuugucuauacagaagguuuguccauaugaagacauuuuguuacuuacucuccagaguggugacaacucccugagcuggucugcuugucaaaguguccuuaagagcauagacacucacuucauauuugguggccaccuagagaaauaagggcauggugagcuuuagcaacguccucaacugaaacccaaggaguuucacuacagcauuagguaaaugcaaugguuagaaaauaaaaaauaaacaaaccagcaaaacccacaaccuugaaaauuccuagauuaauuucauuccuacagugcaggugauaaauguauuuaucaauuuuaaaaugcucuuagcgguuaagcuuaaguaagccauagauuauauacuuaaacuaagcugguaaaaaaaaugagaaaaguggguauuagcguauuuuucuuuuuuaugaucugacagguguaaaucauaauuuuuuccuuaucauagagaggcaaagagaauguuccauuuugucucugaacccucuuucuguaguuuccccugaaauuggccuuauguuaagagguacaucaguccccuagguuccuagcaguuuucugcauguaugucuggaaggauuuuaaaauguuuuaaugaggguaggcucaagguagacugguacaaacuguaaaauauucuuuaccaagguaacagagcucagaaaaugcauaacuaagucgauuuaugcauucaaccaauggauauguaaauugccccccacaaccuuuuaaaauaagcacaauacaucuaaaagagcugcacaaaauccaaagcuauuuauaaaauucugucccaauagucaucuggaaaacuuaggucaacauaaaggaauuccguugauauaaaauuacaauaagauuauuugaugcagaggaaaagaacaguuagauuuauuaugauauuauauuuucaccaccuuagaaacuguguuagagaugaucuccaucuuuauuccaaugaacaacggucaugucuuaccauaaguccugauacaaccacggaugagcugucaggagcaagguugauuucuuucauugguccggucuucuccuugggggucacccgcacucgauauccagugagcugaacauugggugguguccacugggcgcucaggcuugugggugugaccugagugaacuucaggucaguuggugcaggaauagcugucgagauugucauugguuagagguuaucuuauaggaaaugggggaaaaggaaaauaaagugaguuccaagaaguagaauggauuguucuuguugggcuagguggguucccuggucaagcaaagauucaguacaagaaaguacguacaguaagggaugcaaaaugaagaaaguguuugcugagaaauguguuuuauauccaccaauucucagaaucacugaaaacauuuggguaaaugccaaaacucuaagagauuuuagguuuuacaaguuuugcuuucccuuaaaaaaaaaaguuacauuggcuuauuggccauuaugauuuauuuuacuuuuguauggaaaaauaagcaauggcccuuuuucuuucuuaaaauuguuaauuaauuaauuuagaaacggucucucugugucauccaggcggcagugcaguggaguuaucauagcucacugcagccuugaacucguaggcucaagugauccucuaccucagccucuugaguagcugggacuacaggcaugugucaccacaccucgcuaauuuuuucauauuuuuuuguagagacggggucucacuucauugcccaggcugaucaugaacuccuggccucaaucagugcucccggcuuagccucccaaagcacuaggauuacaugugugagccacugcacccggccuccuuuuucuauucuacauaaaguaucuuuguauggauaaccauuucacgcaguauuccauccaaaaaagagagaauaauguuuuuauugucucuuuauuuggacccuauggcagauauggcugcuaaauuugacguucucucuguaaugcggcguaagaagaaaacuggcucccaacagaagcagaaaagagaagcgaaaagcaauaauacagacugucaccucuaggguuuaugcugucacuaggauacaucuuuagcauucuacucugcuucagaaauaaagcacaagaagauaaaguauuauggaaagcaauugcccuauugauuauuuccuaggugucuaaaucacaaucauuuaagcuaauuauacaccagcauaugauaucuaaccagagaagaaaggucuuacccacgugugcucagaaucaugcugcuaugaaaugcccgaguuuggguuccuuuuuauaaguaagcucuguaaugccaaacuucuuuucuuuauacauagugaggguaaucacagggagucagagcuuaggaaauaauccacaacuuuaguauccucuucaaaugucuugcuuuauggucuuguguauaagccaggauacuccaaaauuucuuuuaaucagacuuguuuccuuaaauaucaccuaaguuuuauuguuucuuaccauuccucuuuaaagaggaucuuuccuaauaauucuuuuucacccuuacacgggaaucaauagcccagugaagcauaauucauucaguagggcauaaagccgcugcucccaugggcaccugguggugcaauuaaccauauaccuguggacuggguuccaaucaggggcuggcucuccauaucaucgugcaaggcaaccacacugacuguguacucagaacccggucugaggccuugcagcucugcagugucuucuucaccaucaggugcagggaauagcucauggauuccauccucagggcucgaguaggucacccuguaccuggaaacuugccccugugggcuuucccaagcaauuuugauggaaucgacauccacaucagugaaugccaguccuuuagggcgaucaaugucuguuaggcaaauuaaugguaagagguuaugugaaaagcaaguugugaaauaagcauuuuuauaacaugcaaagcaguuuugcagauaccauuuucuuugaugaaguccaauuaacccacuaucaaaaggaaaaaucacuuaaacacuugcuuaauuuuucuugguuuagaaaauaugcaauguugcaucacuuauuaaaacauagguguaugugagauaagcagauacccugcaaaauguccccacaauggggauguauuuauauuaauuuaaagauauucuaccacgauuugauuuuuacaaugugauguuagucucauagaccuggauuuucuauaccuuggaagugguaaagcugauuugcaaugucagauucaaauuguuauaauuguuuuguuuuguuuuuuuuugagauggagucucacucuaucaccuaggcuggggugcagaggcaugaucuuggcucacugcaacuucugccuccuggguccaagugauucuucugccucagccuccugaguagcugggauuacaggcacgugccaccgcgacuggcuaauuuuuguauuuuuaguagagaugggguuucaccauguuggucaggcuggucucgaacuccugaccucgugauccgccugccucagccucccaaaaugcugggauuacaggcgugagcccagcccuauaaugguucuuacacucuucuuuuccccucucuauuaagcauuuauauuacacucugguccagccauagcccuucaaaugccccaaacauaaagcuacaugaggcacacuucaaucaacuuuaccauccaguuguagaaaagacggucuaggaaaauuuuuuguagauuugcuauaggcaaauaagauuucgcugaggccauuugagcaaaagaaauucaaagcacagcaacuaacuauggugguuucacaacuucuuucucuguaaauuccucgcuuggcacugagaaggaaaaaagauguucguaaagggcucagcucaagacauaaacuaaccaacaaguucacuuucccuauguguaauugcaaaagacaugucgugggcauucagacacccaagaacaaaauuugacuuugaaaauggaaaccaagcagugguuacguacugguuacugcagucugaaccagaggcugacucucuccgcuuggauucugagcauagacacuaaccacauacuccacugugggcugcaagccuucaauagucauuucuguuugaucugcaaagggagugaaaagcaaaugcaacauccacgucauccacuauaaaguccucaaguggcgucuagaguuugguaguaaacauaugguggccuagaauuuuuauuugcagaauuguaacaaaaauauggagagucagacuuugauuuccucuuggacaaaccuguucauugcuaauacaaauuaccauaugggagugaagucacacucaaggauaagaucuaaaacuuaauaugaugcccccaacaauuagugauacugcucucagaaaaaaugaaaauuaacuugacucuaauaaauugccuuaagauccuaauuucacaaguauucuauuuaaaaacaaagacaacauagcuaaaaagagcugaaaaagucaguuaggccauuuaucucuucuuagugugaaugauaaacaaaaccagaagggugaaucuaguaauuuaagauguccauaucacuaaauagaacuauccauguaaaaacagaaaugcacuuaagacuucuacugugaaaaggguugauaaugaucuugagcccugaacucaugaauggggacaaugaugacauaggacaaaaaaauacauaguacucacaacaagguagccauuuauauaaaaaagaauauuaggugguccuaccccaucuauccuguuguauaugagaugcagauuacucuuuuuuuuuuuuuuucccugagauggagucucucacucugucacccaggcuggagugcaguggggcuaucuuggcucacugcaaccucugccuccagacuucaagccauucuccugccucagccuccugaguagcugggauuacaggcacaagccaccaugcccagcuaauuuuuuuguauuuuuuaguacagacgggguuucgccauauuggccaggcuggucucgaacuccuaaccucaagugaucugcccgcaucagccucccaaaguucugggauuauaggagugagccaccgcaccuggccgagaugcagaugauucuuaccuggaccugcaguuuuaguuuuuguugguccugguccauuuuugggaguggugguuacucuguaaccaguaacaggggaacuugaaggcagccacuugacacuaaugcuguuguccugaacaucggucacuugcaucugggaugguuugucaauuucuacaaauaaaagcagggagaaaccagugaagccccaguccuuggagacaagauuggacaaguccuccucucuaggucugguacauauucgaaugaucgcuuacaugagaaagguauuucuucucgaaagaauacagagagagcuuuuagagggauggggcaggcaucucaauaccauuuccuauuuuugagaugguugcuucauucacaaagaagcuacauuccacaagcaggugucucuuccuacuuuaucaacucauccauucuuuucccacaaauacuuacugaacacucucuaugccugucguauugcagacaugcggaauauaucgacaaaacugacugaacuuccugcccuuggggugcuuccuucuuuaucuggcucaaaacucuguucgcugcaggugcuagcugcagguuguugcucauuaaaaaggaaaaucuauucuacaauuagaaaaauaccuugggagaacauugcaaaacaguaucugaauaaguaaaagcuggugucaccccagaguagaaguuuguaccuguucgguaauuaauggaaauuggcuugcugcuugcggggcugucuccacggccagugacagcauacacagugaugguauaaucaacuccagguuuaaggccgcugaugguagcuguagacuugcucccaggcacagugaacuccuggacagggcuauuuccuccuguaugaaaaaggguuaguucagagugugagggguuuagagcuacuuggguauuacugauuaauugaauuaccacauuuauagcagcauguaaaucacaucuucuugcuuauucccuuuuaaagagcgcuaucuugaacagaaagggguauuuaugcauguagcaaaccuugguaaguguauaaacauugagagaaaauuacaguuagcgcuguuuuaacauuucagcuuuaaaaugucacugaguaguagaguagcauuagaagugggagaagguaagcccucaacccaggauugcaugcauuguguccuuuuuaaaacuuuuaacagaauacauuccuuuuaaauaaaauuuggaaaauacagaaaaguaaagagaagaaaaaauaaaaaucacuuauuuccaccacugauaauauguuugugaauuuacaauccuuuuauuuccucagcucugccguucccccucuaguuguaguauauaaacaacuuuuuauuuggguuuuagaacaaauuauaucaucuauaucuuacguauuuucuuggaaaaaacaagggcuccguugaauggacuugccaaaguuucuuuaauucuuuguucacuguugggcuuucagguuauccacaacagaaucugauuuaaucagaguguaaaauagcauuuuacugcuguaccugucucuccguaagugauccuguaauaucucacugugacagcaggagcaucccagcugaucaguaggcuggugggggucgcagcaacaacuuccaggucccucggaacaucagaaacuagaaaaaaaagggaaacuuuucacauccguaauuuucaaacaauauucagauuuacuguuuguucauuuuccagauaauugucuuaaugauucuuccauacaaucauguaaauacuacguguaauuagcagaauuuuauauuaugacgaauucaagauaagggguuacagagcccauucaaauugugauaaaaugauuauuucaaauuuggggaagaguuuuuuucccucaacauuuuauuuggaaaaauuucaaaacuacagaaaaguuaaaaaaaaaaaaaaaaaaaaaagugauacaaggccgggcgugguggcucacgccuguaaucccagcacuuugggaggccgaggcggguggaucauuugaggucaggaguucaaaaccagccuggccaacaugguaaaaucccaucucuacuaaaaauacaaaaauuagccgggcgugguggcgggcaccuguagucccagcuacuugggaggcugaggcaagagaauugcucgagccugggaggcagagguugcagugagccaagaucccaccauugcacuccagccugggcgacagagcaagacuccauuucaggaagaaaaaaaaaaaaaaaaaaguaauacaaugaacaccuauauacccuucccuuagguauuugucucuggcuugacgacuugagacuaaaauacagauaacaugaugcuacuguucccguaaguacuucagccucuaucugcuaagaacaaugacacuauuacccuaaaauuauauuuuuaaagguacuuugaaacaguguucaguuuuccaccuuuuuuuuuuuuuuuuuugagacagagucucccucugucaccaggcuggagugcagugacacaaucuuggcuuacugcaaccuccgccuccuggguucaagcaauucuccugccucagccuccugaguagcugggacuacaggugcaugccaccacgcccagcuaauuuuuguauuuuuaguagagacgagguuucaucauguuggccaggauggucucgaucucuugaccucgugauccacccgccuuggccucccaaagugcugggauuacaagcgugagccauugcgccuggcccuuuuuuuuuuuuuuuuuuugagacagggucuugcucugucacccagguuggagugcaauggccugaucucagcucacugcaaccuucgccucccagguucaaagauucuccugccucagccuccccaguagcugggauuacaggugcaugccaccacaccuugcuaauuuuuguauauuuaguagagaugggguuucacuauguuggccaggcuggucuugaacuucugaccucaagugaucugcccauuucggccucccaaagugcugagauuacugacgugagccaccccguccggccaauuuucuacauuuucaacaaaacuuguguuauuagaaaugcauaaauacccaaaucaggugagaaauuucuugagaggaaaaaaauuaucuucuuuacugccaccacgcccgggcuucuuuaccauauucuaaggaagauguuucuccacauuuucucacuucccucuccauguaccaugacaaugaucuauuuuuuuuuuuuuuuuuuuuuuuuuugagagcugaugacagacaacagcaagcuacuuuacagaaucuaccaacuggguaggaaagucuucugaguuucuuugcagacaagaaaaguuaccuguugauuguuggccaaucaauaagggacuuuccucucugccauuaagagcaacgaugcugaccacauacucugugccuggagugagguuggugagggugauggaauuccgagaguggggcacccgaucuucucgaggucucccacugaagugcucgggaugauggcggauccuguagccagugaugguggcucgaggagcaauccagugcacaguaaaagaguuggcaguaauaucagaaaagucaaugccaguuggggaaucaagaccuguuuuucccacccgggggaggaagagaaaaaaaaaagaaaagacaccaccaguuuaggaagugaggaagguguaggggaaauuaacguacauccaacauuucguuccugucucaucaauaccaugauuugccauaaaccaaagaguaagauguacugauucuaagcuacauaugaauuuuaaaaucuuaaauugacucaauucaaaauagccagcucaagcauucauuuuuuucuugugcuaaguaauucaagcagauuuuagggguuauuacaguaaguuucugugucacauuuggagauaaguguucaagaucuucugagaauugacauuuucaaauucuucaguguucaaguauucuguguuucuauccuguaaguguauccuuccaaguaaagcaagaucugcccacucucaaaguaaauguuugacucucagagaagccuccuaagcucaagaggaaauuuauaugucaacagagugguaaugaugccaaacacaaaacuuucugaaacuaaagacauuaucccagacaaauuacaaugcugauaauuccucgugaauugacaguuuugaaaaaugcauuuuucaaaaaugcacaaaaauucagaguuuguugcaaauucaaaucacuuagucucugggacuuccagcaaauuucuguuucaguuacagcauuuacuaguucuuuucaauaagaaaccaaacuaagauaucauaaguccuuuuuggaagcaaguggacuauaaauaaauuaaugaauacacuaaaguguaccuuuugaaagaaaaaauuaaaagcauucauauuuaaguauguaauauuuaugagauucaauucaacuuccuucuaguaaaugcauauuuuauuaaguaaaaagaaaauguaaacuugcuggcuuaguaaaggaagacaaauagaugacaaugaguguugggucagccauuagacagagcugccuaaugaaaaggaaugucugcuaaaucuaaauaacaaagaucuucuuagaaaauguuuuuuaaaaggacagacaacaaauuucuuaauuuguuagugacugaaagucuaggugauuguugaguaagguaucuuuuaguuuuugagaccagcgauaaaaucauacugugaugacaaagguacacacaccaugacaacaaaaaauggagauguauuuuuagaaguagcauuucauuuguuauacagaauugauaggcaaaagcuacuggauagucauacugccaacaccacucaccuguuuucugucuuccucuaagaggugugcucucauguuguucguagacacuggagacacucacuacauauucuguaccaggcaggagaucuguaggggcaaauggggcuuauuuuaaaacucugcucaaaagcaugagaaacuaaagcacgcccaggacuauuugaacugaugaaauauccaaauguccaguccuauagccuacuuacaccuaagugaacacuacagcgaaguguucagugaacagaccuugagaaggucuguaauuagaugauaaggaagggucaccuugccccauggccucucgaagcccuccauuccaccugugagugugacucagcuggauuucgagugggaugaaguugcugcaacagcuggauauuucucgcauccaccugagaguaugucucuggagggcacaugauaauccuugcuguggugcuguggauugccauuuaugccucacaacaacccuggaagguaguuugcuccuuuuaaaagcaauuucuugucauacaacguacugcauaucuuuaaagugauggguuuuuacauaugugugacuugggagaccaucaccgcauucaagaaaugaacaaaccuaucaccucuaaaaauuugauuuacuacaauuaucuccauuuuguaaaugaaaaaacaaaaaacaaaacaaaaaaaaacugaggcacagagaaguuaucuucuuuaauuuacuugcccaggaucauacugggauugacccaggccaggacuaguggucuuaauaauuaaccuuuacuggaaaaaagccacacuuagaaagcaaucgguucugccauauuaaaaugagagcagaauauuuuuuaaaaaauuaaauauacaucccugaguaucuuguuccauuuuuuuuuauuuuuauuauuuuuucuuuuugacgagguuuuacucuguugcccaggccggagugcaguggugugaucuuggcucacugaaaccucugccuccuggguucaagugauucuccugccucagacuccugaguagcugggauuacaggugccugccaccaugccuggcuaauuuuuguauuuuuaauagagacggggcuucaccguguuaaccaggcuuggacuggaaauccugaccuugugauccacccgccuuggccucucaaagugcugggauuacaggcgugagccacugugcccagcuucuucuuccauuuugauacacagucaggcauagcuuaaugguggagauacauuuugauaagugugugauuuggugauuuuauuguguaagcaucauagaguguaccuacacaaaccuagaugggcuuguaaucccagcacuuugggaggccgaggaggguggaucacuugaggucaggaguuugaaaccagccuggccaacauggugaaaccccucgucuacuaaaaauacaaaaaaauuagcugggcgugguggcucacgccuguaaucccagcuacucgggaggcugaggcaggagaaucacuugagccuuggugguggagguugcagugagcccagaucgugccacugcacuccauccugggcaacagagggagacuccgucucaaaaacaaaacaaaacaaaacaaaacaaaaaaccuagaugguagagccuuugacacaccuaagcuauaagcuauguggucuagccuauugcuccuaggcuaugagccugugcagcauguuacuguacugaacacuagaggcaacuguaauauaugguaaauauuuguauaucuaaaagauacagagagugagguuucuaaauuuggaacuccuacucacuaaacccucauuccccugcacaccauuugcccuucagcguuucuauaaagcccccuacaaaaguuuggaaaagugccagaauggaggaccagaugccuggauuccauuuccaccauacuagcuggccaguggcaauuuacuuaacugcuggggaccucgacggcuucauguuuauuuguuuguuuauuuuuuugagacagggucucacucugucacccaggcuggagugcaguggcacgaucauggcuugcugcagccucaaccuccccaggcucaggugauccuccuaccucaacuuccuacauagcugagaccacaggugugcaccaccaugcccggcuaauuuuuguauuuuuuguagagacuuggucucacuguguugcccaggcuggucucgaacuccugggcucaagcaauuggcccaccucagccucccaaagugcugggauuauacaggcgagagccacugcacugguuugcuucaucuuuaaaagaggauaauaaugacuuugcuaggagggagaggggcuacccugaggucaucuguagcauuaggauuauaauaaggucuuagaacacaugauuagcaugugacaggucuacggcuaagggacagacauugugaugcaggggcuuguauacugggugaugcuguaauuagugauuccagggugcucuagaacagaagcaacagcccuggggugguggauaugccaauauaaagauauucuugcccucagccacaaaguaagaaaccaagauuauggucacgcugagcugcucuucuuuguguuucauuaucuaaauuauguuugaaagguagauguuuucagacuaauacuugguaauguaccuaaauguaagcuauuuuucccuuauguagaaucuuuugcuguuguuauauauuugacuauuacagugaaaauaauaaaaagcacuguuuaugugaaacacagcaccaucuugcagccuacuguuuuauucuuuaacaaaagaugucuauucuauaaugguugggacuagaaagagacaauuuccauaaauuguuguuauuuauuuaaugucaguuuuuuuucuaagcucucagucuucugagaaauccuucuaacagauucuuuuugaaguacaaauuaaacuucugacucucuucacaacaacauucuaaucuagaccaaacaaucagucacuuuucuaaguauucaaauccuaaaucaaucaacugcugacacuuuuuuuauaaaaaugagaauaaagcacauauggugacacuauuuucaguucucauuuuuuucucuaaagauuuagauuuagucauauaauuucucuugauauucacuuauuuuuacgugcuuauuuagaagcagaauuuguuugaagucauggaacuuuccugcagguguuuuuccacuaugauuuuuuuaaagcuguagauaucaaaaguauauuaagauagcaacaaacauuacaucuuucaaaauuaauggagcugugcauugaauucagaguuuaguuuguagcuugguugcagcucucuugcucuuagcuccuccuacuugagaauuuagaauucauuugcuaugcucuagguuaauauuuauggaacagauacauucaacugcuuacuuguuaagaccacugcauugucugaaggagaaauugacaacucugcaacaucuuccucauuuuucacaggugaguaacgcaccaggaaguugguuaaaucaauggauggggguggagcccaggugacacgcauggugucuggaccaauguuggugaaucgcaggucagugggaggaggaacagcugguuucgaacaagaaggaagacucaguuaauguaauuuuaaaauuaaagcuaacgaaguagcuggaaagguaaaaucaauauuucaugcauaaaggaaacagaaucauaaucaugcaaacagucuaaucuaagucuauuuuaaguuauaguguacuacuguuaaaaauaaaacacuacacacaguacuguuaggcccccuuuaaccuuuuugccaucauugauauauuuaaaaaaaauuuuaaucuacuuucaaauauguugacuuuauguacauuauuaauaccacugcagauuauuuuaucccaggccgaagaggcuuaaguugccacacagcaaagagaaacauagcaguacuuuacaaagaaauacaugcacacagacaaaaagacaagaggguccuaaacuuccccccaugugagauaucuagagcuacaguuccauucagugaauucuacuuacaagugaacauguucaugcaaauugguucucagcauguuucuuuucccaugcacagcagagaaccuuuaaaauguugcaugcuuguccccagacugugguuaaagagguguuucuuuaccuagugacagcaacaaaaccuagaaugcucccaaguuuacuuuucuccuaccucaaaacaaugcccauccacucuacccuaaauuuugauggguuuuuagcuacaaagaaggagcaugguagaguuuaucaaaggguagaaggaagaucaugaugguacauuuuggugauauauuucuuauaauuaauugguacuuacgcaauuugguauucguguuugguauuuaagacgaaaaauucuaggucuucaaauugaaugaacauuugcuauuuuauauuuaacagagcagacaucuguauuucucuagcuuuauaucuacuugugguuuaaaugagaguguacugaagaauacuugcauguguuuuucuccaaucaguuuagcagaugcauuugauuccuuauccccccaauccacccuaucugaaucuuuggccaauugcugacuucccccaugaaacauccauauuuaaccggaguaacugguggcagcaugcaacaccaucuaugucucaaacgcagaaguuuucaaaauucacccguuuguugugucaguguaguaggggcacucucgccgccauuaaugagagugauaacgcugauaucauagucaaugcccggcuccagcccugugacuguguaguauccuacugaggaguccacaaaaucuucaaaaauagggauaccuucuccugccgcaacuacugugaugcgguacccaauaaugguggaagaguuuagcgggguccaccucaggccgaugcuugaaucgguuauaucaacaaagcuuaggucagugaguuggggcaccucuauugaguuacaaagcaaagggagggggaggcaaaaggaaaauagagggaaaaaaagaggaaaaaauaaagcaguguauaucagguuacuaguaguaaaauugguggaauguuaaagcaaugaugguaauaugcaaucuguuuuaaauucucugaaaagacuuccuaagcaucaugaacaguuugcuucccuagaagaauaaacaggaauauucuuuuagggaauauauauauauauauauuuuuuacauuuugaaaacauccuuaaaggguacaauuugaacuguucagauuccuaaaaaucauauggcuguuuaggaugucaaaaccauucuuagagccuagacauaauaucugaaguaaguaucagcaaugcuuuuaauaauuccaaaacuguuuuaguagaaaauaagcuugcaugaagaagguuaaaaaauaauaaaugggugauaaauugauuuuuuuucucccauacaaaacucaugacaacaucauggccauaacgcuaaugcauuaugaauguauggugugaaaugugccauucaaaagcacauucaggcugaggaaagacaggccuaagguuaaggccauugccacuauuuuaguucauucauaaucaaaacauguaauuagcguuaguaaaagcauucuacugaagaguccaaagggggacacgaucuguccaaugcuuucauuauguuauaacccaauggacaaacaagccuauccuuagacaggccuuugcaauguugucuuucaagccacaagaaagaacacccugaaggugugacuuuuacuucuuuuuuuuaaaauccaauuuucaaaaagaaggauuugaaacugcaagaugaaaaacuagaugugucaaccaaaugcuguuucagugcucacauacagggacaaaacuauuuuauaggcagcuguuggaaauugauauggauuguaaaaucgggcagaaauguacugaugggaugcauuuaccauauuacuuugagccuaucaguacugaguacagacacgugacaguguuuuagucauacuuccaugugagcagacaauacagaguuaaagccauggcugccacuccauuacauacucgcugcaacacacagcaucccagugaagcacagacaguaaagcaguguuaacagcaagcauuuguccaaaucgcugcuuugacuucuugguuuuggaaagugcagcugggagaucggaauuaaaucccaaauauaguugacacccuuaagcaucuggggauuaagaugcuaauccccacucuuauuggaagugucacucucaggauagcagcuuauuuuucuauuaccugggaugaugguaucagagauagggacacuuuccuugucauccuugacaguguaaacacugacauuguacuccaggccgggacucagguuaucaaaagugcaggagcucugaucagcauggaccacuucuuccaaagaauuucccugcuggccguuuguagggguugugguaauucuauaaccaguaaugucuggagaaaaaagaaaagggaaguuauugcacagaggaucugugagccagagcauauuuaacuagacuccaaugauggauucacagggcggaaugcaggacuuggcauuuacugaggacuccacugucacuguuauucaaugcuugcaacaauccuuucaggcaguacuaagauccucacuuuauuuuuuuauuuuuauuuuuugagacagucucccucuaucacccaggcuggagugcagcggugugaucuuggcucacuucaaccuccgccaagauccucacuuuaaaggaaaucuugaaccaggggagugauuccccaaagcuuucuuuguuuccaaaucucaugguccuaucacuguacccugcuuuuccuuaaugaaucauuugaagacagcugaggaauauuccuuucuaccugccuaguauagaaucgcucuccaccuuaagcacauuccccagagagcucuccuaauuuaaaaggucugaaacuaugggauuuauaggaagagaaccaagaaaggagaaaaggugagaaacaaaagugcugauacuuauucuagaaagaguauugauugggagguugaggcaggcagaucaccugagguugggaguucgagaccagccuggccaacacgguaaaacccugucucuacuaaaaaucuaaaaaauagcugggcuugguggcgcaugucuguagucccagcuacuuggggaggcugaggcacgagaaucgcuugagcccaggagacggagguugcagugaguugagauggcgccacugcacuccaagccugggugacagagugagacucugucucaaaaaaaaaaaacaaaacaaacaaaaaaagagaguauugauuguugaagucuucaggaaucacagaaauugggcaguaaaagaguugagagggaugagagacauucaaauaaaaacagugaugacuagagaucuguggggacagauuaaaaugagaaaguauauuaaacuuuauaaaaggcaaggagaugacagaauauuuugccauuaggaacaggguaaacacuaauguggcaaauacaaggaaacccaacugaaugagaaauaaauauugagaucauuacacuugcuaguggucauccauaugugugggcugggccauugagacgagauauuaaugauccugcugcuaacaagcacgaagauugucaacuuaaaguuucaaauucagagcaacucagcuggaaauuguauagcuuuggcuuaaacaauguuuccgcagauaaugaaaacuuuaccaaaaucacucuacuucagagggagauuaaaagagauauucugagcuaguuucauucuguguguuugcauacauuaaucagauuuagagaugauagccuuagcucugugccccggcaaagauaagaacuauauaauacuuuuuuuuaaacaaaaauuucacaagaauuuuacaguaaaauuagaaauagcuaaauaauaaccuaaacauaucccuuaaauuaacaaguauaugagguaagaaugcaaucaacauuaauuggaacuuuuauuuuuguuuaagauuuuucuccauagguuuguugagacuuccaugugguuuuggcaaaaguaauggguaucuaaaauuuccuguuauugcuauaguacgucaugcuguuugaauauuguuaacaacuaucuuuauacauuuuagcauuuuauaaauaauuuucaaauauaugugaacaaggaauuuagacaaaugcuucauuuaaagcucuaaaaauggucaggaaaccccuuaaucagaauuuucaguuugcauagaauauaauuaaaaaaaaauuacauuccaaauaugugacauugggugugagaaggagucuacaaacuuaaguuacaaucccaguuuuguaacauuuaaaaugugugacuaugaguaggccaauuuuuucuaagucucaguuuucuuauucuguaaaaugaagguauuucugccuuucaucacccuuaaauauuuguggugcaacccaugacaaaacauucauaaaacuucagggaauaauaaacuuaggcucuguaacaacucacaaaagggaaauuacguaauaugacuucaaccauuuguuuggcaauuuuuaaugcacucagcaaaagccaccuuccacagugcuuuucuucagcccuacagcugugugaggaucugucuugucccccuagacuaguguaagguuguucugcuuccugugauugaagucaacgugcauuaaagcauccugcaggcugcuccaugauguacaucauguacugcuauaguuuuuauggagagcuaagcauuuguaauuugaaucccuucuuucucugaaagaaacacaguuucuaaaaucuuugucuugggaagguaugguguauacuugcccucugauccaucccaaacuuaccugggguggugcuccucucccaggagacugugagcacuccagugucaggguuugccuccagaugcaaguuuguugguggagacaaugcuaugcagaaagaacauuuuaaaagucaaagcugacacaaagcucuugaccuguguaaucuuuccuccuucccuaccucccucucuuccaugcuucuucccucccucccucccucccauaaaaauauagguuacauuaugaaaauaugauggacagcaguaauucucugacaaagacuucuuuaugauuaaugauuuugcaauacuauugaaauuauuuucaucuugccaguucauaaauauucuugacauggaaagaacauuucugaugccauaaaauauaaagcaugaauugaaccugcuacuccaaauucaggaauagcauuaauaauauaaguaaggauaagauaucuccccugugccauucucauaaguaaaaagugauauugacacuagcuuuuuucgaaaaguagaacaguuuuaaaaacuaauagaaaagggaaaaaauucuucuuacgugucaccacuuuguuuacaauuggcgcaucucuuuccuguccaucucucaggacuuggaugguguagacguauucuacuccuggagucaagccggacacaacgaugcuuccugagucugaagucacuucucguggugccucuccucccuggcuuggucguacacccagcuagaggaaggaaugcaaaguaaacaccaaggacaaauauuuccagaggacuguuacugcugugaggcuaugauuaugcuuuaaauaguguaaacucuucagaaacugcacaguguacuuuuauugggaaaugauuuggggacucuuuuauauacuuuagcuggaaauucccccaggugggggagguaucuuccaaacugcauuaagguggcuuguaauggaagguuccagagaaaugucauuacauacuguuuugcuugauaaagaaucucuuguuacaaaccagacguauacagggacugugggucacaugguaguucauuucuauuuuucugugugugugcuagaaggaaugucugagcucucccuuuaacgaguuauucacauucaauuaaccuuuuaguugccauuuaaaggcaccagccccuguagcaacuguauugcaaaaacacaccuuuugaagagauauguacauagcuucaacugcaggaugauacauuacaagagaagaauuagaauaacuaugcccauaauuuaaaauccuuuuaagauucuauuucaaaaacuuagguaacacuguuauccaauaguguucaacucuagagagauccuucacacaucauaaggcuucugaaagucagcaugacauuauuaagggaauuaaaagguauacuggcacucuucagaaaguucuucuauauuugaguagcauaaucauaaauauggccauuuacaaacuuuaucuuugguguauuuuuuuaaacgaucaaggggauugagucaugauuuccagcgauaacaaauauuucucucuucacacuaaaugccaaagaauggaauucuuuuaaacauauucauuuguauucaccgcuucccuaauaucauuacuuuaaagaagaugaauccagauauccacagggaaaccuuaaucuuaacuucuauuaagagauucacccucagugcuuugaacaguuggagaugaaacugauuggaugaaaaugcgauuuuuaagugacucugaguuuaacuggucucccuaaacuggcuuuugugaacuuguucacacucauuuagaacaacacaucaaauaaaguuuucccauguuuuuuugaaauguaauucccugcaggaaaggauagagaaaauaagauaacaauaagcagcagcuucgugcuaauguuuuauccuuugcaaaacacuuucgcagccuccaucuacccuuccaacaauucagugagguaggcagggaaggacuguuaggcccugacaauguagucaaagauguauggacagaagcaggugacaaaacccaggucuccugacuccugagcacccuguuuccacuacaugggaaccacaaggacagcucagggcuguaucacagagauuaggaacaucugcaguuuaccuuaaaaccaauucuuggagcaggcguccaugugaucacaaugguggucucagucaccucgguguuguaagguggaauagagcucccaggcugcacugugagagagaaucaaugcacauauucaaaacucaaacucacagaugauugcauagcauauagauaacaaguauuuuuauggagaaccucaguuuaaccaagcaguggauagaggauguaacauauuuuuucauugggugagaauugggagaggaucaggcuucucaaucuuuaaugugccacacacaucaucuggggucuggcuaaaaugcagauucuguuucuggagguccaacaaaaaacuagggaguuugcauuucugacaaacacagauaauaccaauucugcuggcccgugaaugauaccugaguaacaagggguuagauguuugcuaaggugguccuuucauugaaauuauauaaucuaauucaugucuuuuuaugauuguugggauuugacuuugaugacaauaaauuucccuauaucgucaguguaaaaucccuuauaaaauguaaaacuggccaccacaaacugauuaucauauuguuucuuaaccauuaauuuaagaacaaugguaaauuauagaaggugaucuaaaaacagcuuuaugcugggcggggaucgguggcucaugacuguaaucccagcacuuugggaagccgagguggguggaucacuugaggucaggaguucgagaccaggcuggcaaacauggugaaacccugucucuauuaaaaauaugaaaaauuaacugucaugguggcucaugccuguagucccagcuucuugggaggcugagacacaagaaucgcuugaacccuggagauagaaguugcagugagccgagaucaugccauugcacuccagccugggugacagaaugagacuccgucucaaaaaaagaaaaaaaaaaagcuuuacgcugaauuauuccacaauaauggucagcuauuuuugguugcaauaaaagaugcuauauaaaaguuaaacaaaaucugccaccauggaugcacuuugaagucuaaagauuuguacuuuaaauacgugauuauucuuucagaauaauacugcaaaaauuuaguauuuuaucaccagaaucaggaauuauaacaaauuuauuuugcauuuucuagcauccugacaucacuguuauuuuucuuauugaaaauauuacuuuggccaggcgcaguggcucaugccuguaaucccagcacuuugggaggcugauguaggugaaucacuugaggccaggaguucaagaccaaccuggccaacauggugaaaccuugucucugcuaaaaauauaaaaauuagccaggugugaugguggaugccuguaauccuagcugcuugggaagcugaggcaggagaaucaccugaaccugggagauggagguuucagugagccaagaucacaccacugcacuccagccagggugagagagcaaggcuccaucucaaaaaaaaaaaaaaaaaaaaaaaagaaagaaaauaaaauuuuacuuaaacaauuuuuuuuuugagauggacucuugcucugucacccaggcuggagugcaguggcgcaaucucaucucacuguaaccucagccuccuggguucaagugauucuccugccucagacucccaaguagcugggacuacaguugcccaccaccacauccagcuaauuuuuguauuuuuaguaaagaugggguuucacuauguuggccaggccagucucgaacuccugaccuuaggugaucuacccaccucggccucccaaagugcuggaauuacaggcaugagccaucacaccuggccaaaaaaaaaaaaaaucuuauuuuuaaauaaaagauuuguuuuggguuuuagcaccaaaaauaagaaagaaagaaagagagagagagugagagagaaagaaagaaaagaaagaaagaaagaaagaaagaaagaaagaaagaaagaaagaaagaaaggaagaaagaaaggaaggaaaggaaaggaaaggaagaaaagagagagagagaaaggaaggaaggaaggaaagagaaagaaagaaagggaaaggaaaggaaagaaaaagaaagaaagaggcauguauauauaaaguuaagauagagauuuccaacaaccuugcaaaucuuauuauaaauguagaaagguaagaucgcagaaggccagauauuuugaguuggguaaguuuaaguucaaggguaucaaguguguucauagcucuggucacauguuugacaucuccacaauucuuccucucuuuacaucucaaucaaauuuuguucccauugggaaaaaaccucugaaugcauuuauacuaaauuaugaauggcuggcaagacaaagaauuagucuccagaguuauacaaacagggauuaaaaaguguucagacuccagucucaacucaacuccagucaauuuuuuuuucuuugccaugugggaauuuagaaucaacaucgcaauucucgcauuuuuuuuucagucuggauucuaaggagccauuuuuuauuuuuauuuuaaaaauauugugugagaaaaagccaaauauaugugugggccacuucauaaugauagcucuaauggcugaauugagguacuacugguuuagugggcuguuucaucuauguauguuauuauuuugaugguguuuggugggggguggggggacaugacugggaugggugacccgaugccuuuuaguaccucugaaauuauacaccacuugacugcuggugacugugccaaaaugccauggccagcccugugugaccauuuuuaauggcccacaaaaaacaauucagagaacagucaguuucuuucacugaacaucugugaaaaccacaacuuuuuuuacaaauuauauucgccucaacuguccugggcuuuaagacuagguauuuucuauugcuugagccagccaccuagagucuucccaaguuuaagaugaugcucucugccugggaaggccauuaugggaaaaucaccaaaccacaaacccacaaacgaugucaaacaaaggaugugauucuaagugugagcuauggguucuggcaggucuuguuagggaagaacagcccagcuguuaaagaaauaaaauuugcccuaucaauauaagacuaagcugaauuuuccccagaaacagcuuuuuccccuaacuuuucucacauuugcucuuaagaauuuagcacaaguuauaaaacucagaaaaguuacucccagaauucagcuuaguaagauaguaaaaaacuacagaaauuuaguaauuucaaaaacaugcaagccuuguggauguuuacagccuuagggagugcuuaaaguucaaauggaguuguagaauacccugcuuacauuaguuuauuuaaauauaagcuucauuuagcuguuuuuauuauuauuccuuucucaauuaucuauucaccaaauaguuuuugaaagcauacaauguuccagacacuauguuaaccuuuaucuaauaaaauuaguuuuggcuaucaguacuucaguuaaaaucauuauauuuuauaugaauguauuaugcaaagcauaaaauaauauauccaauauaucagucuucagaaguacuugaaauaucuuggcccaccaccuucccuuaauuauuguuagcaucauuaaaaaugcuuuuucuuuuauaagcacuguguucaacaaaagaaacuacauaaaauaugucucauguuaaggaaugaacaagacaacuauagaauucuacauuuuaguaaaagacgacaucuacugaaagggcgcauucacugaaaucuccauucuaauucacugaaggacauuuauaagaaaugaauauuuacaagaaauauaaagacauuaauuucaugagaguagaucuuagacuaucuuagaaccguguaaaauuuuagccaaauuuucaaguaagcuuauuugcaaauuaaaagugaauuuuacuugcuuacgauuaacuauuauuuaggaaaaagccuucaugagccaaacuucauacaguaaauuuaaauggaaguaaguuuuucuuaaaguaugaauucuuauggggaaaaguuuguauuuucuuugggaaaucaauuccauaguuauuuacaaacuaggcuuguauggacuuuuugaaugcuuuuuaacauccauacuuuuaaauuagucgaagaguaacauuuguugaaagcucuuagaaaauugcaaacuaguccaugguuagaauauaugcugaaaaaguacuuauguuaggugcuucuauaauucaaaaugucgaguugaaaauaacaaaugauguucagcuagaaauaaggagucucauaauucucuguaauguaaauggaaauguauuuaauaggaaucgguuugugaauagagguuguuauugugauguagauaugugggagauuuaagaccacuuccuuuaaaauguugagcaaaaggauagacaugaccaaaaauuauuguuaguauuuuucuccucugaggaauuucaagaguaauuuaagaaaagagcgauuccgucugcaaaaguacuuuaaucuucugcagccaacacucauaaagaaaucauuuccuuggcuucauguucaauuaguugguucccauucaauccauagauauuuuuauucugcauuuauaguuacuauucaaugcccaaaguaauagaauguagacauaggugcuaauuuuuucuugcguuaacuaguguuugguaaauucauuuaauguaaucgaauuuaauuuuucuaauaacagacugcuuuaaacccauguuacucaaagugcuggcccuagaggaaagagcgagcuuggcaaugugugcaaauuaacacacugcuuccuucaucaagaaaaucuggcuucagaaaaauucucagcuguacuaagcagugugcuuugugauuuacguucuggcacaaccguuuuucuuguugcagacuagcagcaaacaauuaacgggccagcagccagucuauggagcacauuuuuaguaucacugauuuaaauuauguacuaauuuuuuaauguuuuuuuuguuuuguuuuguuuuguuuuaaagcaugaagaauagagaauguaaauauaguuaagaaaaggcacuuaauuuucagcuuacgugugguaaagacuccaguggcuuuggggcucucuugguugcccuuuauggccacgagggauacgguguacucagaugcaggcugcagauuccucaguggguacuuggagacagagggacccacauuguacugccugggcuguccucuucggguaaggcccacggucagucgguauccuguuaucugggcccgagguggaguccaucucaccaggacaguagaaucaguuucauugacaaacuggagguuagugggagcauccaguucuaggaaaaaagaugaaacaugccaagaaauauuuagaucaguaaugaucauaacucaaguccugaaacuugauugaaugucuaaguuuucucuccucaagguuguaacuaugugaaagucaaaacccuggaaaaacugagccaguaagagauugagugcuacacaaaacuuugccaaaacucugccagucaugagaaauuguggaaccauuuugcuugacugugauccuuugggaagucuaauuuuccagcaagacuuucgcaucagucucagaaauuauaguuacauuaaagcaaugguauuuuuaaaaaggcaaaacaaacacuucugaaguucacaguuagcucugagccaaacagauuaaggaaaaagggauaugccuccuaaaaugacagcaagaagaagcucucuaugggucaaaagcaauauucugugaauagcccuuugcuagagaaauaaaaguuauuuucacaugguucagauuagacaguaauuacaguaaugauaacguauccucagauucaugguaggauacuggugaguuugcacuaucagaaucacauaaguuguggaguuuauucuugagaauaauaaccagcaguuuucccaccgaaauuuaaauuaccuuucaaauagaggaaaucuuuaagaggcagucgaguauaauaauugagagcaugggcuucggacauagguuauagagccagcucuaucccuuccuaucucugugacccuacaaguugcagaacuuuuuuaaagccucaguuucuuuaaguauucaauacggauacuaguaagaccuuccggcugggcacgauggcucacgccuguaaucccagcacuuugggaggccaaaguggguggaucacuugaggucaggaguuucagaccagcuuggccaacacagcgaaacccauuucuacuaaaaacacaaaaauuagcagggcaugguggcacacgccuguagucccagcuacucgggaggcugaggcaggagaauugcuugaacccaggugguagagguuccagugagcugagauggugccacuguacuccagcccuggcgacagagcgagacuccaucucaaaaaaauaaauaaauaaaauaauaauaauaagaccuuccuuccuaaggucaaaacaaagaguaaauaugagaauaaugcuuguaaaaacugagcagauaagcugguggcuaguaauacuagacacuugacaauugcuauuguuaaaugaauucuacucuaaguguuaugauccugcauuuuaacuuugaucuagauauauuuaguuacacgaaaaaugcacucaaauuagauucucuucaguucuccccucuuaguacccuucagcugguacauguauuuuagaaauggguuaccacuuagcauccauggagcuugucugaguuuuguuuucaaguuuaaugugcuuuguguucacuaugcauucccuugccggcuggguauuucccucucucuaagccauacaccucugagugaaugguuuacugcacuuucucacaggcugcaagugaggguggagaauuuggaggggagauagagauaggagaagacauacugguugucuguugagcagucagaggcuugcucucccucccauggcucacugcaaagacuuugaaguaauaggugaccccaggggacagcccggugacuucugcaaagguguuccugcugaugggcagccucugcccgugcucgccaggcagguugacggggaucacauccacacgguagccggucacugcacucucaggcgguguccacaugauggugaccuucacgucugucacuuccacaaacugcaggucccugggagagggcacuguaucugacagacaagagucaacuggucauucacauucucugcugaagauuacuuuuaagaagccaguuucuuggauauguuaggcaguucauugagccucucauucgagaguuuugcuaaguuuugucucuuaaucagaucacauuuucaugguccagucauagugcuuaaauuaugacauuugaaccuuuuaucuaaaauagguaauaagugaguuaccagcauaugaagugucauauggugguggggggagaggguuauaagaaaagauacuaaaaaauuuuuuagaaaaagccuuugaaauaacugcagaaaauaauguaacaguuuuuguuuuacugaaucauuuuauaauacuuaagaaucaaaaaugaaaugacccuuaagcuucuaggggaaaauuuguagauggacguuauggugucaguuuuuaaucagaaaggccaguagccagcuuugauaaguuacuuaugacauuucagcuaaauaucagaaguuuagggaaaaacuaauauauaagauuucuugaaugagaggacuguugacagagacaaaacaacccuccuucaggaacaauccugauaagauaacauaggaagugucuucuuaaaaaaguuaccugagcguggggugccagugguuucuuguugaaugacaacagguguacuuucuugauuuucuuccacagcauagauagugauguuauacugaacaccagguugcaagucacugagggugacggaguuugcaguuucaggaagguugaguucugugcugcuaccuucuacugauggcgaauagacuauucuguacccugcagauucaugagcaaaaguaagaugcacuguuuucuuugagacagaggcuuagaaacaccauaaauccucccuuuucuaauaucccuuagcaucuugcuugauuagugaagagccagugauacuuuuugacucuuugaauauugccacuucuucuaauaaugacuauucagcacgaagauaaaauaagaacagucaugcgaaccuuuuuaauaauaaaugucauccuugaagaccugacauccuuaauaaaugucaauuagagaugccauuaggugaaaauauucauguuaagcugauuuuuccucuuugagcuccagacgagggaagcaauuaaugaaccagccuaagcagaguugucuagcacugugugugucuuuuuggaacuucagugaugaggcaguugaaucaccuaaugagcuaagacgacagcucagcuuucuccuuaaggauaaaucuuagagcaacguuuucaggaaauuacaccucuucaacccugggaacacuugcuuuaauaagccaaugagcuggcuuuacagguuguguguauguugugguguguguguauaagggaguuggugaaaugguuucaaggggaaaugugccauagaaaauaacucccccacccccgccacacacacacacacacacacacacaaaccccucucccauaaauuauauuggagauuuaaagugauaugcagguccgcagucagaaucugcgcccucccugcugaugucauuaagauuaacauagcagccaaagagggggacgcuuagcugaccugugaugggagccuggggucugcuccagcgaacaacaauugaggugucaucaacuugguccacagucgugucaggaggggcaucaggcgcuaagaaagaaagaaaguggggcaaacagucaggaagugcuacuacaggccuguguuuuacagaaaaagauucuuuuaacacuauguagcacacauguaccuguuguuugugaaguagacaggaucaaacucugcuccccauccucagauaucugauagacauuuacaauguauuuucggccaggaagcaggucagggauguucacagaaguggcugugcuuggaagaucuuugaaaugaaaagaaaagguaacuaaucagagcaaacuagucccucaaaugacucuacagcuuauaagaaggauauuuuaagaauuauauauucauagggaaaagcgacuagaagguaaugugcuaauagcuaaucagugauuauuauuauuauuuuuacacagagucuugcuguguugcccaggcuggagugcaguggcacaauuucagcucacugcauccucuaccuuuccgguucaagcaauucuucugccucggccucccgaguagcugggauuacaggugcacaccaccacacccggcuauuuuuuuugcauuuuuauuagagauggagguucaccauguuggccaggcugaucucgaacuccuggccucaagugauccaccagccucagcuucccgaagugcugagauuauaggaguuagccaccgcacccaccuaaucugugauuauuaauguacuaugggaaaacaccacuucuugucuuucuccuuucuccuccuccuccuucuuccuuucauuuuuccaacuuuuuuucuaaagacguauaauuuuuguaaucgaaugccaaauuuuuaaaaauagcucucugcaguaagagucaggguagugauuauuggcggaagaugauggggugaggguagagagauauucuuuuccuugaucugggugcuggucuugugguguguucacuuuauaagaauucaaauucacugaacucagugcuuacgauggcacacacuucagugcgccaaugaaguuuuuuaaaggccccucaccauaacaauuugaaaaguaugagugaccguacugugcucacauugucagcugcaguccugguaauuacuuccaccaagaacacagcuuuugcuguaggaacuugugcacagguaggcgcaugaugcagcuggcaucagggaccaggaacaugugacaguggcuugggaaaaacccggccacuucuuagaaagagucaguccuucccuuccucaugccagagggugguuuguucagucugagcugucaaccaguuccaaaccacagauaccaccugccuagaggccacccacccccacaaggagaguuuuccagcagcugcccugaaccugucuugagcgacauauugagcuuacccagguacuguggcucaucucccuccucacucagcucauauuccacccggaaucccgacacggugucggaagcugagacccaggagaccacaaagcuacuggcugugauuucggucacagauucagaaguggccacaagaggagaaaagggagucgucucuccugucacgguguugccuagagagucacagaaaggggaaagucagccuucagucaucuagaaaauuuaccguccucgucgccaacaucauuuuaaaaaacguuggugccccuccuggaagaauaugaauugagaaggaaagcauugccucaggagagccuagcucuaggaaccucggggguaggaggcaugagggugguuguguacauacuggucacaggugugcuggugcuggugguggugaagucaaagcgagucacuucuugguggccguacugcuggaugcugaugagcuggcccucguauaccacaccaggcuucaggccuuugaugguguaggaguuuaaguggccugguaugguagcuuccuuccaacggccuacagaauuuuucugaaaauuuaaauuaacacacacacacacacacacacguguuuacaaggaugaacauuugaagaugauguucaguaaucuucaaagaaaaaugacuuaagcaggacuuaggcagcuccauucuagaggaaaaucauggaaaacuggauucccaaugguuauaucguuagauauaguuagauauaaugcuaacuauuguuaacaucaacaaacugcugcaguuuacuuacugauacccauacucugugcuguuuaccuacauucucccauuuagucuccauauccuucugaugauaaggcaauggcauuguugcucccguuuuacagacggaaaaacagagugauaugugauaugcccggggugacauaguugcagacacugggcaccuucacuuuuuuuuuuuuuuuuugagacagaguuuugcucuuguugcccaggcuagagugcaguggcucaaucucagcucacugcaaacuccaccucccagguuuaagcgcuucuccugccucagccucccgaguagcugggauuagaggcgugugccaccaugccuggcuaauuuuauauuuuuaguagagaugggguuucuccauguuggucaggcuggucucgaacucccgaccucaggugauccacccgccucggacucccaaagugcugggauuacaagcgugagccaccacgcccacccacaccuucacuuuuaccaaguuaauuguguuauaucaguaacauaauaugaugaaccuaagcuuugccucucucacuuauuuuuuauuccuaccacaaacagauauauuccucucugaaguacagaaaugccaaugccauauauuuuaucuuuuaacucagugggauacaauucaaguuucuuguccugaaaaaacaaaggcagaauguugcuuugugacucaucauauaccagguucaacgagucugguuuugugacucauucuuggauaugagcuaccccaucagaagugguuacccaauuuuggacaagacuacagaaaaaaugcaauuuugguuuauuuaaucuuuugcuuccaguuuauauuucacauccuguucagcuucauuaauaugccaugggucacaaaacucagugcaauaaaauguguaugaaagaaacacccuucagaaaagaugagacucuuucaaguguaaauacucuaaacuaauauaagucaaaauauauuuuuugugcccagugauuuuuaaaaauuacccagucaaccauuuccucaauaauucaaauacucaaguguccauuuauauuuuuggaauaagcgagagugaucguaguacucuucacagugaaauuuuaacucaaauacacuguggaaaauuuugaaaccagucauugcaauuagcucaaauuuaguaaucauuuuucaacaugagcuuguuugguuaguuauuacaagaaaauaacagaaaauaaagucucagguggcauccauuagaaaaaacccugaauuuuuguaauuguuaaaaaucucaaaaaauucaucacugcugcuuuuugaagacuuuccaauucaauguacuuuuuuuuuuuuuuuuuugagauggaguuucgcucuuguugcccaggcuggagugcaguggcgugauccuggcucacugcaaccuccgccuucugguuucaagcgauucuccugccucagcuucccgaguagcugggauuacagguaugcgccaccaugcccagcuaauuuuuuuguauuuuuaauagagacgggguuucaccauguuggccaggaugcucucgaucucuugaccucgugauccgcccaccuuggccucccaaagugcugggauuacaggcgugagccacugcgccuggcccaaaguacauuuuauaccacuuuuaagucucccauugcaauggucucacauaauacuuuggauauccuuaauuuuaaaguaaauaaaauuaaugauguaauaagaagaugagagacuagaagauauuggaugcacugaugcuguugauuucgaucacuggacaucaaguucugcaaauggccagauuauggacauagggugaaagaagaaaaagaaugacuuuucuuuuuuuuuuuuucauucaccauuuguuaagcagugugccaggugcugaagcauucuagacucuacggagacuacauugagccaaugagaaagacacgauuccccucuuuaagggaaucuguuuccauuuucuauuauucuggucuugccuccauguagacaacaugcuuacaccucuauuuguuucauuugucaacaauaagucauauuuacagagucuuuaauaugagacuugaugauuuauuuauauauuuauuuauguugacacagggucuuucucugucucccaggcuggagugcaguagugccaucuuggcucacugcaacuuccgccucucaagcucaagcgauccuuccgccucagccucccaaguagcugggacuacaggugcaugcuaccaugcccggcuaauuuuuagccacugugcccagacaaaguugaggauuuagcucaauaauaccacccuuuccuuccagaaucuuggacauucccagugucugacauuuguaucauuauauuuguucuucuuguguuuauauuuguaauuuaaaguauuauauuaaguaucuuuuuuuuuuuuuuuuuuuuuuacuucaucagcuuuugguaccaucucucaauucucuauuuugaaagauaaagcuguuaucuccucucuucuccaccuuccauauccaccauuuuucauguaaauguuuacuuuuuauuuugucuugaaguugcaaccaaguuuccaugacacaucuauagaccgaucgcaucaugcauuagaaauacauucuuuucaaugagucuaacaucaugacugcuggguggaucaaaguuuccagaaucaagguucaauggaauuauuccucuuuguuuuuauaccuuaauauugcugcauuuuaguuugcuucguauaggaauuauugccuuauaauacacuuggggguuuuuugaaacagaaucucgcucuguugcccaggcuagggugcaauggcgcgaucuuggcucaacucccugcaaccuuugccuccuggguucaagugauucuccuaccucagcuccugaggagcugggacuacaggcgugcgcccccaagccuggcuaauuuuuguauuuuuaguagagacgggguuucgccauguuggccaagcuggucucgaacuccugaccucagguaaucugcccggcuuggccucccaaagugcugggauuacaggugugagccacucuacccagccacauuuggguuuauuauacauuccuccaccugauugucauguuguuauuuuaacugcauuauuugccccugugauuaauuauccacaagccuacuuuuuccaugaagucccuuuuuauucuuggagaccucaaucccugaucccucaaucccauccucaucuuucuguuccaucuguauuggcuguccucuaagccagcuacgcaguuguugcauugcaaaguuuuccaccucuaucaggggucugauuuggaagcacuguuugcuggaccccacaacuuccuucauauuucacucuuguuuuucuggaguguaucuacaaauacccuuaaagaaaaggauauauggaagauaaacugccuaaaaucugucugaaaauauuauuuugcccucauauuugauugauaaccuggcugaguauagaagacuuuaaaaguuucuuuuuauccuuggaacucugacacaucaaagaugcgucuagacgugguucuuuccacuaauuuucugggcaccuaggaggcccuuuuaaaucugaaaaauucugucccuccacuuuagaaauuuagaaaaagaauaauuuuaacagcuuaaauuuuuccugaagaguuuaaauuuaaccgccuggguuggucaaauuuuguuuguuuguuucuuuguaauuguagaauucaauagcuaugauuuaaaauggacauuuuuuucuccuguguuuaaaacaguguuucucaaauuaugagccaugaacuuuggaguuaaacagggcaggcuugagagaguaagagaaacuaaagcuaaauugaccaauauccuccuuauuugguuucuucaauuucuagucacuucucauuaggaaaucacagggcuauuguuuaaauaaaaccaacuuccauccuuuaucuaaacuucccucccaucaucucuuuuccuucuaucuaaauaaauucagugggucaaaaguaaaguuuuaaaaaugaucacuuaaaaagugaaucaaaaaagaaauauauuaauuuggcuuuuuuuuucaaauuaugaaaaugaugccaguaauuuuccuuugaugagguugcaagacauauaaaaaccuuagauucucuucccacauugggcaagaacaaucuuaagcauuaucauuucuaaguccuugcaaaaaagauuucuguaacauaaagagcuaaauucuuccaaauaccagcccccccaccgcaaaaaaacaaaacccaaaaccaaaaccaaaauccccucagucuacaagucaauuuaauugaccacauauuguuuguucacuaaacaaauauaguaaaugcuauaggaauaguuaaucagaguuguuggcucaaaagcugggaaaaaaagaaaccaucagaauugauaagauuaggagacucaguauccaagguuucugggugggauacucacaggucuccaccugagaauguacuuggaaaugugagauggcuguggugcauuccacuggauggggugggaguugggcugacucggagucucagugauaaauacuucgacaggaccacuugagccugaaaaugaaaauguagcauuuaauuaucuugaauauucacucacuucaacuuaaaacuguguacauggacagucaucauuauaaacagcuuugcuugucguuaaaugugaguauaauaaaauuaucuggcauuaaucuuuuaaauauuuacguugaaaaucaaugcagcaaauccauuuuuagccgauaauuauuauucuucacaugagaaaugcaaaucauaguuguuuauagcaaauaaaauauauuuuuaaaaaaaagucucuuggcuugcuuuuauuuucucuacuaucaaaguaagaauugugagaaaauugugaaacgauccuacaaaaauaauguaauacagaacacagacuucauuuacuuauuguauugagccucuuuuaaagcaaauucuaauuuuggaagguuuucaucaagaaugaaucuacuaccuaagaaggaaacaacauuccaaaggccauaugagaugauguaaaacaaacacauuucuaaauggggguagaaucuuagacaaauagcaaagguaauaauuaaagaccuaguuuuauuucucaucagucuaagcagucuaucaguuuggaaaaaacaucaaguuuuauuuuuauucaagaaguuuacucccaaaucacaccauugauccaucaaauuauuaagugauuaaauuuauuuuuuuuccaaaaucaguugucaacagaaaugacuuuaugaaguguauacuaaauucaguauuucuacaccuugauguauaucacuguuaucaacaaaauuuaaaguaugguuuugguucuuuuguuuaaaauaaaaggaaaauaagggaaguagcaucaauuucuaaguaguguuaacuccauuuaagauaauaaugaaauagcuagaaaauuuaugcuugcagaacagaaaacuaucuuuucuuaaaacacuaucuuuaugaugucagucaauguuuaaauuacuagaaauaaaaauugugucuuauaguaaccuuuucaagaauuucuaacugacacucugucaaacagagcaaaauuuuguauguguaauaaagcacuucaccagauuauuaacagauuuaaguuuucugaaagcuucuaggaaaaaaaauacauugauuuucaaacuuuauuaucuaagccauuaaauucucuuggaaaacaaagcuuucuguagcagaaaaaauauauaacuuggauauccauguagauucagaaauucuaaaacaauaugcucacuuccacaccaguaacaauucaaaguugguugaagauuagcaaauacuuugaaucuuaauuccauuuaaugcacauauuuccaagccacaugaacaccaaaauucaugcauaaaauuaugaguuuuucauuuuaaaguuguauguauuucacagaacacacaggauguuuguuuuaaucaauuggcauaagucaauuccaugccuaucuuugaauuaccccuucuguuuaugaagauccuuacaaauguaaacacauuuuuaaagacaacuauucaagaaaaauuuuggagaugugacuauuuaacguacuuccauguaaaucaggaaagcuaggaauaucauguccuuaauuauuuaugauaauuggcauagggcuauuuaaauauugauccuuuaaauaaauccuacuacaauuuccuccauaaagagacaccugauauacacuuuauuuagucuugucaaucaugauuuugaggggggacaagcuuaugauggauaaaugucuauuaaguuuugaaaagauaacauaaaugaccuuuacuguucaccucuaagccuaaucauauuucuauguccacaaggacacaaggaggaggauaaaaaugggcagggaaaggaaagaaaaaggguacagcagugguuuuuacucaagccaaaguggaguacaacuacagaggucccuuuugcuuucauaagauuucgagcacuggugugaaauuccacguuuuaaaaucuagcccuguggcauagcccaccuuuaaaggaaauggacugaacagcauggaauuuagcauguuuuuguucaggaaguaaagagacuuugugucaguuauuucuuagaucaauuaaauuccuauauucuagcuuauacuacguauaauuacucuagcuuauacuauguauccuuuaaagacagaaaaguuaaaaauuaugacaucuuuuacauuauuuagauuuaaacuuuugacaguccuuuuucgcuacugguaguugguauaacuuuuuaaauuaacuuaauuggcauauacuagcuaucgccauugugaaaucuuuacucccucucuuauucaauaugaauaaacuaacaauaaaauaguugagaugauaccaaaaaaaggagauaguacaaugucuacacuuuuaaaauuaguuucaaauaaagucuaaaugaauaauuuccaauaguaguguccuuggagaaguuaaacauuuaugauuuuuugacucaguccuuuuuuucucuauuuauuuugcugagaucugugcuuuucuaguugcuuauugacaaaccaaaugccucuuaucuuuugcuaguuugaacaacucuaccaaguucucuguaggaggaacaaacaaggcaggacucagagacaaucuguugguaaucugcuguucccuuauucucaccacacucuuaaagcccuacgugcuaggccacggagcaaaccagacauacagauaagcaccaaagagcauaucugaggucaaauuccaaucucuucccuccgaaaucaccucuaugcucagugggaucuugcuguucuccuuuuuaaagaguaggaguaaggucaacauguaauacuccaauacucaaggauuccuuccuuuccagauuuuaucuccaacauguccaccuaaaugcuuccagcaagcagcuauguggacagccuuauguugagagagacgaagaucucucucaaucauucagaaggaaaucauuuucagcaaauugcaacaccaauaacaaucauaaauauagaaaccacagagcauuuuuuuagaaguuucuaccauuuaaguaucauuugcaucauauaaacaaacaaaccauucauauacuuauaguacuuccacaaucagauuuaaauauauauuaaguuacaaaaaauuaagugauuccuacaccuaaauccuccaagaaauacaauuuaggagguuggucaaucugugcuauaagccuucaaaagugaagucaccuuccccagcacugacagugucugaggguugggaaaagcagaaucuuccaaguuccuagaaaaggugcaucuggguguuuaguauuuaggauggaacauuaaagguaaucagcuacaaucuucccauauuacagaugaggaaauggaggaaugaggcuuggcuaacacuaccuuuggccaaguuguucccauagcuuguucucugucacagugaaucuuuuaucacagaguuaaucuuaauuucugucgcaugcagauucugacacccugaaacucuuuuguuucugaauguaggccauauuuucagucaaacguuagugaagacuuuggagacuuugcaccucagcaguugcucaaauaacugaugccuuuuaauuagccuuucauguuuuauuaacauguuuuauuauaaucacucagugaauauuuaaaugcaauuuuccccccaaaugaacuaauuacaccuacagcuaggcaugaugucuuugugaccuggaaaaacccagcaauaaacauuugagaguguuugaacugugugggcagagaguugaccaaguuacucaacccuuggcccaacauacuguguuccugguggcaacugaucaaacaaaugaaaaguuugaugcaaagggagcuuagaugacauguugaaugaacacguaccuuaugcugcauuucaugccaucucucuaugcagcuucucuguuaagaaucauaauauaaagccccaaaccuuuacucccagcauaacucacuuggugguuuuuauuuccauguauggauauaagaugaaauuagccagagugucuuaaccuaacagaauauuuuacagaguuaagaaguaaaauuauaaacaggcacauuuucauagccuucucuaccuuuuacuugauagaggaagagagaaaaauuauuuuaaucaaaaauucaauugauuauuagauaauaacaagagaaaagggugggaaagaggggagacccccaacuuaggcaugagagcauuaauaaucacugcccuguuguuauaacccaauuggcaguucucaacuugcaguaauagagcuacuuacuuggauaggucuguaaagguuggcaaugccacuccccaaugccacggccauagcaguagcacugguaucugacaccaugcacauacuucucccaugaaucuccaauuugauaaaacgucccagucucugaauccuggcauuggucuaaaauacauggaaggaaaagauaaacagccuugaagacuuauaacuacgaauuuaauuucagggugcuagagcauacauuuagcuuaaauagaaauuugcaauuguucuuacaaauauaugcaguuaaaaaaauauuuuguucacauucuuuaccuuacaggacaguuuguaguaaaaaaaaaaccaaaguaccuauuaggaggaauauuuaguuuucuaaaagguaauauuucuaaauaaaaauguaaagauuuagauuucaguguauauugauaaucuacacauuaauuuuaaauauuaguuauuauuuuuacccauauuaauauaacuggcuuaacauuuaaauagcaagaaaaaaaucugcaauaauuucauuuuccuuacuucuucaaaauuuaaagaaacuguuugacauuuaaaugaaugaacuagacuuuacgaguauaccugcugagcagcuucuaagaaaaccucucaggcuucucucucaguucugguaaucucacgucaaacaaacggauguuaucaguuuguuuucucagugagcaaccugucucuuuugguaaagaaauaguaauggaucaccuuaaacuuuguagugcugguaacacagcucuuuuaaggcucagccuucacuauuugcuuaguucuauuuugaagggcggccaaaaaaaaaccuagaguguuuuggugggugauauuuacacccuuugcucaugcuguuacacagcugguaaggaagugaguuugagaccagccugacccacauggagaaaccccaucucuacuaaagauacaaaauuagcugggccugguggcgcaugccuguaaucccagcuacucaggaggcugaggcagcagaauugcuugaacccaggaagcagagguugcagugagccgagauugugccauacacuccagccugggcaacaagagcgaaacucucucucaaaaaaacaaaaacaaaaacaaaaacaaacaaaaaaaaaaggaaagaauacuuuuaauagcauggauuaucuuuaugauucuaaacccaagaauaaauuccauucaauuaaaauaagccuaaauuugucaccaaauucagcaaaaaccagacgacuaccaauaucgagauauuuugguccaguauuagagagaagacuuugcaaaguucuuugcaagcaacugaucaaagucuggagccaacuucagucaugugauuucacauagcuuuucuuaucugaaacuugcuaaccauucccccugugcaaacucaucuagggaaauagggcuacucaccgacgggaucacacuuccaccugccccgacccugaccgaagcauguacaguucagcaugugccccucuucaugacgcuuguggaaugugucguucacauuguaagugaugucaucaacaaugcacugaucuguuuaggaaacaggugggugagugagaaacuuuuuaaaguuccauugaugaaagaaaaaagguaugcuucucaaagcauacaacuacuuccacuuaauuaucaacaccuuccacuaaaauaacuuuucuacaagcauagaauaacauuuuuuucaaaguuuggucaguaauacaauuuuugccaaaaaaauuuuuuucuucccaaaauguguaacuuuugcagagguuacaguaugcucaaguaaagaaugugguaaaauacacuuuccugugagaagccaguauuugaacaaauacaugucuuacuuucugaaaauuucuugcuuaguugauaauuuccuuuaaauaucugcuuguuaggauaaauaagaagaagauuaaacauauuuaucuaacacccagcaugaugugguggucuggucucuggaauagggggaaggggaggagauacuuagauuugggaaauaaaaugucaacaguauucacaacgcuaaaauaaauuaggccaacucuguugcucacucuuugagagauccugagaaaauuacuuuuuccuuuuugggucucagcuccuugaucuauauagagugaggucucuauguguuauuaaggucucuuucaguucugcaacaccacauguaauuauuacucccggaugguguuacccacuggacaccacaaaaggagaacaaauucagaccaauaucuacgcacuagccacauagauuauuaauagcucaggguucucccgaaauauuacuuuucauaucaaagaaauggaaaacuaaaacacuuuuaaaaagucaauacuuccucauauuauauagcugggugcaaaggagaaaaacuaaucugaacaaggaaaguuaguccccuauguauuuguuuccugaaaucuggaucuguaaggaucugauuuuagaauagcaaggucuucauuucuuuacagaaauuauccuaucuuuucuagacaugaauccaguggcauagccuaaagcugaauggaucaaauguuucauucuuacuuuugaagccaucuuuuuggcucagccuaaguacuuacaugcuaggaguguuucagaacauuagcauugcuaugccgcuugucuuagcaggcugccugcuaagccuuucaggcuuaucuuaccaugcacaguagacuaaugaaugacguggcauuccauauuucuuccccugcuuuuggcauagugcaaguuuucauaaaaaaaagugucccuuucuguaccuuuugccaucucaaauauuuuuguuaaucagccagcauaccucgaagcugcgaguaggcaaugcauguccauuccccacgaccauucccaacacacgugcaccucaucaugugacccaugucaugcugcuuaucccacugaucuccaaugcgguacaugaccccuucauugguugugcagauuuccucgugggcuguuuggaaauggauaagaaaugcacuugauaaaugaucaccaggucuaaacauguaugugugcaaaaggaucaguucaguuuggucauccuaagaauucucacuugggaagaagcuuugugugcaucaaagacaucuaagugcugucaggugaagggguagaauuuuugagcccuggaggcagaaaacguaguccaaacgugucauagaaaauaguuacaggaaggguuaggggauguuaaacuaagauaauaucuacacauccacacaaaggguucuugcuguucuagaagccuggauuuaacuacagcuucauaacuuuucccaguuccaguuuauucuggaucaaauaaaaacuauggguuuggauauagaauuacaagcaaaaguggguuuuuucuucuaaacucagcaucuucuuuuguugaaagaaauaaaaguauaagcaauuucuuugucucauagucacacuugacagugccuaccgcccaggcucuuguuucuacaacuggaaaauuaaagggaaucuaugggguucuugaaaucugaaaacaaguaaaagguauucguuuccauuuguucgccaucuauacaaacuggggaccuuuaaaaaaagagugagauucccuaccuguuagaaaacauugaguuuuagucacuuuggcacuuauuaauaagugauagagcuuaugcccaucaaaccacaaccaugugucaauauuguagcucugugacuaaagccgucauacauauauuaaauguuguaagcuacucaguugugugcucuuuacaaagacaaaccugugcaaauucauauuuccagacuuacaaauaaguaauuauauuuuugacauuaaaucaugucaaugagguuuaaaaauuauauaaauaauuaucuaauuauucuucccaauccuuauguauaugauguaacaucacacacacacacacacacacacacacacacaaacacacuucacaugaaguuuucuguugucucaaaauuguguuaaugaaugaaaugggaguaaacuggacacuagucuuuagucucuacucccuaaauuguugucaaacaagacaacccacaagggcuucaucuuaccagccauggggcagaacccaaacuucuggucggcaucauaguucuguguggucccacaccacuucauguugucucuucugcccucagaagugcaaucaguguaauugugguuguuguauaggaaggggaaguggcacaaggcaccauuggaauuuccuccucgagucugaaccaaaacugccaggaacaauacacaacaaagaaggaaaagauuaccgcugagcuuuccaauguacacagaauuacuggucugagagagccagguuucugcagcucauucacagacagucuaucucagaauaaaaaaugucugauaauauaguucuaagcuucuuagcauauuuaccuucacaccuucaaaacagguuuaaaucccacuuucacugucauuuccccagcaccccccccacaaaagauuaaaugauagcuuugaauaaaacauuguuuuaacuggaaaauaagcuaaggcacuaaaacauucauccuuuguauuccucagcccugugggaucaucuacugauuccaaaauacaaguaucuuuaaucacaucauaaucccaauguguuaaaucaaaugaacuggaaggcuacucccuuggugucauuucccaacaguacuggggaagauggaagaauccucagcuguuacgugagcgcugcgaucucuugaguccaaacugaacaaaagcgaugcuucuugggcggguucaaaauaaauggcuagaaugcuggcaaauaaaacuagggcaugaaagugaguuuuucucacuucuguggcucccccuugggacacucaccaguguggucugugcagaaagaguauuucugguccugcucauaauucgaaguugugcugcaccaaagauguccguccugucgcccuucuguggugcaggaguagaacguccugccauuguaggugaaugguaagacacauggcucuccauuugaguugccaccguaagucuggguuacagcuacaaucauaaucaaaagagugucaguaaacagagaugcuuuaucucccaccagcagcugcuuauuuauggcuucaaugagauacugagcuugugcccucaaaggaagaagcuaugaguauagaugaucaucucguuaauuucagucaaaaugcauuacucaggaauccaugucuacuguggauagaacgacaccugaguucuucugcugauguccuucaugaccacuucugcugccaugccucaguuucucuauuuguaaagcuauauuuauacaggucaauuaaggaugcugcuuaaggauguugggauaauauuuaugacuauaucuaugccauaaaauuaauauaugagacuauucugggggagaauuguguagcaauuguuauugccauagugacuaccauguuuguagugcagaauacauauauuagguuauuggaagauguuuacaucacaaagcugcugaaauuugagauuuagaauauaaaacauugaugauuauucagaaaguagcucucuuguaacaacacuuuagacagauaaauacaauaaaauuuuuacccaugauauccaugaccagaaagaaaauacauaaauuaaaaagauuggaagaaacuauuucaaaugccaacccuaauuguuaucacagggugguaagauuacaggcuucuuguuuguuuuauuguuucacauugaaaauguauuguccuucaaaaacuaaauaauaaagucaucaguccuauucuucaaaaagauaaugcauaccugucucuuggcagcugacuccguugcccaggcacgugcaaagcauuugcuuauuuccuugugucuucagccacugcauccccacagaguagaccacaccacugucugugacacaguggccauagggaggaggcugggggugaggcugcgguugguaaacagcugcacgaacaucggugaaggggccagauccuaauggcaugaaaagggaaugucacaaaacugggugagagaagacaauucacuacuuucugcagucaggaucuucaggaucucacagagaucacucugaaaucuaugucgcuacuggccugggacuggaaaaaaaugucccuuauucagcaguagcuuuugcauuuagccuaggaaauaauccacaagugucuaccaaguggucuccauccuccagcucagcuggggcuacugggauuauauuucuuuuuguuuguuuguuuuuugguuuuuuggguuguuuuugagauggggucucacucuguugcccaggcuggagugcaguggcgcggucucggcucacugcaaccucugccuccuggguucaagcuauucuccugccucaaccucccaaguagcugcaauuacaggcacgcaccaccaugcccagcugauuuuuuuuguauuuuuuaguagagacgggguuuugccauguuggcaaacuccugaccucaaacuccugucucaaacuccugaccucaggggauccacccgcuucggccucccaaagugcugggauuacaggcaugagccaccucgccuggccgggauuauauuucucaaucacagacaucauccugccacuccauacagcagauaccuucaacacauccucacucuucugaguaaccgagcucaucagagggugccuucagcagcuguccuggauuuucuggaggucaccuccaccuuccacauuuuauuucuccucuggauuauuugugauucuauuguguuuuuucuaaaaccaauugauccucuuaagacagcuuuccuuucagaauaacacaacaggauguguugaucuuuucuuuuuucuuuuuuuuuuuuuuuuuuuuuuugagacggagucucacucugucacccaggcuggagugcaguggcgcaaucucggcucacugcaagcucugccucccggguucacgccauucuccugccucagccucccgaguagcugggacuacaggcacccgccaccacgcccggcuaauuuuuuguauuuuuaguagagacgggguuucaccguguuagccaggauggucucgaucuccugaccuugugauccacccgccuuggccucccaaagugcugggauuacaggcgugagccaccgcgcccggccgaucuuuucuuucaacuuuuagauaucuguucucuugaaggccagggcccaccgcagaacagaaucagggcugaggcuagaccaaagguacacugaauucagugccucccuaagugcugcugaacacuagaacccaaagauguucacagacaaagaaucccaaggucaaacguacuagggagacauggcgcccauccccuacacucuaccauggagaguaugauguaaaggaacacacagauucugcagagcagguuccauuuuguuuaacccauugcuucucaaacuuuuuugaacaauggaaucuuuucaguauuggcaauauucauauauagcuaacauuuauugaguguuuauccccauuuaauucccaccuacacuuuuaaucuauuuugguagacugacauuuauaauuuuuuuuauuuuuuauuuuauuuuauuuuuuugagauggggucucgcuguaucacccaggcuggagugcaguggugcgaucucgggucacugcaaacuccaccucccggguucaugccauucuccugccucagccucccgaguagcugggacuacaggcgcccgccacaacgccugguuaauuuuuuguauuuuuaguagagaugggguuucaccguguuagccaggauggucuugaucuccugaccucgugauccgccugccucggccucccaaagugcugggauuacaggcgugagccaccgcgcguggccgauguuuauaauuuuuuuuggccaguagcaauuuuauuaaugauaauaaaauaacucaaagauauuaucaaaucuaaucuuguucaccuucauaagugcucaaagcaagacaaaaacucaucaaaagaagaaaaauuagaacaauuaauauuuuuaauugaaggauggcugagacacuacguaaugauguuggcacaucauauaguaaaaaguuaaucaaaacauauuaaaaauaaugagaggagugcacguccuuguuggccauauuucucucuucagauuuuuaugaaacauuuaugacguaaaaaucuuuuucucaugccaaaaaugauuaaaacuuguuuuuuaaaaagaaugcuuagauaucaugucuuucauggccaucucuaaguccucucugaauuucuaaaauuucgaaugccaauacaugaaggaaauaauuguguguuacuuuauagaauguaacaaaguuugccagagcauagaaaccacauauaaaggaugguuuccacuacaaaaagaguucaaugucgggacagggaaguauauuucauucaaaaacaaacaaacaaaaaauccaaaugcacuuuuuuuguccuuuccuagcagaagaaccagguagucauauaauuaauuauaacucucauuuccuuucaaaugaacuuuggauauucaaaauacgugugugugugcgugugugcgugaucuauccaugguaaguuuuaugaugcuagcauucuuuaaaacucaguuuuaucuuuuggagauaaaucuggcuuuuuucccccuaagguuuauuuguaugucauuuuucuuuuuuucugaaaaauuuaaaacuugacauuaaaaaaaguuuuaacaaccaauaauguguaaauuaucuuagguuauuagcugaaacacugcaaauuauccucaaauggcaugucaaaggaaagauggauuugcggaaauauuucuugaccugcuuccccauuucccgccccugcucguccugugccucaccgcucgauguggucugcacagaggugugccucucacacuuccacucuccucggccguugccugugcagaugcacuggagcagguuuccucgauuauccuucuugcuccaggugucuccaauucuauaggauguccuuguguccugaucguugcaucuaucugugucacaaaggaagcacauacauacaucaggucgagagucgcaaguggucaauucaaacuuaaaaaaggaaugcuaucuaugccugguaaucuauuuuugguaauauguucauauucagcucuggugcugcaagguauuacacuucugaaagaugaaauuacauuuguuacaguggaaaggcagcugaaugguuuagucuaguuucaucucucugucaaauaacauuuucauuuaucuauuuauuuauuguuuucacacuguuccuuugacuaacuucauucucuggcauuauauuucaucuuuuuccuucucaggcucuuccaggauuuuucuuagucaucacuguuuauggccugccuuucaauagggaccuugcuuuagaaaacuaaaaacaggcuaagcgcgguggcucacgccuguaauccuaguacuuuaggaggguggaucaccugcagucaggaguucaagaccagccugggcaacauggugaaacccccgucucuacuaaaaauaccaaaaaaaauuagccggcugugguggcgggcgccuguaauccaagcuacucgggaagcugaggcaagagaaucgcuugaacccgggagguggagguugcaaugagcugagaucacaccauugcacuccagccugggcgacagggugagacugucucaaaaacaaaacaaaacaaaacaaaacaaaaaaaacaagcaaacaaaaaaaagcuuauaacaauggggaggcaagcagguaucaaagggucuucaccaauggcuacaaagaagcuauaagaaggugguaguaucucuuucuucauuuguuauguaaaaaauguagaggaugcacaauuucuuugacuaaaauauuauuuucccuuccccuauacccaaacaucuacaguauuuaaaaaucacuagcaaaauagccccaaauuauucaguguuagcccuccacuggaagagugggaucaacauaaaaugauaauuuguaacuaaaugaccauuagucuaugcgugcauuuaucugguaaauagauuauuuaaauuauaauccaaauuugcucugugccacgaugugaguauagaggaucugaugucuuugugaauuggauauuguugcaacuccuggguuagagaaaaaaaauuaauaguugauguagguucaaacaaauacacacccacauccaucuaccacaagaauagaaguuugcaugaagguauaauuacugauuagagcuuuuucccaaauccccagcgaaaaguauuaucauccccugaaccuccauagcacuacuuucaguauuucuguugaaaucuuuaauacuguguuuugcagaugauaaauauguauaagacuuucucaucucccugacccccuaaguacucuuugaaggcugggcuaauguucauuucauaucugcaccccuauaauaccuugaacaaaguaaguccuuauaaaauuuucuggaauaaaugacuucucuuugagaaacuuuucccaacuugcuauuuaaagaguucuaaauaacagauaagguuugaaucagacaucuaauuugucuuaagcuaaaauauugccacaaagaucuuggaagucugaugaucacaguaacauuuuaaaugcaaaauaucuaauaaaccagcaaguuucugggaaagcuuuggucaaaaugguuaccacuuuucaugagagaccuauuuuuguuagcaaagaauuugaauuuggaugauggcuauguuaaagguaguuaaauggguucagcuagauaaauaaaacagguucaaauuauuuggauuugauuuuaaacuuauuuacaacaccaguaguuaauggcuguuuuacuucaacaaacucucuagcuguuauuaguuuacaauaucaaaaaaggagccuucaaacccaaaggcaacaauuaagaccccaagacaaucuuagaaggagcaguaaagacaccagaggccagcuucuuuacagcacuaaucaaaugcguuaggucagagacacuaucccuaacuccagaguagauaaaucauuuuaauuuaugggauaaauucuuuuuaauuuuaucaauuuagccugugaaugugcccuauuuaaauuucaaacauagaaggaaaccuaaaccuuuuguucaacucuaugucaguggcagugagcugagauugaaccuuaucaaagugauauguuuuucuauuuauguagucuucucugaagaugcggaauaaguugguuaugaaaguuuucuugacuuccagaaguuaccaaagcaugcugauauacuggauguguucugaguaacauaguauuacccuucucucuaggaauccagaaaacaauaccuggcuuaaucuuuaacauaaagauguaaaacauacuucuagaagugcaagugaugcguccgcugccuucucccaggcaaguacaaucuaccaucauccagccuugguagggcuucucccacguuucuccgaccacauaggaagucccagcagcaugaucaaaacacuucucagcuguagggaaauuuggaagaaaaacaggaaaaaaagguuauuuugaauugugcaagcucccuguaauuuaaaguguaguguguaagcaaaaauucagccacauuuuuuuuaaguggcacucuguucagaaagaaugacacacccagcaucuaagcacacaguaaguagccaaggcaaaagaaagcucaagcugaguuggcaggcagaaauuccauucuccuaauaaguacauggacuacauauuuucagcgagccccaaacuucccagcagcauuuccaguagcaaggaucuauguauguaucuagucugugggagacuacauaugcaaaauuccaaucuuaauuauaaaugaccaauuaugaauuuugaguggccuaaauacaaugacaaagaaagcuauuuuuaaauauuggaaagcaaaacaauacaaaacaagacaaaaaccucuaaauuagaagacaaguaaacagaguaaaauuuauagccagaaacuuucaggcuuguacuuacaaaauucaacugaggauugagauccaaagaagcucaacaacuuuuaauuugaaaagaaaugagcagagugugacaagcacacacuauuucauguuucgguccaggacauuccauauagaaauguguccaaagugucauuuuuuuuucuuuuaaauaaauuauaucuugacgaaggaggaaucugagaucagcuauuagguaaaagaaaugacuccauucuaaaucuuucaauucuaccuuaugcuuuugaagcaaaguuaagacuucuauguguagucaguacuuuuugaucuaacuccuguaagaagacuauggauuauauaauaauucauuauuucaaacaaaauucccauuucuuuauugguuuucacuggaauucaggucuaugaccuauguagaugugauucugguccaaccccacauuagaacuaagcaucccagcucuugcucagcccuaagacucacacaccuaugggcuugcagguccauucuccuuuuccauuaccaagacacacacacucuaacauguaaccaccagucucauguggucuccuccaggugucaccaaucuuguaggacugacccccuucauggcagcggucuguugaagauacaacgaaaauguuaggagagggcagaacagauuuuuuuuuuuggucucauauuccacccaugguagguacuuagguuggcuaaaguagagacacagacaacagcuuucccaucagagacaggggaaacguuaacaggucuggucacuuggagucaauucaguuaagugucuugcuuagaacacaauggaaaaccacagagaaaucuggauggcaaggaagaggucaugaauccugcuuucccagagagaucacaggaaauuggguccuaagcagaaaagaaaggcugggaggcuuggucuucacucauacacagcaggcuaagacugagacuaauucagugaaaaggccacaucaggcacagcacuccagcuuuugggagcauggagagccuguauuuuacccuaggauagaaaugucauuuugguggaaagcaaacagacauaugcauauaaaguguggaaauccugguaguuuucuaaguuguuaagcccaauggcacauucaaaugcugaacuagauuguaaacacuauggacccuugccucuugcgauuugccugugaacuuggauaaacccuaacaugaaauauggggaaaguugauugggccuauucacacgggacuuguucuuuugaauagaagucuuuaagacgacuuauauuuaaagaauggauuaaaaaacuuaaauacuaucuuaauagaaucuauugguaacccagugaaucauacuggaaagagugccuuagcuaaacuagaguugagaaucagcccgguucccaaaguuccuuagcaaacucuauuggguuaauaauuuuguauuaucccuaggaauagugacaucugcuuccuggguauaaccuacuggucaccaagaaaccagacuguuucugugaggugcaagaggucucugcauugcaaacaugaagaccagacaacacauggcugguucacucuucaugaacaccuucccagucacugcagaaaagucucaugauuugucuagcuugaagauauccaggugauuuaaaaugggcaacuccccuaagcaugucuuacugaaauggaacccaagaggucucuugguucuacuauguacagaaacacacacacucauaaaugcacacacacucauaaacgcacacacaucaaacacugauuccaucugugcucauacccgucuuuaagaaacacaggaaccaguugggugaccacuuaagaguaccuggucaccaggggcaaaccucaaaguucggaauauccagucauggauaacagaaaaugacagugaugguaacagagaaauucauauuugauauuuuggcaucauuuuacacaaucucuuccuuacuugcgaugguacagcuuauucucccucgcccagccccgaugcagguacagucccagaucauggagucuuuaggacgcucauaagugucacccacucgguaaguguucccaguguacuugucaaagcaagucucuucagcugaggggaaaaggaaaguccaugugagccucacuuagguacaagcuuuucuaguucacuaauccccucuaaaggaaaacccacuucucuauuccacaaguaacaugguacaccucaaagaauaaaaugaagugagagauacagauuuuuauccuaagcucuaauaaggccaugguuuuugaccuugacauauugucaaauuuucuguaaauuauucauauuguagaaaaaucucaggcucuuaggaaaaggccauauaaaguacuaacuuaugacagagcuagauuugugaaggguuucacauuccaaucucugacucagaaagucaaagcaagguucacauaaaaagcaaacgauuggccgggcacaguggcucacgccuguaaucccagcacuuugggaggcugaggcggguggaucaccugaggucaggaauucgagaccacccugaccaauacggugaaaccccgucucuacuaaaaauaugaaaauuagcugggugugguggcaugugccuguagucccagcuacucaggaggcugaggcaggagaauugcuugaacccuggaggcagagguugcagugagcugagauagugcuacugcacuccagccuggugacagagcaagacucugucucaaaaacaaaacaaaacaaaaacaaacaaacaauucgaagauccccaccucccacaaggccuugacaguuguuaauccuaugauuuccauuuuccccugaucagugcuucucugacagaguugcuauaauuuaugagaaaaauaucauugguccuaaaggaaugagaacuuugaaguggcuaaugguuuuguguuaacugccgcugacaaaucauuuuacgauguaaguccccaaaguguuuucuggcucauaaacuaacaguuuaagauuugagacugcuuucuaauaaauuaaaauuuuauaagcaauuuuuuuugucggaggacacacaaaaucuuucauuuuucucaucaaaaacuuugggagaguaaagcaaaaagaagacucuaggaacuaauuugggaaagauucguuucuuuguuuuaaagguaaaagcaugugaaaagcaaauauaagcaguuuuuaaacuuaagaggaaaugacagguaauucuauuagaaaaaugguguauguauuuuuacuuacuaaugcaaaguuuaacaauuaccacuucauguauuaaaagauacuaacuauggggcuuguugucacuuaccuucagguuuacucucgcaguuaaaaccucggcuuccuccauaacaaguacaaaccaacgcauugccuagguagguccgcucccacuguugauuuaucugauaguguuuuccauugucauaacaaccggcugcaaauaauugaaggaaaacguuacauuugcauuucuccuuuucccaaaauuauggaauuuucuucaugugaauauugacguacauauuuuuuuccuuuuaacuuugcuaaaaguuauauacaaugaugucauuuccaucuggccaggggucuacauaaaaaaguuggaaacauuuuggaaggcagacaauugaagucacauuuuuaaaacaugcaaggaacuuaaauauucuuuuggaguaauagucaaaaaggacaacuuuaagcagcuuucucaaagcaaaaggagggugugucuuugaaaaacggaaagaauuccaaccucuguucuuggugaaguauccugagcggcccuaaagaggucugaaccaauuacaucucuuccaaguuaguuagaaacaagacagcuauuucaauacccccuuuccacccccauguugaaaauauuugaccaauuauuuaacagaaggaaauaaguagcaguaaggaccacacuaaucccagacggaaaauuuauagacaugcaucauuuuucucuuuaaaggcaaguuuugguuaauuccuagaaggacaaucugaacgugcagaauuuauuagaacacgggaaagucgcagaguccucguccuccaaugcacggucuuaucaucccaggcccucagaaccagcgugcucaaaacucgguccuuuugugugcacagcugguuucucucaguaaagcgcgcacacacucgcacacacgcgcgcgcacaaaacuucagccccaacuuuggucggcuuuagggucccaucccugaggcagccuguuucagcccgcggucaguacucacgcuugcuuugacugacagccaccggggacuggggcugaaccauuugcugagccugccucuugcucuucgaggcucccguggagggcaccgcuguccccaggcacuggacggccagcagcagcagcccgggccccggaccccuaagcauguugagacggugggggagagacgcccgcaccgggaggcaaguugccaccaaguuugcuucccuucgcaaccugcgggaaaaaucccuucuaaugccucccggggguugucgccuccaagaaggugggggccagaggguggggaaggggacggguggagggacagaagggaugcagaggaccagagaaguuguggcugcagguccccucuucccgcucgcgccugggguucccucuccucccccugugcagcacagccggcgcgggcguccgagcgccgggagccggggcuuauaugggacgguccccucccgccccucuggaggcccgg

SEQ ID NO: 12737 - RNA, 75311 nt, Homo sapiens
ccgggccuccagaggggcgggaggggaccgucccauauaagccccggcucccggcgcucggacgcccgcgccggcugugcugcacagggggaggagagggaaccccaggcgcgagcgggaagaggggaccugcagccacaacuucucugguccucugcaucccuucugucccuccacccguccccuuccccacccucuggcccccaccuucuuggaggcgacaacccccgggaggcauuagaagggauuuuucccgcagguugcgaagggaagcaaacuugguggcaacuugccucccggugcgggcgucucucccccaccgucucaacaugcuuagggguccggggcccgggcugcugcugcuggccguccagugccuggggacagcggugcccuccacgggagccucgaagagcaagaggcaggcucagcaaaugguucagccccaguccccgguggcugucagucaaagcaagcgugaguacugaccgcgggcugaaacaggcugccucagggaugggacccuaaagccgaccaaaguuggggcugaaguuuugugcgcgcgcgugugugcgagugugugcgcgcuuuacugagagaaaccagcugugcacacaaaaggaccgaguuuugagcacgcugguucugagggccugggaugauaagaccgugcauuggaggacgaggacucugcgacuuucccguguucuaauaaauucugcacguucagauuguccuucuaggaauuaaccaaaacuugccuuuaaagagaaaaaugaugcaugucuauaaauuuuccgucugggauuagugugguccuuacugcuacuuauuuccuucuguuaaauaauuggucaaauauuuucaacauggggguggaaaggggguauugaaauagcugucuuguuucuaacuaacuuggaagagauguaauugguucagaccucuuuagggccgcucaggauacuucaccaagaacagagguuggaauucuuuccguuuuucaaagacacacccuccuuuugcuuugagaaagcugcuuaaaguuguccuuuuugacuauuacuccaaaagaauauuuaaguuccuugcauguuuuaaaaaugugacuucaauugucugccuuccaaaauguuuccaacuuuuuuauguagaccccuggccagauggaaaugacaucauuguauauaacuuuuagcaaaguuaaaaggaaaaaaauauguacgucaauauucacaugaagaaaauuccauaauuuugggaaaaggagaaaugcaaauguaacguuuuccuucaauuauuugcagccgguuguuaugacaauggaaaacacuaucagauaaaucaacagugggagcggaccuaccuaggcaaugcguugguuuguacuuguuauggaggaagccgagguuuuaacugcgagaguaaaccugaagguaagugacaacaagccccauaguuaguaucuuuuaauacaugaagugguaauuguuaaacuuugcauuaguaaguaaaaauacauacaccauuuuucuaauagaauuaccugucauuuccucuuaaguuuaaaaacugcuuauauuugcuuuucacaugcuuuuaccuuuaaaacaaagaaacgaaucuuucccaaauuaguuccuagagucuucuuuuugcuuuacucucccaaaguuuuugaugagaaaaaugaaagauuuuguguguccuccgacaaaaaaaauugcuuauaaaauuuuaauuuauuagaaagcagucucaaaucuuaaacuguuaguuuaugagccagaaaacacuuuggggacuuacaucguaaaaugauuugucagcggcaguuaacacaaaaccauuagccacuucaaaguucucauuccuuuaggaccaaugauauuuuucucauaaauuauagcaacucugucagagaagcacugaucaggggaaaauggaaaucauaggauuaacaacugucaaggccuugugggagguggggaucuucgaauuguuuguuuguuuuuguuuuguuuuguuuuugagacagagucuugcucugucaccaggcuggagugcaguagcacuaucucagcucacugcaaccucugccuccaggguucaagcaauucuccugccucagccuccugaguagcugggacuacaggcacaugccaccacacccagcuaauuuucauauuuuuaguagagacgggguuucaccguauuggucaggguggucucgaauuccugaccucaggugauccacccgccucagccucccaaagugcugggauuacaggcgugagccacugugcccggccaaucguuugcuuuuuaugugaaccuugcuuugacuuucugagucagagauuggaaugugaaacccuucacaaaucuagcucugucauaaguuaguacuuuauauggccuuuuccuaagagccugagauuuuucuacaauaugaauaauuuacagaaaauuugacaauaugucaaggucaaaaaccauggccuuauuagagcuuaggauaaaaaucuguaucucucacuucauuuuauucuuugagguguaccauguuacuuguggaauagagaaguggguuuuccuuuagaggggauuagugaacuagaaaagcuuguaccuaagugaggcucacauggacuuuccuuuuccccucagcugaagagacuugcuuugacaaguacacugggaacacuuaccgagugggugacacuuaugagcguccuaaagacuccaugaucugggacuguaccugcaucggggcugggcgagggagaauaagcuguaccaucgcaaguaaggaagagauuguguaaaaugaugccaaaauaucaaauaugaauuucucuguuaccaucacugucauuuucuguuauccaugacuggauauuccgaacuuugagguuugccccuggugaccagguacucuuaaguggucacccaacugguuccuguguuucuuaaagacggguaugagcacagauggaaucaguguuugaugugugugcguuuaugagugugugugcauuuaugaguguguguguuucuguacauaguagaaccaagagaccucuuggguuccauuucaguaagacaugcuuaggggaguugcccauuuuaaaucaccuggauaucuucaagcuagacaaaucaugagacuuuucugcagugacugggaagguguucaugaagagugaaccagccauguguugucuggucuucauguuugcaaugcagagaccucuugcaccucacagaaacagucugguuucuuggugaccaguagguuauacccaggaagcagaugucacuauuccuagggauaauacaaaauuauuaacccaauagaguuugcuaaggaacuuugggaaccgggcugauucucaacucuaguuuagcuaaggcacucuuuccaguaugauucacuggguuaccaauagauucuauuaagauaguauuuaaguuuuuuaauccauucuuuaaauauaagucgucuuaaagacuucuauucaaaagaacaagucccgugugaauaggcccaaucaacuuuccccauauuucauguuaggguuuauccaaguucacaggcaaaucgcaagaggcaaggguccauaguguuuacaaucuaguucagcauuugaaugugccauugggcuuaacaacuuagaaaacuaccaggauuuccacacuuuauaugcauaugucuguuugcuuuccaccaaaaugacauuucuauccuaggguaaaauacaggcucuccaugcucccaaaagcuggagugcugugccugauguggccuuuucacugaauuagucucagucuuagccugcuguguaugagugaagaccaagccucccagccuuucuuuucugcuuaggacccaauuuccugugaucucucugggaaagcaggauucaugaccucuuccuugccauccagauuucucugugguuuuccauuguguucuaagcaagacacuuaacugaauugacuccaagugaccagaccuguuaacguuuccccugucucugaugggaaagcuguugucugugucucuacuuuagccaaccuaaguaccuaccauggguggaauaugagaccaaaaaaaaaaaucuguucugcccucuccuaacauuuucguuguaucuucaacagaccgcugccaugaagggggucaguccuacaagauuggugacaccuggaggagaccacaugagacuggugguuacauguuagagugugugugucuugguaauggaaaaggagaauggaccugcaagcccauaggugugugagucuuagggcugagcaagagcugggaugcuuaguucuaaugugggguuggaccagaaucacaucuacauaggucauagaccugaauuccagugaaaaccaauaaagaaaugggaauuuuguuugaaauaaugaauuauuauauaauccauagucuucuuacaggaguuagaucaaaaaguacugacuacacauagaagucuuaacuuugcuucaaaagcauaagguagaauugaaagauuuagaauggagucauuucuuuuaccuaauagcugaucucagauuccuccuucgucaagauauaauuuauuuaaaagaaaaaaaaaugacacuuuggacacauuucuauauggaauguccuggaccgaaacaugaaauagugugugcuugucacacucugcucauuucuuuucaaauuaaaaguuguugagcuucuuuggaucucaauccucaguugaauuuuguaaguacaagccugaaaguuucuggcuauaaauuuuacucuguuuacuugucuucuaauuuagagguuuuugucuuguuuuguauuguuuugcuuuccaauauuuaaaaauagcuuucuuugucauuguauuuaggccacucaaaauucauaauuggucauuuauaauuaagauuggaauuuugcauauguagucucccacagacuagauacauacauagauccuugcuacuggaaaugcugcugggaaguuuggggcucgcugaaaauauguaguccauguacuuauuaggagaauggaauuucugccugccaacucagcuugagcuuucuuuugccuuggcuacuuacugugugcuuagaugcugggugugucauucuuucugaacagagugccacuuaaaaaaaauguggcugaauuuuugcuuacacacuacacuuuaaauuacagggagcuugcacaauucaaaauaaccuuuuuuuccuguuuuucuuccaaauuucccuacagcugagaaguguuuugaucaugcugcugggacuuccuauguggucggagaaacgugggagaagcccuaccaaggcuggaugaugguagauuguacuugccugggagaaggcagcggacgcaucacuugcacuucuagaaguauguuuuacaucuuuauguuaaagauuaagccagguauuguuuucuggauuccuagagagaaggguaauacuauguuacucagaacacauccaguauaucagcaugcuuugguaacuucuggaagucaagaaaacuuucauaaccaacuuauuccgcaucuucagagaagacuacauaaauagaaaaacauaucacuuugauaagguucaaucucagcucacugccacugacauagaguugaacaaaagguuuagguuuccuucuauguuugaaauuuaaauagggcacauucacaggcuaaauugauaaaauuaaaaagaauuuaucccauaaauuaaaaugauuuaucuacucuggaguuagggauagugucucugaccuaacgcauuugauuagugcuguaaagaagcuggccucuggugucuuuacugcuccuucuaagauugucuuggggucuuaauuguugccuuuggguuugaaggcuccuuuuuugauauuguaaacuaauaacagcuagagaguuuguugaaguaaaacagccauuaacuacugguguuguaaauaaguuuaaaaucaaauccaaauaauuugaaccuguuuuauuuaucuagcugaacccauuuaacuaccuuuaacauagccaucauccaaauucaaauucuuugcuaacaaaaauaggucucucaugaaaagugguaaccauuuugaccaaagcuuucccagaaacuugcugguuuauuagauauuuugcauuuaaaauguuacugugaucaucagacuuccaagaucuuuguggcaauauuuuagcuuaagacaaauuagaugucugauucaaaccuuaucuguuauuuagaacucuuuaaauagcaaguugggaaaaguuucucaaagagaagucauuuauuccagaaaauuuuauaaggacuuacuuuguucaagguauuauaggggugcagauaugaaaugaacauuagcccagccuucaaagaguacuuagggggucagggagaugagaaagucuuauacauauuuaucaucugcaaaacacaguauuaaagauuucaacagaaauacugaaaguagugcuauggagguucaggggaugauaauacuuuucgcuggggauuugggaaaaagcucuaaucaguaauuauaccuucaugcaaacuucuauucuugugguagauggauguggguguguauuuguuugaaccuacaucaacuauuaauuuuuuuucucuaacccaggaguugcaacaauauccaauucacaaagacaucagauccucuauacucacaucguggcacagagcaaauuuggauuauaauuuaaauaaucuauuuaccagauaaaugcacgcauagacuaauggucauuuaguuacaaauuaucauuuuauguugaucccacucuuccaguggagggcuaacacugaauaauuuggggcuauuuugcuagugauuuuuaaauacuguagauguuuggguauaggggaagggaaaauaauauuuuagucaaagaaauugugcauccucuacauuuuuuacauaacaaaugaagaaagagauacuaccaccuucuuauagcuucuuuguagccauuggugaagacccuuugauaccugcuugccuccccauuguuauaagcuuuuuuuuguuugcuuguuuuuuuuguuuuguuuuguuuuguuuuguuuuugagacagucucacccugucgcccaggcuggagugcaauggugugaucucagcucauugcaaccuccaccucccggguucaagcgauucucuugccucagcuucccgaguagcuuggauuacaggcgcccgccaccacagccggcuaauuuuuuuugguauuuuuaguagagacggggguuucaccauguugcccaggcuggucuugaacuccugacugcaggugauccacccuccuaaaguacuaggauuacaggcgugagccaccgcgcuuagccuguuuuuaguuuucuaaagcaaggucccuauugaaaggcaggccauaaacagugaugacuaagaaaaauccuggaagagccugagaaggaaaaagaugaaauauaaugccagagaaugaaguuagucaaaggaacagugugaaaacaauaaauaaauagauaaaugaaaauguuauuugacagagagaugaaacuagacuaaaccauucagcugccuuuccacuguaacaaauguaauuucaucuuucagaaguguaauaccuugcagcaccagagcugaauaugaacauauuaccaaaaauagauuaccaggcauagauagcauuccuuuuuuaaguuugaauugaccacuugcgacucucgaccugauguauguaugugcuuccuuugugacacagauagaugcaacgaucaggacacaaggacauccuauagaauuggagacaccuggagcaagaaggauaaucgaggaaaccugcuccagugcaucugcacaggcaacggccgaggagaguggaagugugagaggcacaccucugugcagaccacaucgagcggugaggcacaggacgagcaggggcgggaaauggggaagcaggucaagaaauauuuccgcaaauccaucuuuccuuugacaugccauuugaggauaauuugcaguguuucagcuaauaaccuaagauaauuuacacauuauugguuguuaaaacuuuuuuuaaugucaaguuuuaaauuuuucagaaaaaaagaaaaaugacauacaaauaaaccuuagggggaaaaaagccagauuuaucuccaaaagauaaaacugaguuuuaaagaaugcuagcaucauaaaacuuaccauggauagaucacgcacacacgcacacacacacguauuuugaauauccaaaguucauuugaaaggaaaugagaguuauaauuaauuauaugacuaccugguucuucugcuaggaaaggacaaaaaaagugcauuuggauuuuuuguuuguuuguuuuugaaugaaauauacuucccugucccgacauugaacucuuuuuguaguggaaaccauccuuuauaugugguuucuaugcucuggcaaacuuuguuacauucuauaaaguaacacacaauuauuuccuucauguauuggcauucgaaauuuuagaaauucagagaggacuuagagauggccaugaaagacaugauaucuaagcauucuuuuuaaaaaacaaguuuuaaucauuuuuggcaugagaaaaagauuuuuacgucauaaauguuucauaaaaaucugaagagagaaauauggccaacaaggacgugcacuccucucauuauuuuuaauauguuuugauuaacuuuuuacuauaugaugugccaacaucauuacguagugucucagccauccuucaauuaaaaauauuaauuguucuaauuuuucuucuuuugaugaguuuuugucuugcuuugagcacuuaugaaggugaacaagauuagauuugauaauaucuuugaguuauuuuauuaucauuaauaaaauugcuacuggccaaaaaaaauuauaaacaucggccacgcgcgguggcucacgccuguaaucccagcacuuugggaggccgaggcaggcggaucacgaggucaggagaucaagaccauccuggcuaacacggugaaaccccaucucuacuaaaaauacaaaaaauuaaccaggcguuguggcgggcgccuguagucccagcuacucgggaggcugaggcaggagaauggcaugaacccgggagguggaguuugcagugacccgagaucgcaccacugcacuccagccugggugauacagcgagaccccaucucaaaaaaauaaaauaaaauaaaaaauaaaaaaaauuauaaaugucagucuaccaaaauagauuaaaaguguaggugggaauuaaauggggauaaacacucaauaaauguuagcuauauaugaauauugccaauacugaaaagauuccauuguucaaaaaaguuugagaagcaauggguuaaacaaaauggaaccugcucugcagaaucuguguguuccuuuacaucauacucuccaugguagaguguaggggaugggcgccaugucucccuaguacguuugaccuugggauucuuugucugugaacaucuuuggguucuaguguucagcagcacuuagggaggcacugaauucaguguaccuuuggucuagccucagcccugauucuguucugcggugggcccuggccuucaagagaacagauaucuaaaaguugaaagaaaagaucggccgggcgcgguggcucacgccuguaaucccagcacuuugggaggccaaggcggguggaucacaaggucaggagaucgagaccauccuggcuaacacggugaaaccccgucucuacuaaaaauacaaaaaauuagccgggcgugguggcgggugccuguagucccagcuacucgggaggcugaggcaggagaauggcgugaacccgggaggcagagcuugcagugagccgagauugcgccacugcacuccagccugggugacagagugagacuccgucucaaaaaaaaaaaaaaaaaaaaaaagaaaaaagaaaagaucaacacauccuguuguguuauucugaaaggaaagcugucuuaagaggaucaauugguuuuagaaaaaacacaauagaaucacaaauaauccagaggagaaauaaaauguggaagguggaggugaccuccagaaaauccaggacagcugcugaaggcacccucugaugagcucgguuacucagaagagugaggauguguugaagguaucugcuguauggaguggcaggaugaugucugugauugagaaauauaaucccggccaggcgagguggcucaugccuguaaucccagcacuuugggaggccgaagcggguggauccccugaggucaggaguuugagacaggaguuugaggucaggaguuugccaacauggcaaaaccccgucucuacuaaaaaauacaaaaaaaaucagcugggcaugguggugcgugccuguaauugcagcuacuugggagguugaggcaggagaauagcuugaacccaggaggcagagguugcagugagccgagaccgcgccacugcacuccagccugggcaacagagugagaccccaucucaaaaacaacccaaaaaaccaaaaaacaaacaaacaaaaagaaauauaaucccaguagccccagcugagcuggaggauggagaccacuugguagacacuuguggauuauuuccuaggcuaaaugcaaaagcuacugcugaauaagggacauuuuuuuccagucccaggccaguagcgacauagauuucagagugaucucugugagauccugaagauccugacugcagaaaguagugaauugucuucucucacccaguuuugugacauucccuuuucaugccauuaggaucuggccccuucaccgauguucgugcagcuguuuaccaaccgcagccucacccccagccuccucccuauggccacugugucacagacagugguguggucuacucuguggggaugcaguggcugaagacacaaggaaauaagcaaaugcuuugcacgugccugggcaacggagucagcugccaagagacagguaugcauuaucuuuuugaagaauaggacugaugacuuuauuauuuaguuuuugaaggacaauacauuuucaaugugaaacaauaaaacaaacaagaagccuguaaucuuaccacccugugauaacaauuaggguuggcauuugaaauaguuucuuccaaucuuuuuaauuuauguauuuucuuucuggucauggauaucauggguaaaaauuuuauuguauuuaucugucuaaaguguuguuacaagagagcuacuuucugaauaaucaucaauguuuuauauucuaaaucucaaauuucagcagcuuugugauguaaacaucuuccaauaaccuaauauauguauucugcacuacaaacaugguagucacuauggcaauaacaauugcuacacaauucucccccagaauagucucauauauuaauuuuauggcauagauauagucauaaauauuaucccaacauccuuaagcagcauccuuaauugaccuguauaaauauagcuuuacaaauagagaaacugaggcauggcagcagaaguggucaugaaggacaucagcagaagaacucaggugucguucuauccacaguagacauggauuccugaguaaugcauuuugacugaaauuaacgagaugaucaucuauacucauagcuucuuccuuugagggcacaagcucaguaucucauugaagccauaaauaagcagcugcuggugggagauaaagcaucucuguuuacugacacucuuuugauuaugauuguagcuguaacccagacuuacgguggcaacucaaauggagagccaugugucuuaccauucaccuacaauggcaggacguucuacuccugcaccacagaagggcgacaggacggacaucuuuggugcagcacaacuucgaauuaugagcaggaccagaaauacucuuucugcacagaccacacuggugagugucccaagggggagccacagaagugagaaaaacucacuuucaugcccuaguuuuauuugccagcauucuagccauuuauuuugaacccgcccaagaagcaucgcuuuuguucaguuuggacucaagagaucgcagcgcucacguaacagcugaggauucuuccaucuuccccaguacuguugggaaaugacaccaagggaguagccuuccaguucauuugauuuaacacauugggauuaugaugugauuaaagauacuuguauuuuggaaucaguagaugaucccacagggcugaggaauacaaaggaugaauguuuuagugccuuagcuuauuuuccaguuaaaacaauguuuuauucaaagcuaucauuuaaucuuuuguggggggggugcuggggaaaugacagugaaagugggauuuaaaccuguuuugaaggugugaagguaaauaugcuaagaagcuuagaacuauauuaucagacauuuuuuauucugagauagacugucugugaaugagcugcagaaaccuggcucucucagaccaguaauucuguguacauuggaaagcucagcgguaaucuuuuccuucuuuguuguguauuguuccuggcaguuuugguucagacucgaggaggaaauuccaauggugccuugugccacuuccccuuccuauacaacaaccacaauuacacugauugcacuucugagggcagaagagacaacaugaaguggugugggaccacacagaacuaugaugccgaccagaaguuuggguucugccccauggcugguaagaugaagcccuuguggguugucuuguuugacaacaauuuagggaguagagacuaaagacuaguguccaguuuacucccauuucauucauuaacacaauuuugagacaacagaaaacuucaugugaaguguguuugugugugugugugugugugugugugugugugauguuacaucauauacauaaggauugggaagaauaauuagauaauuauuuauauaauuuuuaaaccucauugacaugauuuaaugucaaaaauauaauuacuuauuuguaagucuggaaauaugaauuugcacagguuugucuuuguaaagagcacacaacugaguagcuuacaacauuuaauauauguaugacggcuuuagucacagagcuacaauauugacacaugguugugguuugaugggcauaagcucuaucacuuauuaauaagugccaaagugacuaaaacucaauguuuucuaacagguagggaaucucacucuuuuuuuaaagguccccaguuuguauagauggcgaacaaauggaaacgaauaccuuuuacuuguuuucagauuucaagaaccccauagauucccuuuaauuuuccaguuguagaaacaagagccugggcgguaggcacugucaagugugacuaugagacaaagaaauugcuuauacuuuuauuucuuucaacaaaagaagaugcugaguuuagaagaaaaaacccacuuuugcuuguaauucuauauccaaacccauaguuuuuauuugauccagaauaaacuggaacugggaaaaguuaugaagcuguaguuaaauccaggcuucuagaacagcaagaacccuuuguguggauguguagauauuaucuuaguuuaacauccccuaacccuuccuguaacuauuuucuaugacacguuuggacuacguuuucugccuccagggcucaaaaauucuaccccuucaccugacagcacuuagaugucuuugaugcacacaaagcuucuucccaagugagaauucuuaggaugaccaaacugaacugauccuuuugcacacauacauguuuagaccuggugaucauuuaucaagugcauuucuuauccauuuccaaacagcccacgaggaaaucugcacaaccaaugaaggggucauguaccgcauuggagaucagugggauaagcagcaugacaugggucacaugaugaggugcacguguguugggaauggucguggggaauggacaugcauugccuacucgcagcuucgagguaugcuggcugauuaacaaaaauauuugagauggcaaaagguacagaaagggacacuuuuuuuuaugaaaacuugcacuaugccaaaagcaggggaagaaauauggaaugccacgucauucauuagucuacugugcaugguaagauaagccugaaaggcuuagcaggcagccugcuaagacaagcggcauagcaaugcuaauguucugaaacacuccuagcauguaaguacuuaggcugagccaaaaagauggcuucaaaaguaagaaugaaacauuugauccauucagcuuuaggcuaugccacuggauucaugucuagaaaagauaggauaauuucuguaaagaaaugaagaccuugcuauucuaaaaucagauccuuacagauccagauuucaggaaacaaauacauaggggacuaacuuuccuuguucagauuaguuuuucuccuuugcacccagcuauauaauaugaggaaguauugacuuuuuaaaaguguuuuaguuuuccauuucuuugauaugaaaaguaauauuucgggagaacccugagcuauuaauaaucuauguggcuagugcguagauauuggucugaauuuguucuccuuuugugguguccaguggguaacaccauccgggaguaauaauuacaugugguguugcagaacugaaagagaccuuaauaacacauagagaccucacucuauauagaucaaggagcugagacccaaaaaggaaaaaguaauuuucucaggaucucucaaagagugagcaacagaguuggccuaauuuauuuuagcguugugaauacuguugacauuuuauuucccaaaucuaaguaucuccuccccuucccccuauuccagagaccagaccaccacaucaugcuggguguuagauaaauauguuuaaucuucuucuuauuuauccuaacaagcagauauuuaaaggaaauuaucaacuaagcaagaaauuuucagaaaguaagacauguauuuguucaaauacuggcuucucacaggaaaguguauuuuaccacauucuuuacuugagcauacuguaaccucugcaaaaguuacacauuuugggaagaaaaaaauuuuuuuggcaaaaauuguauuacugaccaaacuuugaaaaaaauguuauucuaugcuuguagaaaaguuauuuuaguggaagguguugauaauuaaguggaaguaguuguaugcuuugagaagcauaccuuuuuucuuucaucaauggaacuuuaaaaaguuucucacucacccaccuguuuccuaaacagaucagugcauuguugaugacaucacuuacaaugugaacgacacauuccacaagcgucaugaagaggggcacaugcugaacuguacaugcuucggucagggucggggcagguggaagugugaucccgucggugaguagcccuauuucccuagaugaguuugcacagggggaaugguuagcaaguuucagauaagaaaagcuaugugaaaucacaugacugaaguuggcuccagacuuugaucaguugcuugcaaagaacuuugcaaagucuucucucuaauacuggaccaaaauaucucgauauugguagucgucugguuuuugcugaauuuggugacaaauuuaggcuuauuuuaauugaauggaauuuauucuuggguuuagaaucauaaagauaauccaugcuauuaaaaguauucuuuccuuuuuuuuuuguuuguuuuuguuuuuguuuuuguuuuuuugagagagaguuucgcucuuguugcccaggcuggaguguauggcacaaucucggcucacugcaaccucugcuuccuggguucaagcaauucugcugccucagccuccugaguagcugggauuacaggcaugcgccaccaggcccagcuaauuuuguaucuuuaguagagaugggguuucuccaugugggucaggcuggucucaaacucacuuccuuaccagcuguguaacagcaugagcaaaggguguaaauaucacccaccaaaacacucuagguuuuuuuuuggccgcccuucaaaauagaacuaagcaaauagugaaggcugagccuuaaaagagcuguguuaccagcacuacaaaguuuaaggugauccauuacuauuucuuuaccaaaagagacagguugcucacugagaaaacaaacugauaacauccguuuguuugacgugagauuaccagaacugagagagaagccugagagguuuucuuagaagcugcucagcagguauacucguaaagucuaguucauucauuuaaaugucaaacaguuucuuuaaauuuugaagaaguaaggaaaaugaaauuauugcagauuuuuuucuugcuauuuaaauguuaagccaguuauauuaauauggguaaaaauaauaacuaauauuuaaaauuaauguguagauuaucaauauacacugaaaucuaaaucuuuacauuuuuauuuagaaauauuaccuuuuagaaaacuaaauauuccuccuaauagguacuuugguuuuuuuuuuacuacaaacuguccuguaagguaaagaaugugaacaaaauauuuuuuuaacugcauauauuuguaagaacaauugcaaauuucuauuuaagcuaaauguaugcucuagcacccugaaauuaaauucguaguuauaagucuucaaggcuguuuaucuuuuccuuccauguauuuuagaccaaugccaggauucagagacugggacguuuuaucaaauuggagauucaugggagaaguaugugcauggugucagauaccagugcuacugcuauggccguggcauuggggaguggcauugccaaccuuuacagaccuauccaaguaaguagcucuauuacugcaaguugagaacugccaauuggguuauaacaacagggcagugauuauuaaugcucucaugccuaaguugggggucuccccucuuucccacccuuuucucuuguuauuaucuaauaaucaauugaauuuuugauuaaaauaauuuuucucucuuccucuaucaaguaaaagguagagaaggcuaugaaaaugugccuguuuauaauuuuacuucuuaacucuguaaaauauucuguuagguuaagacacucuggcuaauuucaucuuauauccauacauggaaauaaaaaccaccaagugaguuaugcugggaguaaagguuuggggcuuuauauuaugauucuuaacagagaagcugcauagagagauggcaugaaaugcagcauaagguacguguucauucaacaugucaucuaagcucccuuugcaucaaacuuuucauuuguuugaucaguugccaccaggaacacaguauguugggccaaggguugaguaacuuggucaacucucugcccacacaguucaaacacucucaaauguuuauugcuggguuuuuccaggucacaaagacaucaugccuagcuguagguguaauuaguucauuuggggggaaaauugcauuuaaauauucacugagugauuauaauaaaacauguuaauaaaacaugaaaggcuaauuaaaaggcaucaguuauuugagcaacugcugaggugcaaagucuccaaagucuucacuaacguuugacugaaaauauggccuacauucagaaacaaaagaguuucagggugucagaaucugcaugcgacagaaauuaagauuaacucugugauaaaagauucacugugacagagaacaagcuaugggaacaacuuggccaaagguaguguuagccaagccucauuccuccauuuccucaucuguaauaugggaagauuguagcugauuaccuuuaauguuccauccuaaauacuaaacacccagaugcaccuuuucuaggaacuuggaagauucugcuuuucccaacccucagacacugucagugcuggggaaggugacuucacuuuugaaggcuuauagcacagauugaccaaccuccuaaauuguauuucuuggaggauuuagguguaggaaucacuuaauuuuuuguaacuuaauauauauuuaaaucugauuguggaaguacuauaaguauaugaaugguuuguuuguuuauaugaugcaaaugauacuuaaaugguagaaacuucuaaaaaaaugcucugugguuucuauauuuaugauuguuauugguguugcaauuugcugaaaaugauuuccuucugaaugauugagagagaucuucgucucucucaacauaaggcuguccacauagcugcuugcuggaagcauuuagguggacauguuggagauaaaaucuggaaaggaaggaauccuugaguauuggaguauuacauguugaccuuacuccuacucuuuaaaaaggagaacagcaagaucccacugagcauagaggugauuucggagggaagagauuggaauuugaccucagauaugcucuuuggugcuuaucuguaugucugguuugcuccguggccuagcacguagggcuuuaagaguguggugagaauaagggaacagcagauuaccaacagauugucucugaguccugccuuguuuguuccuccuacagagaacuugguagaguuguucaaacuagcaaaagauaagaggcauuugguuugucaauaagcaacuagaaaagcacagaucucagcaaaauaaauagagaaaaaaaggacugagucaaaaaaucauaaauguuuaacuucuccaaggacacuacuauuggaaauuauucauuuagacuuuauuugaaacuaauuuuaaaaguguagacauuguacuaucuccuuuuuuugguaucaucucaacuauuuuauuguuaguuuauucauauugaauaagagagggaguaaagauuucacaauggcgauagcuaguauaugccaauuaaguuaauuuaaaaaguuauaccaacuaccaguagcgaaaaaggacugucaaaaguuuaaaucuaaauaauguaaaagaugucauaauuuuuaacuuuucugucuuuaaaggauacauaguauaagcuagaguaauuauacguaguauaagcuagaauauaggaauuuaauugaucuaagaaauaacugacacaaagucucuuuacuuccugaacaaaaacaugcuaaauuccaugcuguucaguccauuuccuuuaaaggugggcuaugccacagggcuagauuuuaaaacguggaauuucacaccagugcucgaaaucuuaugaaagcaaaagggaccucuguaguuguacuccacuuuggcuugaguaaaaaccacugcuguacccuuuuucuuuccuuucccugcccauuuuuauccuccuccuuguguccuuguggacauagaaauaugauuaggcuuagaggugaacaguaaaggucauuuauguuaucuuuucaaaacuuaauagacauuuauccaucauaagcuuguccccccucaaaaucaugauugacaagacuaaauaaaguguauaucaggugucucuuuauggaggaaauuguaguaggauuuauuuaaaggaucaauauuuaaauagcccuaugccaauuaucauaaauaauuaaggacaugauauuccuagcuuuccugauuuacauggaaguacguuaaauagucacaucuccaaaauuuuucuugaauaguugucuuuaaaaauguguuuacauuuguaaggaucuucauaaacagaagggguaauucaaagauaggcauggaauugacuuaugccaauugauuaaaacaaacauccuguguguucugugaaauacauacaacuuuaaaaugaaaaacucauaauuuuaugcaugaauuuugguguucauguggcuuggaaauaugugcauuaaauggaauuaagauucaaaguauuugcuaaucuucaaccaacuuugaauuguuacugguguggaagugagcauauuguuuuagaauuucugaaucuacauggauauccaaguuauauauuuuuucugcuacagaaagcuuuguuuuccaagagaauuuaauggcuuagauaauaaaguuugaaaaucaauguauuuuuuuuccuagaagcuuucagaaaacuuaaaucuguuaauaaucuggugaagugcuuuauuacacauacaaaauuuugcucuguuugacagagugucaguuagaaauucuugaaaagguuacuauaagacacaauuuuuauuucuaguaauuuaaacauugacugacaucauaaagauaguguuuuaagaaaagauaguuuucuguucugcaagcauaaauuuucuagcuauuucauuauuaucuuaaauggaguuaacacuacuuagaaauugaugcuacuucccuuauuuuccuuuuauuuuaaacaaaagaaccaaaaccauacuuuaaauuuuguugauaacagugauauacaucaagguguagaaauacugaauuuaguauacacuucauaaagucauuucuguugacaacugauuuuggaaaaaaaauaaauuuaaucacuuaauaauuugauggaucaauggugugauuugggaguaaacuucuugaauaaaaauaaaacuugauguuuuuuccaaacugauagacugcuuagacugaugagaaauaaaacuaggucuuuaauuauuaccuuugcuauuugucuaagauucuacccccauuuagaaauguguuuguuuuacaucaucucauauggccuuuggaauguuguuuccuucuuagguaguagauucauucuugaugaaaaccuuccaaaauuagaauuugcuuuaaaagaggcucaauacaauaaguaaaugaagucuguguucuguauuacauuauuuuuguaggaucguuucacaauuuucucacaauucuuacuuugauaguagagaaaauaaaagcaagccaagagacuuuuuuuuaaaaauauauuuuauuugcuauaaacaacuaugauuugcauuucucaugugaagaauaauaauuaucggcuaaaaauggauuugcugcauugauuuucaacguaaauauuuaaaagauuaaugccagauaauuuuauuauacucacauuuaacgacaagcaaagcuguuuauaaugaugacuguccauguacacaguuuuaaguugaagugagugaauauucaagauaauuaaaugcuacauuuucauuuucaggcucaagugguccugucgaaguauuuaucacugagacuccgagucagcccaacucccaccccauccaguggaaugcaccacagccaucucacauuuccaaguacauucucagguggagaccugugaguaucccacccagaaaccuuggauacugagucuccuaaucuuaucaauucugaugguuucuuuuuuucccagcuuuugagccaacaacucugauuaacuauuccuauagcauuuacuauauuuguuuagugaacaaacaauauguggucaauuaaauugacuuguagacugaggggauuuugguuuugguuuuggguuuuguuuuuuugcggugggggggcugguauuuggaagaauuuagcucuuuauguuacagaaaucuuuuuugcaaggacuuagaaaugauaaugcuuaagauuguucuugcccaaugugggaagagaaucuaagguuuuuauaugucuugcaaccucaucaaaggaaaauuacuggcaucauuuucauaauuugaaaaaaaaagccaaauuaauauauuucuuuuuugauucacuuuuuaagugaucauuuuuaaaacuuuacuuuugacccacugaauuuauuuagauagaaggaaaagagaugaugggagggaaguuuagauaaaggauggaaguugguuuuauuuaaacaauagcccugugauuuccuaaugagaagugacuagaaauugaagaaaccaaauaaggaggauauuggucaauuuagcuuuaguuucucuuacucucucaagccugcccuguuuaacuccaaaguucauggcucauaauuugagaaacacuguuuuaaacacaggagaaaaaaauguccauuuuaaaucauagcuauugaauucuacaauuacaaagaaacaaacaaacaaaauuugaccaacccaggcgguuaaauuuaaacucuucaggaaaaauuuaagcuguuaaaauuauucuuuuucuaaauuucuaaaguggagggacagaauuuuucagauuuaaaagggccuccuaggugcccagaaaauuaguggaaagaaccacgucuagacgcaucuuugaugugucagaguuccaaggauaaaaagaaacuuuuaaagucuucuauacucagccagguuaucaaucaaauaugagggcaaaauaauauuuucagacagauuuuaggcaguuuaucuuccauauauccuuuucuuuaaggguauuuguagauacacuccagaaaaacaagagugaaauaugaaggaaguugugggguccagcaaacagugcuuccaaaucagaccccugauagagguggaaaacuuugcaaugcaacaacugcguagcuggcuuagaggacagccaauacagauggaacagaaagaugaggaugggauugagggaucagggauugaggucuccaagaauaaaaagggacuucauggaaaaaguaggcuuguggauaauuaaucacaggggcaaauaaugcaguuaaaauaacaacaugacaaucagguggaggaauguauaauaaacccaaauguggcuggguagaguggcucacaccuguaaucccagcacuuugggaggccaagccgggcagauuaccugaggucaggaguucgagaccagcuuggccaacauggcgaaaccccgucucuacuaaaaauacaaaaauuagccaggcuugggggcgcacgccuguagucccagcuccucaggagcugagguaggagaaucacuugaacccaggaggcaaagguugcagggaguugagccaagaucgcgccauugcacccuagccugggcaacagagcgagauucuguuucaaaaaacccccaaguguauuauaaggcaauaauuccuauacgaagcaaacuaaaaugcagcaauauuaagguauaaaaacaaagaggaauaauuccauugaaccuugauucuggaaacuuugauccacccagcagucaugauguuagacucauugaaaagaauguauuucuaaugcaugaugcgaucggucuauagaugugucauggaaacuugguugcaacuucaagacaaaauaaaaaguaaacauuuacaugaaaaaugguggauauggaagguggagaagagaggagauaacagcuuuaucuuucaaaauagagaauugagagaugguaccaaaagcugaugaaguaaaaaaaaaaaaaaaaaaaaaagauacuuaauauaauacuuuaaauuacaaauauaaacacaagaagaacaaauauaaugauacaaaugucagacacugggaauguccaagauucuggaaggaaagggugguauuauugagcuaaauccucaacuuugucugggcacaguggcuaaaaauuagccgggcaugguagcaugcaccuguagucccagcuacuugggaggcugaggcggaaggaucgcuugagcuugagaggcggaaguugcagugagccaagauggcacuacugcacuccagccugggagacagagaaagacccugugucaacauaaauaaauauauaaauaaaucaucaagucucauauuaaagacucuguaaauaugacuuauuguugacaaaugaaacaaauagagguguaagcauguugucuacauggaggcaagaccagaauaauagaaaauggaaacagauucccuuaaagaggggaaucgugucuuucucauuggcucaauguagucuccguagagucuagaaugcuucagcaccuggcacacugcuuaacaaauggugaaugaaaaaaaaaaaaagaaaagucauucuuuuucuucuuucacccuauguccauaaucuggccauuugcagaacuugauguccagugaucgaaaucaacagcaucagugcauccaauaucuucuagucucucaucuucuuauuacaucauuaauuuuauuuacuuuaaaauuaaggauauccaaaguauuaugugagaccauugcaaugggagacuuaaaagugguauaaaauguacuuugggccaggcgcaguggcucacgccuguaaucccagcacuuugggaggccaaggugggcggaucacgaggucaagagaucgagagcauccuggccaacauggugaaaccccgucucuauuaaaaauacaaaaaaauuagcugggcaugguggcgcauaccuguaaucccagcuacucgggaagcugaggcaggagaaucgcuugaaaccagaaggcggagguugcagugagccaggaucacgccacugcacuccagccugggcaacaagagcgaaacuccaucucaaaaaaaaaaaaaaaaaaguacauugaauuggaaagucuucaaaaagcagcagugaugaauuuuuugagauuuuuaacaauuacaaaaauucaggguuuuuucuaauggaugccaccugagacuuuauuuucuguuauuuucuuguaauaacuaaccaaacaagcucauguugaaaaaugauuacuaaauuugagcuaauugcaaugacugguuucaaaauuuuccacaguguauuugaguuaaaauuucacugugaagaguacuacgaucacucucgcuuauuccaaaaauauaaauggacacuugaguauuugaauuauugaggaaaugguugacuggguaauuuuuaaaaaucacugggcacaaaaaauauauuuugacuuauauuaguuuagaguauuuacacuugaaagagucucaucuuuucugaaggguguuucuuucauacacauuuuauugcacugaguuuugugacccauggcauauuaaugaagcugaacaggaugugaaauauaaacuggaagcaaaagauuaaauaaaccaaaauugcauuuuuucuguagucuuguccaaaauuggguaaccacuucugaugggguagcucauauccaagaaugagucacaaaaccagacucguugaaccugguauaugaugagucacaaagcaacauucugccuuuguuuuuucaggacaagaaacuugaauuguaucccacugaguuaaaagauaaaauauauggcauuggcauuucuguacuucagagaggaauauaucuguuugugguaggaauaaaaaauaagugagagaggcaaagcuuagguucaucauauuauguuacugauauaacacaauuaacuugguaaaagugaaggugugggugggcgugguggcucacgcuuguaaucccagcacuuugggaguccgaggcggguggaucaccugaggucgggaguucgagaccagccugaccaacauggagaaaccccaucucuacuaaaaauauaaaauuagccaggcaugguggcacacgccucuaaucccagcuacucgggaggcugaggcaggagaagcgcuuaaaccugggagguggaguuugcagugagcugagauugagccacugcacucuagccugggcaacaagagcaaaacucugucucaaaaaaaaaaaaaaaaagugaaggugcccagugucugcaacuaugucaccccgggcauaucacauaucacucuguuuuuccgucuguaaaacgggagcaacaaugccauugccuuaucaucagaaggauauggagacuaaaugggagaauguagguaaacagcacagaguauggguaucaguaaguaaacugcagcaguuuguugauguuaacaauaguuagcauuauaucuaacuauaucuaacgauauaaccauugggaauccaguuuuccaugauuuuccucuagaauggagcugccuaaguccugcuuaagucauuuuucuuugaagauuacugaacaucaucuucaaauguucauccuuguaaacacguguguguguguguguguguguuaauuuaaauuuucagaaaaauucuguaggccguuggaaggaagcuaccauaccaggccacuuaaacuccuacaccaucaaaggccugaagccuggugugguauacgagggccagcucaucagcauccagcaguacggccaccaagaagugacucgcuuugacuucaccaccaccagcaccagcacaccugugaccaguauguacacaaccacccucaugccuccuacccccgagguuccuagagcuaggcucuccugaggcaaugcuuuccuucucaauucauauucuuccaggaggggcaccaacguuuuuuaaaaugauguuggcgacgaggacgguaaauuuucuagaugacugaaggcugacuuuccccuuucugugacucucuaggcaacaccgugacaggagagacgacucccuuuucuccucuuguggccacuucugaaucugugaccgaaaucacagccaguagcuuuguggucuccugggucucagcuuccgacaccgugucgggauuccggguggaauaugagcugagugaggagggagaugagccacaguaccuggguaagcucaauaugucgcucaagacagguucagggcagcugcuggaaaacucuccuuguggggguggguggccucuaggcaggugguaucugugguuuggaacugguugacagcucagacugaacaaaccacccucuggcaugaggaagggaaggacugacucuuucuaagaaguggccggguuuuucccaagccacugucacauguuccuggucccugaugccagcugcaucaugcgccuaccugugcacaaguuccuacagcaaaagcuguguucuugguggaaguaauuaccaggacugcagcugacaaugugagcacaguacggucacucauacuuuucaaauuguuauggugaggggccuuuaaaaaacuucauuggcgcacugaagugugugccaucguaagcacugaguucagugaauuugaauucuuauaaagugaacacaccacaagaccagcacccagaucaaggaaaagaauaucucucuacccucaccccaucaucuuccgccaauaaucacuacccugacucuuacugcagagagcuauuuuuaaaaauuuggcauucgauuacaaaaauuauacgucuuuagaaaaaaaguuggaaaaaugaaaggaagaaggaggaggaggagaaaggagaaagacaagaagugguguuuucccauaguacauuaauaaucacagauuaggugggugcgguggcuaacuccuauaaucucagcacuucgggaagcugaggcugguggaucacuugaggccaggaguucgagaucagccuggccaacauggugaaccuccaucucuaauaaaaaugcaaaaaaaauagccgggugugguggugugcaccuguaaucccagcuacucgggaggccgaggcagaagaauugcuugaaccggaaagguagaggaugcagugagcugaaauugugccacugcacuccagccugggcaacacagcaagacucuguguaaaaauaauaauaauaaucacugauuagcuauuagcacauuaccuucuagucgcuuuucccuaugaauauauaauucuuaaaauauccuucuuauaagcuguagagucauuugagggacuaguuugcucugauuaguuaccuuuucuuuucauuucaaagaucuuccaagcacagccacuucugugaacaucccugaccugcuuccuggccgaaaauacauuguaaaugucuaucagauaucugaggauggggagcagaguuugauccugucuacuucacaaacaacagguacaugugugcuacauaguguuaaaagaaucuuuuucuguaaaacacaggccuguaguagcacuuccugacuguuugccccacuuucuuucuuucuuagcgccugaugccccuccugacacgacuguggaccaaguugaugacaccucaauuguuguucgcuggagcagaccccaggcucccaucacaggucagcuaagcgucccccucuuuggcugcuauguuaaucuuaaugacaucagcagggagggcgcagauucugacugcggaccugcauaucacuuuaaaucuccaauauaauuuaugggagagggguuuguguguguguguguguguguguguggcgggggugggggaguuauuuucuauggcacauuuccccuugaaaccauuucaccaacucccuuauacacacacaccacaacauacacacaaccuguaaagccagcucauuggcuuauuaaagcaaguguucccaggguugaagagguguaauuuccugaaaacguugcucuaagauuuauccuuaaggagaaagcugagcugucgucuuagcucauuaggugauucaacugccucaucacugaaguuccaaaaagacacacacagugcuagacaacucugcuuaggcugguucauuaauugcuucccucgucuggagcucaaagaggaaaaaucagcuuaacaugaauauuuucaccuaauggcaucucuaauugacauuuauuaaggaugucaggucuucaaggaugacauuuauuauuaaaaagguucgcaugacuguucuuauuuuaucuucgugcugaauagucauuauuagaagaaguggcaauauucaaagagucaaaaaguaucacuggcucuucacuaaucaagcaagaugcuaagggauauuagaaaagggaggauuuaugguguuucuaagccucugucucaaagaaaacagugcaucuuacuuuugcucaugaaucugcaggguacagaauagucuauucgccaucaguagaagguagcagcacagaacucaaccuuccugaaacugcaaacuccgucacccucagugacuugcaaccugguguucaguauaacaucacuaucuaugcuguggaagaaaaucaagaaaguacaccuguugucauucaacaagaaaccacuggcaccccacgcucagguaacuuuuuuaagaagacacuuccuauguuaucuuaucaggauuguuccugaaggaggguuguuuugucucugucaacaguccucucauucaagaaaucuuauauauuaguuuuucccuaaacuucugauauuuagcugaaaugucauaaguaacuuaucaaagcuggcuacuggccuuucugauuaaaaacugacaccauaacguccaucuacaaauuuuccccuagaagcuuaagggucauuucauuuuugauucuuaaguauuauaaaaugauucaguaaaacaaaaacuguuacauuauuuucugcaguuauuucaaaggcuuuuucuaaaaaauuuuuuaguaucuuuucuuauaacccucuccccccaccaccauaugacacuucauaugcugguaacucacuuauuaccuauuuuagauaaaagguucaaaugucauaauuuaagcacuaugacuggaccaugaaaaugugaucugauuaagagacaaaacuuagcaaaacucucgaaugagaggcucaaugaacugccuaacauauccaagaaacuggcuucuuaaaaguaaucuucagcagagaaugugaaugaccaguugacucuugucugucagauacagugcccucucccagggaccugcaguuuguggaagugacagacgugaaggucaccaucauguggacaccgccugagagugcagugaccggcuaccguguggaugugauccccgucaaccugccuggcgagcacgggcagaggcugcccaucagcaggaacaccuuugcagaagucaccgggcuguccccuggggucaccuauuacuucaaagucuuugcagugagccaugggagggagagcaagccucugacugcucaacagacaaccaguaugucuucuccuaucucuaucuccccuccaaauucuccacccucacuugcagccugugagaaagugcaguaaaccauucacucagagguguauggcuuagagagagggaaauacccagccggcaagggaaugcauagugaacacaaagcacauuaaacuugaaaacaaaacucagacaagcuccauggaugcuaagugguaacccauuucuaaaauacauguaccagcugaaggguacuaagaggggagaacugaagagaaucuaauuugagugcauuuuucguguaacuaaauauaucuagaucaaaguuaaaaugcaggaucauaacacuuagaguagaauucauuuaacaauagcaauugucaagugucuaguauuacuagccaccagcuuaucugcucaguuuuuacaagcauuauucucauauuuacucuuuguuuugaccuuaggaaggaaggucuuauuauuauuauuuuauuuauuuauuuuuuugagauggagucucgcucugucgccagggcuggaguacaguggcaccaucucagcucacuggaaccucuaccaccuggguucaagcaauucuccugccucagccucccgaguagcugggacuacaggcgugugccaccaugcccugcuaauuuuuguguuuuuaguagaaauggguuucgcuguguuggccaagcuggucugaaacuccugaccucaagugauccacccacuuuggccucccaaagugcugggauuacaggcgugagccaucgugcccagccggaaggucuuacuaguauccguauugaauacuuaaagaaacugaggcuuuaaaaaaguucugcaacuuguagggucacagagauaggaagggauagagcuggcucuauaaccuauguccgaagcccaugcucucaauuauuauacucgacugccucuuaaagauuuccucuauuugaaagguaauuuaaauuucggugggaaaacugcugguuauuauucucaagaauaaacuccacaacuuaugugauucugauagugcaaacucaccaguauccuaccaugaaucugaggauacguuaucauuacuguaauuacugucuaaucugaaccaugugaaaauaacuuuuauuucucuagcaaagggcuauucacagaauauugcuuuugacccauagagagcuucuucuugcugucauuuuaggaggcauaucccuuuuuccuuaaucuguuuggcucagagcuaacugugaacuucagaaguguuuguuuugccuuuuuaaaaauaccauugcuuuaauguaacuauaauuucugagacugaugcgaaagucuugcuggaaaauuagacuucccaaaggaucacagucaagcaaaaugguuccacaauuucucaugacuggcagaguuuuggcaaaguuuuguguagcacucaaucucuuacuggcucaguuuuuccaggguuuugacuuucacauaguuacaaccuugaggagagaaaacuuagacauucaaucaaguuucaggacuugaguuaugaucauuacugaucuaaauauuucuuggcauguuucaucuuuuuuccuagaacuggaugcucccacuaaccuccaguuugucaaugaaacugauucuacuguccuggugagauggacuccaccucgggcccagauaacaggauaccgacugaccgugggccuuacccgaagaggacagcccaggcaguacaaugugggucccucugucuccaaguacccacugaggaaucugcagccugcaucugaguacaccguaucccucguggccauaaagggcaaccaagagagccccaaagccacuggagucuuuaccacacguaagcugaaaauuaagugccuuuucuuaacuauauuuacauucucuauucuucaugcuuuaaaacaaaacaaaacaaaacaaaaaaaacauuaaaaaauuaguacauaauuuaaaucagugauacuaaaaaugugcuccauagacuggcugcuggcccguuaauuguuugcugcuagucugcaacaagaaaaacgguugugccagaacguaaaucacaaagcacacugcuuaguacagcugagaauuuuucugaagccagauuuucuugaugaaggaagcaguguguuaauuugcacacauugccaagcucgcucuuuccucuagggccagcacuuugaguaacauggguuuaaagcagucuguuauuagaaaaauuaaauucgauuacauuaaaugaauuuaccaaacacuaguuaacgcaagaaaaaauuagcaccuaugucuacauucuauuacuuugggcauugaauaguaacuauaaaugcagaauaaaaauaucuauggauugaaugggaaccaacuaauugaacaugaagccaaggaaaugauuucuuuaugaguguuggcugcagaagauuaaaguacuuuugcagacggaaucgcucuuuucuuaaauuacucuugaaauuccucagaggagaaaaauacuaacaauaauuuuuggucaugucuauccuuuugcucaacauuuuaaaggaaguggucuuaaaucucccacauaucuacaucacaauaacaaccucuauucacaaaccgauuccuauuaaauacauuuccauuuacauuacagagaauuaugagacuccuuauuucuagcugaacaucauuuguuauuuucaacucgacauuuugaauuauagaagcaccuaacauaaguacuuuuucagcauauauucuaaccauggacuaguuugcaauuuucuaagagcuuucaacaaauguuacucuucgacuaauuuaaaaguauggauguuaaaaagcauucaaaaaguccauacaagccuaguuuguaaauaacuauggaauugauuucccaaagaaaauacaaacuuuuccccauaagaauucauacuuuaagaaaaacuuacuuccauuuaaauuuacuguaugaaguuuggcucaugaaggcuuuuuccuaaauaauaguuaaucguaagcaaguaaaauucacuuuuaauuugcaaauaagcuuacuugaaaauuuggcuaaaauuuuacacgguucuaagauagucuaagaucuacucucaugaaauuaaugucuuuauauuucuuguaaauauucauuucuuauaaauguccuucagugaauuagaauggagauuucagugaaugcgcccuuucaguagaugucgucuuuuacuaaaauguagaauucuauaguugucuuguucauuccuuaacaugagacauauuuuauguaguuucuuuuguugaacacagugcuuauaaaagaaaaagcauuuuuaaugaugcuaacaauaauuaagggaagguggugggccaagauauuucaaguacuucugaagacugauauauuggauauauuauuuuaugcuuugcauaauacauucauauaaaauauaaugauuuuaacugaaguacugauagccaaaacuaauuuuauuagauaaagguuaacauagugucuggaacauuguaugcuuucaaaaacuauuuggugaauagauaauugagaaaggaauaauaauaaaaacagcuaaaugaagcuuauauuuaaauaaacuaauguaagcaggguauucuacaacuccauuugaacuuuaagcacucccuaaggcuguaaacauccacaaggcuugcauguuuuugaaauuacuaaauuucuguaguuuuuuacuaucuuacuaagcugaauucugggaguaacuuuucugaguuuuauaacuugugcuaaauucuuaagagcaaaugugagaaaaguuaggggaaaaagcuguuucuggggaaaauucagcuuagucuuauauugauagggcaaauuuuauuucuuuaacagcugggcuguucuucccuaacaagaccugccagaacccauagcucacacuuagaaucacauccuuuguuugacaucguuuguggguuugugguuuggugauuuucccauaauggccuucccaggcagagagcaucaucuuaaacuugggaagacucuagguggcuggcucaagcaauagaaaauaccuagucuuaaagcccaggacaguugaggcgaauauaauuuguaaaaaaaguugugguuuucacagauguucagugaaagaaacugacuguucucugaauuguuuuuugugggccauuaaaaauggucacacagggcuggccauggcauuuuggcacagucaccagcagucaagugguguauaauuucagagguacuaaaaggcaucgggucacccaucccagucauguccccccaccccccaccaaacaccaucaaaauaauaacauacauagaugaaacagcccacuaaaccaguaguaccucaauucagccauuagagcuaucauuaugaaguggcccacacauauauuuggcuuuuucucacacaauauuuuuaaaauaaaaauaaaaaauggcuccuuagaauccagacugaaaaaaaaaugcgagaauugcgauguugauucuaaauucccacauggcaaagaaaaaaaaauugacuggaguugaguugagacuggagucugaacacuuuuuaaucccuguuuguauaacucuggagacuaauucuuugucuugccagccauucauaauuuaguauaaaugcauucagagguuuuuucccaaugggaacaaaauuugauugagauguaaagagaggaagaauuguggagaugucaaacaugugaccagagcuaugaacacacuugauacccuugaacuuaaacuuacccaacucaaaauaucuggccuucugcgaucuuaccuuucuacauuuauaauaagauuugcaagguuguuggaaaucucuaucuuaacuuuauauauacaugccucuuucuuucuuuuucuuuccuuuccuuucccuuucuuucuuucucuuuccuuccuuccuuccuuucucucucucucuuuucuuccuuuccuuuccuuuccuuccuuucuuucuuccuuucuuucuuucuuucuuucuuucuuucuuucuuucuuucuuucuuucuuuucuuucuuucucucucacucucucucucuuucuuucuuucuuauuuuuggugcuaaaacccaaaacaaaucuuuuauuuaaaaauaagauuuuuuuuuuuuuuggccaggugugauggcucaugccuguaauuccagcacuuugggaggccgagguggguagaucaccuaaggucaggaguucgagacuggccuggccaacauagugaaaccccaucuuuacuaaaaauacaaaaauuagcuggaugugguggugggcaacuguagucccagcuacuugggagucugaggcaggagaaucacuugaacccaggaggcugagguuacagugagaugagauugcgccacugcacuccagccugggugacagagcaagaguccaucucaaaaaaaaaauuguuuaaguaaaauuuuauuuucuuucuuuuuuuuuuuuuuuuuuuuuuuugagauggagccuugcucucucacccuggcuggagugcaguggugugaucuuggcucacugaaaccuccaucucccagguucaggugauucuccugccucagcuucccaagcagcuaggauuacaggcauccaccaucacaccuggcuaauuuuuauauuuuuagcagagacaagguuucaccauguuggccagguuggucuugaacuccuggccucaagugauucaccuacaucagccucccaaagugcugggauuacaggcaugagccacugcgccuggccaaaguaauauuuucaauaagaaaaauaacagugaugucaggaugcuagaaaaugcaaaauaaauuuguuauaauuccugauucuggugauaaaauacuaaauuuuugcaguauuauucugaaagaauaaucacguauuuaaaguacaaaucuuuagacuucaaagugcauccaugguggcagauuuuguuuaacuuuuauauagcaucuuuuauugcaaccaaaaauagcugaccauuauuguggaauaauucagcguaaagcuuuuuuuuuuucuuuuuuugagacggagucucauucugucacccaggcuggagugcaauggcaugaucucggcucacugcaacuucuaucuccaggguucaagcgauucuugugucucagccucccaagaagcugggacuacaggcaugagccaccaugacaguuaauuuuucauauuuuuaauagagacaggguuucaccauguuugccagccuggucucgaacuccugaccucaagugauccacccaccucggcuucccaaagugcugggauuacagucaugagccaccgauccccgcccagcauaaagcuguuuuuagaucaccuucuauaauuuaccauuguucuuaaauuaaugguuaagaaacaauaugauaaucaguuugugguggccaguuuuacauuuuauaagggauuuuacacugacgauauagggaaauuuauugucaucaaagucaaaucccaacaaucauaaaaagacaugaauuagauuauauaauuucaaugaaaggaccaccuuagcaaacaucuaaccccuuguuacucagguaucauucacgggccagcagaauugguauuaucuguguuugucagaaaugcaaacucccuaguuuuuuguuggaccuccagaaacagaaucugcauuuuagccagaccccagaugauguguguggcacauuaaagauugagaagccugauccucucccaauucucacccaaugaaaaaauauguuacauccucuauccacugcuugguuaaacugagguucuccauaaaaauacuuguuaucuauaugcuaugcaaucaucugugaguuugaguuuugaauaugugcauugauucucucucacagugcagccugggagcucuauuccaccuuacaacaccgaggugacugagaccaccauugugaucacauggacgccugcuccaagaauugguuuuaagguaaacugcagauguuccuaaucucugugauacagcccugagcuguccuugugguucccauguaguggaaacagggugcucaggagucaggagaccuggguuuugucaccugcuucuguccauacaucuuugacuacauugucagggccuaacaguccuucccugccuaccucacugaauuguuggaaggguagauggaggcugcgaaaguguuuugcaaaggauaaaacauuagcacgaagcugcugcuuauuguuaucuuauuuucucuauccuuuccugcagggaauuacauuucaaaaaaacaugggaaaacuuuauuugauguguuguucuaaaugagugugaacaaguucacaaaagccaguuuagggagaccaguuaaacucagagucacuuaaaaaucgcauuuucauccaaucaguuucaucuccaacuguucaaagcacugagggugaaucucuuaauagaaguuaagauuaagguuucccuguggauaucuggauucaucuucuuuaaaguaaugauauuagggaagcggugaauacaaaugaauauguuuaaaagaauuccauucuuuggcauuuagugugaagagagaaauauuuguuaucgcuggaaaucaugacucaauccccuugaucguuuaaaaaaauacaccaaagauaaaguuuguaaauggccauauuuaugauuaugcuacucaaauauagaagaacuuucugaagagugccaguauaccuuuuaauucccuuaauaaugucaugcugacuuucagaagccuuaugaugugugaaggaucucucuagaguugaacacuauuggauaacaguguuaccuaaguuuuugaaauagaaucuuaaaaggauuuuaaauuaugggcauaguuauucuaauucuucucuuguaauguaucauccugcaguugaagcuauguacauaucucuucaaaagguguguuuuugcaauacaguugcuacaggggcuggugccuuuaaauggcaacuaaaagguuaauugaaugugaauaacucguuaaagggagagcucagacauuccuucuagcacacacacagaaaaauagaaaugaacuaccaugugacccacagucccuguauacgucugguuuguaacaagagauucuuuaucaagcaaaacaguauguaaugacauuucucuggaaccuuccauuacaagccaccuuaaugcaguuuggaagauaccucccccaccugggggaauuuccagcuaaaguauauaaaagaguccccaaaucauuucccaauaaaaguacacugugcaguuucugaagaguuuacacuauuuaaagcauaaucauagccucacagcaguaacaguccucuggaaauauuuguccuugguguuuacuuugcauuccuuccucuagcuggguguacgaccaagccagggaggagaggcaccacgagaagugacuucagacucaggaagcaucguuguguccggcuugacuccaggaguagaauacgucuacaccauccaaguccugagagauggacaggaaagagaugcgccaauuguaaacaaaguggugacacguaagaagaauuuuuucccuuuucuauuaguuuuuaaaacuguucuacuuuucgaaaaaagcuagugucaauaucacuuuuuacuuaugagaauggcacaggggagauaucuuauccuuacuuauauuauuaaugcuauuccugaauuuggaguagcagguucaauucaugcuuuauauuuuauggcaucagaaauguucuuuccaugucaagaauauuuaugaacuggcaagaugaaaauaauuucaauaguauugcaaaaucauuaaucauaaagaagucuuugucagagaauuacugcuguccaucauauuuucauaauguaaccuauauuuuuaugggagggagggagggagggaagaagcauggaagagagggagguagggaaggaggaaagauuacacaggucaagagcuuugugucagcuuugacuuuuaaaauguucuuucugcauagcauugucuccaccaacaaacuugcaucuggaggcaaacccugacacuggagugcucacagucuccugggagaggagcaccaccccagguaaguuugggauggaucagagggcaaguauacaccauaccuucccaagacaaagauuuuagaaacuguguuucuuucagagaaagaagggauucaaauuacaaaugcuuagcucuccauaaaaacuauagcaguacaugauguacaucauggagcagccugcaggaugcuuuaaugcacguugacuucaaucacaggaagcagaacaaccuuacacuagucuagggggacaagacagauccucacacagcuguagggcugaagaaaagcacuguggaagguggcuuuugcugagugcauuaaaaauugccaaacaaaugguugaagucauauuacguaauuucccuuuugugaguuguuacagagccuaaguuuauuauucccugaaguuuuaugaauguuuugucauggguugcaccacaaauauuuaagggugaugaaaggcagaaauaccuucauuuuacagaauaagaaaacugagacuuagaaaaaauuggccuacucauagucacacauuuuaaauguuacaaaacugggauuguaacuuaaguuuguagacuccuucucacacccaaugucacauauuuggaauguaauuuuuuuuuaauuauauucuaugcaaacugaaaauucugauuaagggguuuccugaccauuuuuagagcuuuaaaugaagcauuugucuaaauuccuuguucacauauauuugaaaauuauuuauaaaaugcuaaaauguauaaagauaguuguuaacaauauucaaacagcaugacguacuauagcaauaacaggaaauuuuagauacccauuacuuuugccaaaaccacauggaagucucaacaaaccuauggagaaaaaucuuaaacaaaaauaaaaguuccaauuaauguugauugcauucuuaccucauauacuuguuaauuuaagggauauguuuagguuauuauuuagcuauuucuaauuuuacuguaaaauucuugugaaauuuuuguuuaaaaaaaaguauuauauaguucuuaucuuugccggggcacagagcuaaggcuaucaucucuaaaucugauuaauguaugcaaacacacagaaugaaacuagcucagaauaucucuuuuaaucucccucugaaguagagugauuuugguaaaguuuucauuaucugcggaaacauuguuuaagccaaagcuauacaauuuccagcugaguugcucugaauuugaaacuuuaaguugacaaucuucgugcuuguuagcagcaggaucauuaauaucucgucucaauggcccagcccacacauauggaugaccacuagcaaguguaaugaucucaauauuuauuucucauucaguuggguuuccuuguauuugccacauuaguguuuacccuguuccuaauggcaaaauauucugucaucuccuugccuuuuauaaaguuuaauauacuuucucauuuuaaucuguccccacagaucucuagucaucacuguuuuuauuugaaugucucucaucccucucaacucuuuuacugcccaauuucugugauuccugaagacuucaacaaucaauacucucuuuuuuuguuuguuuuguuuuuuuuuuuugagacagagucucacucugucacccaggcuuggagugcaguggcgccaucucaacucacugcaaccuccgucuccugggcucaagcgauucucgugccucagccuccccaaguagcugggacuacagacaugcgccaccaagcccagcuauuuuuuagauuuuuaguagagacaggguuuuaccguguuggccaggcuggucucgaacucccaaccucaggugaucugccugccucaaccucccaaucaauacucuuucuagaauaaguaucagcacuuuuguuucucaccuuuucuccuuucuugguucucuuccuauaaaucccauaguuucagaccuuuuaaauuaggagagcucucuggggaaugugcuuaagguggagagcgauucuauacuaggcagguagaaaggaauauuccucagcugucuucaaaugauucauuaaggaaaagcaggguacagugauaggaccaugagauuuggaaacaaagaaagcuuuggggaaucacuccccugguucaagauuuccuuuaaagugaggaucuuggcggagguugaagugagccaagaucacaccgcugcacuccagccugggugauagagggagacugucucaaaaaauaaaaauaaaaaaauaaagugaggaucuuaguacugccugaaaggauuguugcaagcauugaauaacagugacaguggaguccucaguaaaugccaaguccugcauuccgcccugugaauccaucauuggagucuaguuaaauaugcucuggcucacagauccucugugcaauaacuucccuuuucuuuuuucuccagacauuacugguuauagaauuaccacaaccccuacaaacggccagcagggaaauucuuuggaagaagugguccaugcugaucagagcuccugcacuuuugauaaccugagucccggccuggaguacaaugucaguguuuacacugucaaggaugacaaggaaagugucccuaucucugauaccaucaucccagguaauagaaaaauaagcugcuauccugagagugacacuuccaauaagaguggggauuagcaucuuaauccccagaugcuuaagggugucaacuauauuugggauuuaauuccgaucucccagcugcacuuuccaaaaccaagaagucaaagcagcgauuuggacaaaugcuugcuguuaacacugcuuuacugucugugcuucacugggaugcuguguguugcagcgaguauguaauggaguggcagccauggcuuuaacucuguauugucugcucacauggaaguaugacuaaaacacugucacgugucuguacucaguacugauaggcucaaaguaauaugguaaaugcaucccaucaguacauuucugcccgauuuuacaauccauaucaauuuccaacagcugccuauaaaauaguuuugucccuguaugugagcacugaaacagcauuugguugacacaucuaguuuuucaucuugcaguuucaaauccuucuuuuugaaaauuggauuuuaaaaaaaagaaguaaaagucacaccuucaggguguucuuucuuguggcuugaaagacaacauugcaaaggccugucuaaggauaggcuuguuuguccauuggguuauaacauaaugaaagcauuggacagaucgugucccccuuuggacucuucaguagaaugcuuuuacuaacgcuaauuacauguuuugauuaugaaugaacuaaaauaguggcaauggccuuaaccuuaggccugucuuuccucagccugaaugugcuuuugaauggcacauuucacaccauacauucauaaugcauuagcguuauggccaugauguugucaugaguuuuguaugggagaaaaaaaaucaauuuaucacccauuuauuauuuuuuaaccuucuucaugcaagcuuauuuucuacuaaaacaguuuuggaauuauuaaaagcauugcugauacuuacuucagauauuaugucuaggcucuaagaaugguuuugacauccuaaacagccauaugauuuuuaggaaucugaacaguucaaauuguacccuuuaaggauguuuucaaaauguaaaaaauauauauauauauauauucccuaaaagaauauuccuguuuauucuucuagggaagcaaacuguucaugaugcuuaggaagucuuuucagagaauuuaaaacagauugcauauuaccaucauugcuuuaacauuccaccaauuuuacuacuaguaaccugauauacacugcuuuauuuuuuccucuuuuuuucccucuauuuuccuuuugccucccccucccuuugcuuuguaacucaauagaggugccccaacucacugaccuaagcuuuguugauauaaccgauucaagcaucggccugagguggaccccgcuaaacucuuccaccauuauuggguaccgcaucacaguaguugcggcaggagaagguaucccuauuuuugaagauuuuguggacuccucaguaggauacuacacagucacagggcuggagccgggcauugacuaugauaucagcguuaucacucucauuaauggcggcgagagugccccuacuacacugacacaacaaacgggugaauuuugaaaacuucugcguuugagacauagaugguguugcaugcugccaccaguuacuccgguuaaauauggauguuucaugggggaagucagcaauuggccaaagauucagauaggguggauuggggggauaaggaaucaaaugcaucugcuaaacugauuggagaaaaacacaugcaaguauucuucaguacacucucauuuaaaccacaaguagauauaaagcuagagaaauacagaugucugcucuguuaaauauaaaauagcaaauguucauucaauuugaagaccuagaauuuuucgucuuaaauaccaaacacgaauaccaaauugcguaaguaccaauuaauuauaagaaauauaucaccaaaauguaccaucaugaucuuccuucuacccuuugauaaacucuaccaugcuccuucuuuguagcuaaaaacccaucaaaauuuaggguagaguggaugggcauuguuuugagguaggagaaaaguaaacuugggagcauucuagguuuuguugcugucacuagguaaagaaacaccucuuuaaccacagucuggggacaagcaugcaacauuuuaaagguucucugcugugcaugggaaaagaaacaugcugagaaccaauuugcaugaacauguucacuuguaaguagaauucacugaauggaacuguagcucuagauaucucacauggggggaaguuuaggacccucuugucuuuuugucugugugcauguauuucuuuguaaaguacugcuauguuucucuuugcuguguggcaacuuaagccucuucggccugggauaaaauaaucugcagugguauuaauaauguacauaaagucaacauauuugaaaguagauuaaaauuuuuuuuaaauauaucaaugauggcaaaaagguuaaagggggccuaacaguacuguguguaguguuuuauuuuuaacaguaguacacuauaacuuaaaauagacuuagauuagacuguuugcaugauuaugauucuguuuccuuuaugcaugaaauauugauuuuaccuuuccagcuacuucguuagcuuuaauuuuaaaauuacauuaacugagucuuccuucuuguucgaaaccagcuguuccuccucccacugaccugcgauucaccaacauugguccagacaccaugcgugucaccugggcuccacccccauccauugauuuaaccaacuuccuggugcguuacucaccugugaaaaaugaggaagauguugcagaguugucaauuucuccuucagacaaugcaguggucuuaacaaguaagcaguugaauguaucuguuccauaaauauuaaccuagagcauagcaaaugaauucuaaauucucaaguaggaggagcuaagagcaagagagcugcaaccaagcuacaaacuaaacucugaauucaaugcacagcuccauuaauuuugaaagauguaauguuuguugcuaucuuaauauacuuuugauaucuacagcuuuaaaaaaaucauaguggaaaaacaccugcaggaaaguuccaugacuucaaacaaauucugcuucuaaauaagcacguaaaaauaagugaauaucaagagaaauuauaugacuaaaucuaaaucuuuagagaaaaaaaugagaacugaaaauagugucaccauaugugcuuuauucucauuuuuauaaaaaaagugucagcaguugauugauuuaggauuugaauacuuagaaaagugacugauuguuuggucuagauuagaauguuguugugaagagagucagaaguuuaauuuguacuucaaaaagaaucuguuagaaggauuucucagaagacugagagcuuagaaaaaaaacugacauuaaauaaauaacaacaauuuauggaaauugucucuuucuagucccaaccauuauagaauagacaucuuuuguuaaagaauaaaacaguaggcugcaagauggugcuguguuucacauaaacagugcuuuuuauuauuuucacuguaauagucaaauauauaacaacagcaaaagauucuacauaagggaaaaauagcuuacauuuagguacauuaccaaguauuagucugaaaacaucuaccuuucaaacauaauuuagauaaugaaacacaaagaagagcagcucagcgugaccauaaucuugguuucuuacuuuguggcugagggcaagaauaucuuuauauuggcauauccaccaccccagggcuguugcuucuguucuagagcacccuggaaucacuaauuacagcaucacccaguauacaagccccugcaucacaaugucugucccuuagccguagaccugucacaugcuaaucauguguucuaagaccuuauuauaauccuaaugcuacagaugaccucaggguagccccucucccuccuagcaaagucauuauuauccucuuuuaaagaugaagcaaaccagugcaguggcucucgccuguauaaucccagcacuuugggaggcugaggugggccaauugcuugagcccaggaguucgagaccagccugggcaacacagugagaccaagucucuacaaaaaauacaaaaauuagccgggcaugguggugcacaccuguggucucagcuauguaggaaguugagguaggaggaucaccugagccuggggagguugaggcugcagcaagccaugaucgugccacugcacuccagccugggugacagagugagacccugucucaaaaaaauaaacaaacaaauaaacaugaagccgucgagguccccagcaguuaaguaaauugccacuggccagcuaguaugguggaaauggaauccaggcaucugguccuccauucuggcacuuuuccaaacuuuuguagggggcuuuauagaaacgcugaagggcaaauggugugcaggggaaugaggguuuagugaguaggaguuccaaauuuagaaaccucacucucuguaucuuuuagauauacaaauauuuaccauauauuacaguugccucuaguguucaguacaguaacaugcugcacaggcucauagccuaggagcaauaggcuagaccacauagcuuauagcuuaggugugucaaaggcucuaccaucuagguuuuuuguuuuguuuuguuuuguuuuguuuuugagacggagucucccucuguugcccaggauggagugcaguggcacgaucugggcucacugcaaccuccaccaccaaggcucaagugauucuccugccucagccucccgaguagcugggauuacaggcgugagccaccacgcccagcuaauuuuuuuguauuuuuaguagacgagggguuucaccauguuggccaggcugguuucaaacuccugaccucaagugauccacccuccucggccucccaaagugcugggauuacaagcccaucuagguuuguguagguacacucuaugaugcuuacacaauaaaaucaccaaaucacacacuuaucaaaauguaucuccaccauuaagcuaugccugacuguguaucaaaauggaagaagaagcugggcacaguggcucacgccuguaaucccagcacuuugagaggccaaggcggguggaucacaaggucaggauuuccaguccaagccugguuaacacggugaagccccgucucuauuaaaaauacaaaaauuagccaggcaugguggcaggcaccuguaaucccagcuacucaggagucugaggcaggagaaucacuugaacccaggaggcagagguuucagugagccaagaucacaccacugcacuccggccugggcaacagaguaaaaccucgucaaaaagaaaaaauaauaaaaauaaaaaaaaauggaacaagauacucagggauguauauuuaauuuuuuaaaaaauauucugcucucauuuuaauauggcagaaccgauugcuuucuaaguguggcuuuuuuccaguaaagguuaauuauuaagaccacuaguccuggccugggucaaucccaguaugauccugggcaaguaaauuaaagaagauaacuucucugugccucaguuuuuuuuuguuuuguuuuuuguuuuuucauuuacaaaauggagauaauuguaguaaaucaaauuuuuagaggugauagguuuguucauuucuugaaugcggugauggucucccaagucacacauauguaaaaacccaucacuuuaaagauaugcaguacguuguaugacaagaaauugcuuuuaaaaggagcaaacuaccuuccaggguuguugugaggcauaaauggcaauccacagcaccacagcaaggauuaucaugugcccuccagagacauacucucagguggaugcgagaaauauccagcuguugcagcaacuucaucccacucgaaauccagcugagucacacucacagguggaauggagggcuucgagaggccauggggcaaggugacccuuccuuaucaucuaauuacagaccuucucaaggucuguucacugaacacuucgcuguaguguucacuuagguguaaguaggcuauaggacuggacauuuggauauuucaucaguucaaauaguccugggcgugcuuuaguuucucaugcuuuugagcagaguuuuaaaauaagccccauuugccccuacagaucuccugccugguacagaauauguagugagugucuccagugucuacgaacaacaugagagcacaccucuuagaggaagacagaaaacaggugagugguguuggcaguaugacuauccaguagcuuuugccuaucaauucuguauaacaaaugaaaugcuacuucuaaaaauacaucuccauuuuuuguugucaugguguguguaccuuugucaucacaguaugauuuuaucgcuggucucaaaaacuaaaagauaccuuacucaacaaucaccuagacuuucagucacuaacaaauuaagaaauuuguugucuguccuuuuaaaaaacauuuucuaagaagaucuuuguuauuuagauuuagcagacauuccuuuucauuaggcagcucugucuaauggcugacccaacacucauugucaucuauuugucuuccuuuacuaagccagcaaguuuacauuuucuuuuuacuuaauaaaauaugcauuuacuagaaggaaguugaauugaaucucauaaauauuacauacuuaaauaugaaugcuuuuaauuuuuucuuucaaaagguacacuuuaguguauucauuaauuuauuuauaguccacuugcuuccaaaaaggacuuaugauaucuuaguuugguuucuuauugaaaagaacuaguaaaugcuguaacugaaacagaaauuugcuggaagucccagagacuaagugauuugaauuugcaacaaacucugaauuuuugugcauuuuugaaaaaugcauuuuucaaaacugucaauucacgaggaauuaucagcauuguaauuugucugggauaaugucuuuaguuucagaaaguuuuguguuuggcaucauuaccacucuguugacauauaaauuuccucuugagcuuaggaggcuucucugagagucaaacauuuacuuugagagugggcagaucuugcuuuacuuggaaggauacacuuacaggauagaaacacagaauacuugaacacugaagaauuugaaaaugucaauucucagaagaucuugaacacuuaucuccaaaugugacacagaaacuuacuguaauaaccccuaaaaucugcuugaauuacuuagcacaagaaaaaaaugaaugcuugagcuggcuauuuugaauugagucaauuuaagauuuuaaaauucauauguagcuuagaaucaguacaucuuacucuuugguuuauggcaaaucaugguauugaugagacaggaacgaaauguuggauguacguuaauuuccccuacaccuuccucacuuccuaaacugguggugucuuuucuuuuuuuuuucucuuccucccccgggugggaaaaacaggucuugauuccccaacuggcauugacuuuucugauauuacugccaacucuuuuacugugcacuggauugcuccucgagccaccaucacuggcuacaggauccgccaucaucccgagcacuucagugggagaccucgagaagaucgggugccccacucucggaauuccaucacccucaccaaccucacuccaggcacagaguauguggucagcaucguugcucuuaauggcagagaggaaagucccuuauugauuggccaacaaucaacagguaacuuuucuugucugcaaagaaacucagaagacuuuccuacccaguugguagauucuguaaaguagcuugcuguugucugucaucagcucucaaaaaaaaaaaaaaaaaaaaaaaaaauagaucauugucaugguacauggagagggaagugagaaaauguggagaaacaucuuccuuagaauaugguaaagaagcccgggcgugguggcaguaaagaagauaauuuuuuuccucucaagaaauuucucaccugauuuggguauuuaugcauuucuaauaacacaaguuuuguugaaaauguagaaaauuggccggacgggguggcucacgucaguaaucucagcacuuugggaggccgaaaugggcagaucacuugaggucagaaguucaagaccagccuggccaacauagugaaaccccaucucuacuaaauauacaaaaauuagcaaggugugguggcaugcaccuguaaucccagcuacuggggaggcugaggcaggagaaucuuugaaccugggaggcgaagguugcagugagcugagaucaggccauugcacuccaaccugggugacagagcaagacccugucucaaaaaaaaaaaaaaaaaaagggccaggcgcaauggcucacgcuuguaaucccagcacuuugggaggccaaggcggguggaucacgaggucaagagaucgagaccauccuggccaacaugaugaaaccucgucucuacuaaaaauacaaaaauuagcugggcgugguggcaugcaccuguagucccagcuacucaggaggcugaggcaggagaauugcuugaacccaggaggcggagguugcaguaagccaagauugugucacugcacuccagccuggugacagagggagacucugucucaaaaaaaaaaaaaaaaaagguggaaaacugaacacuguuucaaaguaccuuuaaaaauauaauuuuaggguaauagugucauuguucuuagcagauagaggcugaaguacuuacgggaacaguagcaucauguuaucuguauuuuagucucaagucgucaagccagagacaaauaccuaagggaaggguauauagguguucauuguauuacuuuuuuuuuuuuuuuuuucuuccugaaauggagucuugcucugucgcccaggcuggagugcaauggugggaucuuggcucacugcaaccucugccucccaggcucgagcaauucucuugccucagccucccaaguagcugggacuacaggugcccgccaccacgcccggcuaauuuuuguauuuuuaguagagaugggauuuuaccauguuggccaggcugguuuugaacuccugaccucaaaugauccacccgccucggccucccaaagugcugggauuacaggcgugagccaccacgcccggccuuguaucacuuuuuuuuuuuuuuuuuuuuuuaacuuuucuguaguuuugaaauuuuuccaaauaaaauguugagggaaaaaaacucuuccccaaauuugaaauaaucauuuuaucacaauuugaaugggcucuguaaccccuuaucuugaauucgucauaauauaaaauucugcuaauuacacguaguauuuacaugauuguauggaagaaucauuaagacaauuaucuggaaaaugaacaaacaguaaaucugaauauuguuugaaaauuacggaugugaaaaguuucccuuuuuuuucuaguuucugauguuccgagggaccuggaaguuguugcugcgacccccaccagccuacugaucagcugggaugcuccugcugucacagugagauauuacaggaucacuuacggagagacagguacagcaguaaaaugcuauuuuacacucugauuaaaucagauucuguuguggauaaccugaaagcccaacagugaacaaagaauuaaagaaacuuuggcaaguccauucaacggagcccuuguuuuuuccaagaaaauacguaagauauagaugauauaauuuguucuaaaacccaaauaaaaaguuguuuauauacuacaacuagagggggaacggcagagcugaggaaauaaaaggauuguaaauucacaaacauauuaucagugguggaaauaagugauuuuuauuuuuucuucucuuuacuuuucuguauuuuccaaauuuuauuuaaaaggaauguauucuguuaaaaguuuuaaaaaggacacaaugcaugcaauccuggguugagggcuuaccuucucccacuucuaaugcuacucuacuacucagugacauuuuaaagcugaaauguuaaaacagcgcuaacuguaauuuucucucaauguuuauacacuuaccaagguuugcuacaugcauaaauaccccuuucuguucaagauagcgcucuuuaaaagggaauaagcaagaagaugugauuuacaugcugcuauaaaugugguaauucaauuaaucaguaauacccaaguagcucuaaaccccucacacucugaacuaacccuuuuucauacaggaggaaauagcccuguccaggaguucacugugccugggagcaagucuacagcuaccaucagcggccuuaaaccuggaguugauuauaccaucacuguguaugcugucacuggccguggagacagccccgcaagcagcaagccaauuuccauuaauuaccgaacagguacaaacuucuacucuggggugacaccagcuuuuacuuauucagauacuguuuugcaauguucucccaagguauuuuucuaauuguagaauagauuuuccuuuuuaaugagcaacaaccugcagcuagcaccugcagcgaacagaguuuugagccagauaaagaaggaagcaccccaagggcaggaaguucagucaguuuugucgauauauuccgcaugucugcaauacgacaggcauagagaguguucaguaaguauuugugggaaaagaauggaugaguugauaaaguaggaagagacaccugcuuguggaauguagcuucuuugugaaugaagcaaccaucucaaaaauaggaaaugguauugagaugccugccccaucccucuaaaagcucucucuguauucuuucgagaagaaauaccuuucucauguaagcgaucauucgaauauguaccagaccuagagaggaggacuuguccaaucuugucuccaaggacuggggcuucacugguuucucccugcuuuuauuuguagaaauugacaaaccaucccagaugcaagugaccgauguucaggacaacagcauuagugucaaguggcugccuucaaguuccccuguuacugguuacagaguaaccaccacucccaaaaauggaccaggaccaacaaaaacuaaaacugcagguccagguaagaaucaucugcaucucggccaggugcgguggcucacuccuauaaucccagaacuuugggaggcugaugcgggcagaucacuugagguuaggaguucgagaccagccuggccaauauggcgaaaccccgucuguacuaaaaaauacaaaaaaauuagcugggcaugguggcuugugccuguaaucccagcuacucaggaggcugaggcaggagaauggcuugaagucuggaggcagagguugcagugagccaagauagccccacugcacuccagccugggugacagagugagagacuccaucucagggaaaaaaaaaaaaaaagaguaaucugcaucucauauacaacaggauagaugggguaggaccaccuaauauucuuuuuuauauaaauggcuaccuuguugugaguacuauguauuuuuuuguccuaugucaucauuguccccauucaugaguucagggcucaagaucauuaucaacccuuuucacaguagaagucuuaagugcauuucuguuuuuacauggauaguucuauuuagugauauggacaucuuaaauuacuagauucacccuucugguuuuguuuaucauucacacuaagaagagauaaauggccuaacugacuuuuucagcucuuuuuagcuauguugucuuuguuuuuaaauagaauacuugugaaauuaggaucuuaaggcaauuuauuagagucaaguuaauuuucauuuuuucugagagcaguaucacuaauuguugggggcaucauauuaaguuuuagaucuuauccuugagugugacuucacucccauaugguaauuuguauuagcaaugaacagguuuguccaagaggaaaucaaagucugacucuccauauuuuuguuacaauucugcaaauaaaaauucuaggccaccauauguuuacuaccaaacucuagacgccacuugaggacuuuauaguggaugacguggauguugcauuugcuuuucacucccuuugcagaucaaacagaaaugacuauugaaggcuugcagcccacaguggaguaugugguuagugucuaugcucagaauccaagcggagagagucagccucugguucagacugcaguaaccaguacguaaccacugcuugguuuccauuuucaaagucaaauuuuguucuugggugucugaaugcccacgacaugucuuuugcaauuacacauagggaaagugaacuuguugguuaguuuaugucuugagcugagcccuuuacgaacaucuuuuuuccuucucagugccaagcgaggaauuuacagagaaagaaguugugaaaccaccauaguuaguugcugugcuuugaauuucuuuugcucaaauggccucagcgaaaucuuauuugccuauagcaaaucuacaaaaaauuuuccuagaccgucuuuucuacaacuggaugguaaaguugauugaagugugccucauguagcuuuauguuuggggcauuugaagggcuauggcuggaccagaguguaauauaaaugcuuaauagagaggggaaaagaagaguguaagaaccauuauagggcugggcucacgccuguaaucccagcauuuugggaggcugaggcaggcggaucacgaggucaggaguucgagaccagccugaccaacauggugaaaccccaucucuacuaaaaauacaaaaauuagccagucgcgguggcacgugccuguaaucccagcuacucaggaggcugaggcagaagaaucacuuggacccaggaggcagaaguugcagugagccaagaucaugccucugcaccccagccuaggugauagagugagacuccaucucaaaaaaaaacaaaacaaaacaauuauaacaauuugaaucugacauugcaaaucagcuuuaccacuuccaagguauagaaaauccaggucuaugagacuaacaucacauuguaaaaaucaaaucgugguagaauaucuuuaaauuaauauaaauacauccccauuguggggacauuuugcaggguaucugcuuaucucacauacaccuauguuuuaauaagugaugcaacauugcauauuuucuaaaccaagaaaaauuaagcaaguguuuaagugauuuuuccuuuugauaguggguuaauuggacuucaucaaagaaaaugguaucugcaaaacugcuuugcauguuauaaaaaugcuuauuucacaacuugcuuuucacauaaccucuuaccauuaauuugccuaacagacauugaucgcccuaaaggacuggcauucacugauguggaugucgauuccaucaaaauugcuugggaaagcccacaggggcaaguuuccagguacagggugaccuacucgagcccugaggauggaauccaugagcuauucccugcaccugauggugaagaagacacugcagagcugcaaggccucagaccggguucugaguacacagucagugugguugccuugcacgaugauauggagagccagccccugauuggaacccaguccacagguauaugguuaauugcaccaccaggugcccaugggagcagcggcuuuaugcccuacugaaugaauuaugcuucacugggcuauugauucccguguaagggugaaaaagaauuauuaggaaagauccucuuuaaagaggaaugguaagaaacaauaaaacuuaggugauauuuaaggaaacaagucugauuaaaagaaauuuuggaguauccuggcuuauacacaagaccauaaagcaagacauuugaagaggauacuaaaguuguggauuauuuccuaagcucugacucccugugauuacccucacuauguauaaagaaaagaaguuuggcauuacagagcuuacuuauaaaaaggaacccaaacucgggcauuucauagcagcaugauucugagcacacguggguaagaccuuucuucucugguuagauaucauaugcugguguauaauuagcuuaaaugauugugauuuagacaccuaggaaauaaucaauagggcaauugcuuuccauaauacuuuaucuucuugugcuuuauuucugaagcagaguagaaugcuaaagauguauccuagugacagcauaaacccuagaggugacagucuguauuauugcuuuucgcuucucuuuucugcuucuguugggagccaguuuucuucuuacgccgcauuacagagagaacgucaaauuuagcagccauaucugccauaggguccaaauaaagagacaauaaaaacauuauucucucuuuuuuggauggaauacugcgugaaaugguuauccauacaaagauacuuuauguagaauagaaaaaggaggccgggugcaguggcucacacauguaauccuagugcuuugggaggcuaagccgggagcacugauugaggccaggaguucaugaucagccugggcaaugaagugagaccccgucucuacaaaaaaauaugaaaaaauuagcgagguguggugacacaugccuguagucccagcuacucaagaggcugagguagaggaucacuugagccuacgaguucaaggcugcagugagcuaugauaacuccacugcacugccgccuggaugacacagagagaccguuucuaaauuaauuaauuaacaauuuuaagaaagaaaaagggccauugcuuauuuuuccauacaaaaguaaaauaaaucauaauggccaauaagccaauguaacuuuuuuuuuuaagggaaagcaaaacuuguaaaaccuaaaaucucuuagaguuuuggcauuuacccaaauguuuucagugauucugagaauugguggauauaaaacacauuucucagcaaacacuuucuucauuuugcaucccuuacuguacguacuuucuuguacugaaucuuugcuugaccagggaacccaccuagcccaacaagaacaauccauucuacuucuuggaacucacuuuauuuuccuuuucccccauuuccuauaagauaaccucuaaccaaugacaaucucgacagcuauuccugcaccaacugaccugaaguucacucaggucacacccacaagccugagcgcccaguggacaccacccaauguucagcucacuggauaucgagugcgggugacccccaaggagaagaccggaccaaugaaagaaaucaaccuugcuccugacagcucauccgugguuguaucaggacuuaugguaagacaugaccguuguucauuggaauaaagauggagaucaucucuaacacaguuucuaagguggugaaaauauaauaucauaauaaaucuaacuguucuuuuccucugcaucaaauaaucuuauuguaauuuuauaucaacggaauuccuuuauguugaccuaaguuuuccagaugacuauugggacagaauuuuauaaauagcuuuggauuuugugcagcucuuuuagauguauugugcuuauuuuaaaagguuguggggggcaauuuacauauccauugguugaaugcauaaaucgacuuaguuaugcauuuucugagcucuguuaccuugguaaagaauauuuuacaguuuguaccagucuaccuugagccuacccucauuaaaacauuuuaaaauccuuccagacauacaugcagaaaacugcuaggaaccuaggggacugauguaccucuuaacauaaggccaauuucaggggaaacuacagaaagaggguucagagacaaaauggaacauucucuuugccucucuaugauaaggaaaaaauuaugauuuacaccugucagaucauaaaaaagaaaaauacgcuaauacccacuuuucucauuuuuuuuaccagcuuaguuuaaguauauaaucuauggcuuacuuaagcuuaaccgcuaagagcauuuuaaaauugauaaauacauuuaucaccugcacuguaggaaugaaauuaaucuaggaauuuucaagguuguggguuuugcugguuuguuuauuuuuuauuuucuaaccauugcauuuaccuaaugcuguagugaaacuccuuggguuucaguugaggacguugcuaaagcucaccaugcccuuauuucucuagguggccaccaaauaugaagugagugucuaugcucuuaaggacacuuugacaagcagaccagcucagggaguugucaccacucuggagaguaaguaacaaaaugucuucauauggacaaaccuucuguauagacaaaaauuaaagaaugguaaaucagugggguucaguggcucaugucuaaaauccaagcacuuugggaagcugaggcgggagcgucacuugaggccaggaguuugagaccuacccgggcaaauagcaaggcccugucucuuaaaaaaaauaaaauaaauaaaauaaauaauuuuuuagauuuauauguuaacaguggaaugaguccuaauuugaaaaucaauuugauugccuuuuugacgcaugacugucaucuuuuauacuccuucagaaaggggucuacugacccauaaaauggaaucacuucauaagcuuauaauguugauauuauggacuaugacugacaucuaguuuaugcucuacuuguuagaauuuguuuucauagagcuaagcuuggggagaccccacuggcuucugcuauaucuuaacaaugcauauuaggccauucuugcauuacuauaaagaaauaccggagacuggguaauuucuaaagaaaagaggcuuaauuggcccacaggccagcaggcuuuacaggaagcauggugcugguaucuucuuggcuucuagggaggccuugggaagcuuacucaugguggaaggccaagggggagcaggcacaucacauggcuguggcaaaagcaagaccgagagagagagagaguuggggggggaggaccuuauacauuuaaaugacccagucucuugagaacucacugucauaaagagggcaccaagccacaagggaucugcccccaugauccaaacaccucucaccaggccccaccuccagcauuggagauuacaacucaacagagauuuggacagggacaaauauccaaauuauaucacagcacaguaaccauuggaccaaaucaggcuuagauucuagucuucuguuauaucaauaccuugauguaugccuuuucaaaagucagguaaagugucaaaguuuuaucauuuauaaaagagggauggcauuguaccuguugagagaaaauacaaaauacuugccguaauauuagacacacacacacacacacacacacacacacucucucucucucucacacacacauacacacacacacacacaaaauuguuagcuggccauguuauuguaacuccuaccacacauauuuuuacauuauaauacauuaauaauuuuaauauuuauugaaguauuuguagauacuauaaagccagcccugggaaccacugguaguaucuauaaagcuuuucagcucuucaaaauaaaaugucugagagguagauauuuuccuauuuucuaauuacaguugaccuuucucucugaaugccaaaggagauaaucuacacauuacuaguuauauauuucuugaaauggaugaauuugauauauaccaaggaaacguuuuaaaauaccaaaacuuuacauggaugagccaagcaggcacuaaucucuagcuaugcuccugugcagaugucagcccaccaagaagggcucgugugacagaugcuacugagaccaccaucaccauuagcuggagaaccaagacugagacgaucacuggcuuccaaguugaugccguuccagccaauggccagacuccaauccagagaaccaucaagccagaugucagaagcuacaccaucacaggucagggaacucauugcacuaaccacauuuguuaacaaauacccacaauguaaacgggcuuauuaacuguucuacgacugacacugauaaaauuuauuuucaguguuaucaucauaacccaguuuuagaacguuauuuucaugcuaugaucagaaauaguuuuguccuuugaaugccugauuuuguguaauauuugucauggaaauugcguaagugucaaucaacaaguuugaucuuccaucauugugcccuuucuuauuuaaaaaauuguaacauaagguuuaaaacuaaaagaaauaaaaaacagugauguauagaucuuagcauuaaaaagcauaguuaauauaaaaguaaacaauaccacuuaauaaaggccaaaauuguaaccgaagaauauucaauaucugaggucuuuuuuagcuuuuuaaaauugugauuccaaggcucaacuauugaccaucugauuacgguaaagagaaaaccucaauaaguggcugacccccauucugcaagagggccucuuccaacauagcauuuuugcauuccagaauuuacuuuaccaguguccuugucuguaucagugauucacuuucgagauauguuucuuguuaacaguuaacauccauagcaugcucuacuuuacuguucaaauguggaccacuuugguagucuauauaaauaugggaugauagaagaacccagaaaaauugcaggcuagcuugagaauucuccuaguaaaaagcaagaacuguuaaaaaucaucucuucucaaaucccagguuuacaaccaggcacugacuacaagaucuaccuguacaccuugaaugacaaugcucggagcuccccuguggucaucgacgccuccacugguaacuauaccuucuacugaggaaaugccauugacuuguaugcaaucaguuucaugaacucaaaaaacaaaugugaggcguauauuuuuguauuauagauuccagagaaucuuguuuccgguuuacaguauucucagauucuuuuaaguguguuuagaacggcucgggagaaaagugugggaguaauuuucuugguuauuugccuucuuagagacuuaauuuuguuuucuuucagccauugaugcaccauccaaccugcguuuccuggccaccacacccaauuccuugcugguaucauggcagccgccacgugccaggauuaccggcuacaucaucaaguaugagaagccugggucuccucccagagaaguggucccucggccccgcccuggugucacagaggcuacuauuacugguauugcugcuuccaugcugucauuuuccuucuuacuaccuaggacacaugaaguccuuagcaaacucccacagcgucuuugauacugugucaugagaaugcgaaacucuguuccugauaaccucaaaaagcauucucuguguaggagugguagagccuaauacaucccaaaaggcaugagugaaggaaaaugcaauuucaagacuguacuaauggcaugacuagacucauguuuuccuuucgcugcaaguuugccagauaccugucaauucaguccuggagaaagauauuuuucaaagcauacuagcugauugugauucugucauuacacucagcucucuauagauauggcaaucuugcaggacuugccagugcaccaccugccauugaccuuguugaccacuaucacaggauaggucuugaggcagagcagucccaaccacccacauuggaagaaugccuggaauggggaauaagaguugucuaccuuggugggaaagacuauaagccucuaguauuauuuuugcccaagagaugaaauauuuaaacuaucuguauuagucuguuuucauacugcuauaaagagguuuaauugacucacaguuccgcauggcuggggaggccucagaaaauguacaaucaugguggaaggaaaagcaggcaugucuuacauggcagcaggagagagaagcacacaggaggaacuuccagauacuuacaaaacuaucagaucuugugagaacucacuaucaugagaacagccugggggaaccaccccaugauccaaucaccuccucuccucaauacauggggauuacaauuccagaugagauuuggaugcagacacagagccaaaccauaucagucuguauagaguaucaccuggacuuuaaaauucccacagaacauacagacauuagaaggagacacuggcuuuuuagaauuggggggaacaggaaaauagaagcagacaugagaggaauugaacuagacacuucccacagaggcugcacaaacacuggccaaucucuccuacccuucacuugccuuuaguuucacuuuucauugaucugccacugaggacugcuugguuauuaggccuaaguagauucauguauauaaucugcaggacucucuuucaaauuuauauuccaguggugguauaugaugcugauagauuuucuuaaauucaaaaaggcaaauaagaccacguuaaaagaauacccuggaaaggccaggcgcgguggcucacgccuguaaucccagcacuuugggaggccgaggcaggcagaucacaaggucaggagaucgagaccauccuggcuaacacggugaaaccccaucucuacuaaaaauacaaaaacaaaauuagccaggcguggugaugggugccuguagucccagcuacucggguggcugaggcaggagaauggcugaaccugggaagcggagcuugcagugagccgagauagcaccacugcacuccagccugggugacagagccagacuccaucucaaaaaaaaaaaaaaaaaaaaaaaaaagaauacccuggaaaaguuagccaaaaaaugucuauucaggcgucagauaugauaguaagauaauuaguuugcgaugcggacuuuauaugcaggauauuuggguguuuauggaggaaaagugaagucgauuuuaccuucaagaggccaacagccagcuggagaggaagugccugcucccaguagcgucugcuggugagaccgacuuccacuugacuagcugagcccauugacauaaugugaugguucuauucucccuucaggccuggaaccgggaaccgaauauacaauuuaugucauugcccugaagaauaaucagaagagcgagccccugauuggaaggaaaaagacagguaagaguaucuugcagguaacaaggagaaagauaggacaaaacuaauaacaaaugagcaaucuugcaauaugaaaagguucuccauguuuugaugcauuucuugugauuuuuuuuaucuaacagcauaguguauauauuguauucuuuaauaggagaaauaauuuaacaugcacugcagaguuugguuuuauuuuuuuucuuuacuacagccacucaauauaaagccuuguuauucaccuuuuaaaaauucaaacaagauguuaaaauguaaaagaagagcuaucauugcucuucuuuuauaccuucuguugaauuuuaaaauguuuccuuuuuuaaaggagggagagaaaccucucacauuuaucuuuauuugguuucuacaacuuagagcuaaauaaugucuuacuuuugcauccaguuucaguuaauuucaagaaaauguguauuccugauauaggaaaauuucaaaaaugaacauguguguuuuaucuauuuuuaccauuucaaaccaugaaaaacuguugagccaaaccucuguaauucucauacuuaugacacugauaugauuagucuggauucuacuuccuacaacuugcuucucaaauuuaaaaaagaaagagagaaagagaaagacugcacauuucaguuccauuaggucuaauuugagcagaggcagcuucuacggggcucagcgguuuaaagcuguguguaugauaaauucauacuaacacuuuuuucuuucuaaacuauaaagaaaccuuugagaaaaauccuaaagauuucuuucuggaaaaaguguuuugugaucucagaacugcucauuuucugguggcuuuuaucaaauugaugaacagucauuguugccugaaucgauuauuaucauugcugcuacuuccuggagcuuaaugcgcuuugcuuuuuuggcucuaaccucucucggcuagacgagcuuccccaacugguaacccuuccacaccccaaucuucauggaccagagaucuuggauguuccuuccacaguucaaaagaccccuuucgucacccacccuggguaugacacuggaaaugguauucagcuuccuggcacuucuggucagcaacccaguguugggcaacaaaugaucuuugaggaacaugguuuuaggcggaccacaccgcccacaacggccacccccauaaggcauaggccaagaccauacccgccgaauguaggugaggaaauccaaauuggucacauccccagggaagauguagacuaucaccuguacccacacgguccgggacucaauccaaaugccucuacaggacaagaagcucucucucagacaaccaucucaugggccccauuccaggacacuucugaguacaucauuucaugucauccuguuggcacugaugaagaacccuuacagguaauuaauuguucucuucacuucucauggggcagcacagaaaggaauaaguuagguaacugaagugaccagcccucgaauaaaaaguggcuucauggccgggugugauggcucacgccuguaaucccagcacuuugggaggccgaggcagguggaucauuugagguuaggaguucaagaccagccuggccaacauggugaaaccucgucucuugaaaaaaaaaaaaaaaaaaaaguggcuccacuuuuagaaccucuuagaagauggcacauuuaagcccugcuuuuuuuuuuuuuuaaaucccaauauggcucuacuuuggaggacauaccagagagucacuagcuuuuauuucauagagaaaaugaaacuauuucucuuauucucacacauuugagguuccuuuuugaguaagauagaugauucuagaaaagaaagauauucuaccugaauuuccauuugugugcagaagucuaaaacacuaccuuuacgauuuguccuugaagaaccccacuaucuacaacauaucuaaagaaaaaaaaaaacaggcgaagcugugcauagcagcugauaagugauugauucucuaaaacguauauuauuuaauuuguguugacaguauccauuuuuuuuuuuccccgagauggagucuugcucuauggcccuggcuggagugcaguggcgugaucucggcucacugcaaccucugccucccagguucaagcaauucuccugccucagccucccaaauagcugggauuacaggcaugugccaccgcacccagcuaauuuuuguauuuuuaguagagacgggguuucacgauguuggccaggauggucucgaucuccugaccucgugauccgcccgccuuggccucccaaagugcugggacuacaagcaugagccacccacuacacccggcccacugacaguaucaauuuuuauuguguuguuacuuuuagaaaguggcagaauuuaaaaacugacaacacuguaggaaauuuaugagcuuagaaacaugaguuugaggauuugcccaacuguuuuaaggacuccacacuggggucagaugucaccuggaggagcaugaccgugucucccauauagcgcaguguccagguuuuaugugaagcaaacauggccagggcuuccagagggcuuaugcagaccugcgacugaagcaagaucaauggcaggccgucucuaguauugucgagggcuccuguuaacuacggagcacguagguagauuguuggcaggaaaaucuggcaggaacgauggccccuauccuuguuccauuucucuccucagcugguuaggaccacuauacccucccucuuuuuuuuuuuuuuguuuuuuguuuuuugucuuccuuugcuuuguuuaaacagugaggguuauugguaagaggagagcccgugucauuccucacuauaaugcuuucucucugcuuuggauguaccgauaauugcaguucaggguuccuggaacuucuaccagugccacucugacaggccucaccagaggugccaccuacaacgucauaguggaggcacugaaagaccagcagaggcauaagguucgggaagagguuguuaccgugggcaacucugguauguaaacacguacuauuuagacacaggcuccccucugcuguacaccagagaugggcuuuucuguugacuguaccuuuguugccauugucuuuuuaucuuugggauuuaaugcaacacaucaacaugaaauaaaugagcaacuuuauauuaaauuaaucucucccccaccuccugccauauccuguugucuucacaaaaugcauacguaauugacagacucucaaauggugauaugauuauagaucuggaagggauuucaaauauuauuuaguacaacacucugaguccuuacuucugaguaucugaguugauauagggcacagguuuccugaugucuuuucccagacccucuccaucucaccaugcugcuguccucuugagugauuaaauacugaaacgauuaccuauaaagaaaauaccccuucugcagacauggggacaguuggcuuuugcuccugauauaaaaugcuaccaacauugugcauuucugucugcagagaauguuauuccaauguuauuuccauuuuuuuccaauguuauuuccauuuuuuuuucugacuauacagguuaaaagcuucuauagagguuaaaagaucauuaacucuucuuuguagcaccugggaaauccuuuuaaaucaauagcgugccaccuggcugcucaauuugcagcagcugaaaauucaccaaggcacaugagauaggggauaaucaaaaccgugaauccccaaucuuccaacaggagaguucucuacuccacaccaacagagagugcuaaguccugucuaugccaagugacagauuuuauuccuaaggccaguuguuuaauuuuagccccuucccucaucugauagaagacugugcuacuuuacauguauaaauuccugugaauuaagcaguugagcauuuggcuggagagagguugggaggagauuauuuuguguuuguuguauuacauauccacaguaaugcuuaucuuugccuuuugugguuuuacuaguagaaugccacgugaacagaauuuucaagagcaaaaaggucuuugugcuuuucuaagucauuuuuuuuuuuuuuuuuuaaagauuccaucucuuuaacuuuaguuaggauggaauuugaacuccuggcucuuuugaguauagaaaccccuaguaacaauuuaaguuccuuccauuuuucuuuuaaacuccuuauucccagcagcaguauucuacauucuaaccagguucucccagcuuugagacgucucagacuuaccaguucuccaaaacgcuauuuucuuuaagggugacaccuuuuaaaaauuaggcaccucaaauaucuacugcuuuugagcuuuugaguuuugcacuguaaaaagaaaaauacacagugggauuuuaagucaaauuaguuuaucuaauuuuuagggaauaauuugaagcaugcuuuguuugcauagauuuuuuuaaaauaagcuuuuccaaaucauaaagagauaagaucuuagguaacaugaagagacucccuuacuuauuccuaaaucaucuauauuccaagggcauuuucuuauuuggaacaguugaccucacugauaaagcugucucaccacuauaauaacaauguccaaaaucuaggcuuucugcacuauuaugcaaaaauuacaauaauaaaagugaaaauuacauuauaaugguauauuaaaaugcuaagacuuuugcauuauaagcaaaagacagccuuuaauaauuauucuuuauuuagugaacauuuucuaagucuuggaaaagggucaauguuuugaauucauggccuuauauaaucuucacaagauuccccaggagguauagauauuuuuauuauuacgcuaguauugcagaugagggaagcaaggcagagugguauuaaauagcuggcccaaggucacucagguaccaauggagaggcaucauuagucuuugcaucccacuaaaguucuccacuagcuucaauugccucaagaucuguuccauguucuaugaaguaguuucaacagaaauggcaauuaucuuagaagcaagggaaaaauaaaagaugggcuuccugucgggugccugugacaggugucacaucuaaccaugguuuuuuagagcaguuaaugccuugauagaacagaugaaugccucuuaauccuccuggaauucuuguuuuagauuaagucauuguauacagucauucgauuuucuucuuaugguccaaaucgauuaauaagaugucucuuuuugcuuuuucuuccuuuucuucauagucaacgaaggcuugaaccaaccuacggaugacucgugcuuugaccccuacacaguuucccauuaugccguuggagaugagugggaacgaaugucugaaucaggcuuuaaacuguugugccagugcuuaggcuuuggaaguggucauuucagaugugauucaucuagugaguaguugcuuuguccauccacuuccguguuugucuccucaaguuccaugcaugcacucaugugccaaggaagcauguuuggaagacacagguucuuccaaacaugaagcaaacaagagaauacuguuugacucgaaguaauauuuugcaucauagaaaaaugaugggaaauuuuacuuguuggacauugcuucauuucaaggguuguaugccaauacaacuauuaauuacacauaagauuauggugcuaauuugauuuuugaaauuuucugugaaaacaaauggauaaagacuuuuggaaccaggucuauuuaagaguauuagagacacagaaaaaccucaaaucucuuuuaaucuucaguguugaaugagaucagaggugaacauuuagacucaaaaacagccuccuucaacauaaaccaaacaugcacauaucauaguacccaugcacacacuuuugcgucacacacauagcccagguagcuugaacguugcuagaaauaugaaagaaaaaacagauaaucugcuuuuagaucauuaaaaaucaacuugaauugauaaauguuugauuuucaaauucuaauacguuuuaauuuucaaauuuuuuaaguuaaaaugugccuaggaaauaucuauuaugcuuugagauuaggauuagaauuuauaaaccuuucauuuauucuuuguguuuaggagaugugaugauuauugacaauugguucauuuuuauagguguugaccguuaugccuauaaauaagccuccuauagacauacagaaaucauauccuguggaauuagaauauaagacuugguaaaagagauuuucaaaguauuuuacuuaacuuguauacuugaaaucauuuaauccagacugaaguuguaaaagccagccaguguuuucaauauagacuuccauguuugaccaucugaaaaugaaaaacacuaaaaacaucacaugcuguuuaggagcuggaaauuuuaauauuugacuucaaguagaugguuuuuaacuccugaaaucgaacuacguuuaaguuuguauguuuauuaccuguuugagcacuuaggugcaauugugggagcggggaugucaaguucauuuaugugacucuuuggcucaacuuacauaaucuuuguuuugauaucacaguugucuaauuauuuuacuuuguagcuuaaggcaggcugaauuguugauaaaauggaaaaaguaguauauuguuauauaagcuucugagguguguuuuguuguauaagcccuggagguuaaaaagucaucccuuauguauaguaguuaaaggcauaaaacugugacuuuuagauauuccacagaaccagacuuauuugauguggauaauaaccaaugauuuagcauuuuguuugcuuuuguuuuauuuuauccggguucauuuuuuacucuucccauguacaugaaacaggugguggcguguagagaucagcugauccuuguuuuaugguuaauugaacuacuuuguauccaggguuucugcaaauccaaaagugauuuuucaucuaggaucuauuccuaacagucuacuccaaucccacuuuaguuuuccacaauuuuaaaucuuaauagugagaauucaaaugaaagucauuucauuugacuauucugaugacaugauuguggcagaauaaauugggucuuaaaaugcccuagaaaaugguaaaugauaaaaaauaauauuuuaaaauucaaccaaagaaauggcccauuggccaggugugguggcucacaccuguaaucccagcacuuuuggaggcugaggcggguggaucaccugagcucacgaguuugagaccagccuacccaacaugguaaaaccccaucucuacaaaaaauacaaaaaaaaaaaaaaaaaaaaaaauagcacuguggggagugccuguaaucccagcuacucaggaggcugaggcaggauaacugcaugaacccaggagauggagguuacagugagccgagauugcaccacuucacuccagucugggcgacagagaaagacuuugucucaaaaaaaaaaaaaaaaauaaaaaguaaauaaauaaauaaaauaaauggcccauuauagggguuuuuaucuuuaacuugcuauuuuuccagaucaugguucugaagacccugugacacgucccaguucaccuacugucuugugagucagaauauacaaauaacuuuuugguccugacuuuccccaccccuacaggauggugccaugacaauggugugaacuacaagauuggagagaagugggaccgucagggagaaaauggccagaugaugagcugcacaugucuugggaacggaaaaggagaauucaagugugacccucguaugucaucacagaucauuuuuagugccuuauuaagcauucucacuuucauuaucaggcuguaacucucauucacagaaaugauuggagacuuuaggucuccuugaggagugaacaguggguuucuuaaucuuuugauuugggaaaguggagacaagcuucaaaaaugagucaugauuuaauguuauuacaggacacuuuagcacuuguccaaccugaguauuuugaccauuaucugcaguaaaaugcuacaaagaagcuuuauuggucuguagauucaacuuuuaaaauaugauuuccaucuucccguuggacccuuuccaguguauuaggucuaauuuuuggaagugccacccuaagaucuguauagcaguacugcucuuagggaugauucacauaaauaugugguguuugcgcugugaugauacaaauuuaggacagaaauagaacccaccccuagaucaagucugcaguauuguucucagcuuaugcgugcaucugucuugugucuauaugcagaugaggcaacguguuaugaugaugggaagacauaccacguaggagaacaguggcagaaggaauaucucggugccauuugcuccugcacaugcuuuggaggccagcggguaagacuggaugugccaggcucccuacaaguuagauaagauaaagggugggcuccugcaaggaugugucguacacacaggaggggcagagacccuucggaaguauuaaaauaccacauuuccuguuggcauacaacugcugacauagagcucuagagcagcucuaugucuaccuuacaugccauucauucuuucuauuacucuuaguagaaagaaugaaugaauggcauguagaguaccaaaaacacaagucuugagucauucuuaauagcaacaccugucauuuauaugauguuagaaucauuuuccuaagcucccuagcaugucagagauacuauuuacacugaaaaauagugaagcagagauacuauucaaauuaauuagugguaaauagaauguguuucauuucagccgguucuccccauccugggcagccugagacccuccccuccccuacuauucucaggcugcuucuauuuuucagcaaaguguuaagugcaguguagcucuaggccuccaacuccauucugauggacaggugucccauggcaacguuguuaaauauuuugaauaauaucucagauguaagaaaaugccacuucuuuuaaccucucucuugauucagaacagaugcuuguuauaggucuagcacugugcuaaguaguauaggaaaaacagaggaaaugagaaauggcuuggcucuuaaugauauaguugaagauguuaaauuagcauacauuucaaagucaagcuaauuaaguucuaagugggucugacaaauacaguucuggguaggcuggaauuagcaagaaagagaagcaugaacuggcugagguuuacgaugacuaagguuuaguugggaggggagaaagcagagagacacacccccugggauagaaaggagcuggcccaggugggcuuuggugagccaacccucugccugcugucuucugguaagaaaauagaugggaagaaguggcuuauggagggccuuggcaacccauuauuuaagccaguacuucucaaccauuucuaaaauaugcccaguauaacaaaaaauaauaagccuuucucuaauaugauuucaaauuucaaaaugaaauuauguguaacucaaaagcaauggaaugugacagcccuuuguuuucaacgaagacaugcccucccagcaacuccccaaauccuggugggugaggggcaugcuucacacucaagggugagacucauugguuaaugccaaaugcauuaaccaauuacagguauccaagaugcaaagaaacaugauggaaaauagucuuugggaaaauuaaucuggcagcagggguguucaggggccugucuuggcuccaccaggggcagcccauggaaacuacuaugaucuuguuucacccccagugauuacauggggagggaggugcucccaauucugauggaggagaauuggagauuggaauuuagauugaauucaguaucucucucugucucucucucucucucucucccauuaacacuuacaacgacugugauuguaugaccuuagaacucagucauucugguaugaaauugugugauggagaaugaauuugcugggaaguugauuuuggucucacuucagcaucuucucauuauuuaugcacaugaaaccuuucaugugcgacacuuauucuauucucaagugcuaaaugaaacauuuaagacaggaguggaaacuguucacuuucucauaugaaagcaagauucagugauucuguaaggagguagucacugguauuguguuagguauuaaggggcauaugugcuuaaacagagaaauaugucuaaaauauuuaaauucuaauauaaaaaagaaagugacuguauuauuuagggcugcauuuuaguuguaagaaaaaaguccaacucaagcaaaaauggcccacacaauggaacagucccaggacccaccggcuucaggggcugcuccagcaauggcgcccggacucccucuugcuccgcgugccuucccaugcacuggcuucgugcuucagcggggucucugcugauggugccauugaugacugaccuccaugagcuugcuuuacccccugccagcuuaagaacaguagugaaagagaacauguguguccucccauuuccaguaaaaacuucaggcaggagccucacuggcucagcuuggucccguuuccaucucccaugccaucuccggccaggugacaggcuaccaugucacugccuagggaaguuuaggaagagaguggcaaaguggugcauuagaaagaacauggccaggucaccccaccuccugggcggcaggcccaacuccaccagugguccacugugugacuucccugcucccucuaagcaagucacuccucuccucugggucucuguuuccuuaccuauaaaaugagaacguuucuucaugugaucucaagucccuuuuaaaaucgcuaggauucuuugaaaaccuuuucuaucaucuagugcagagaacuuguugaggaaguugggauuggaaugagccucagcagaugggcaagguuugaauaggaagagaagagacauuucaggagaaagaaacaacauagagagacagauguagguauaagauaugguaauaagccaaaauguauuaagaguuauaaaugcaugaaaucaucaucaaagcuugcuuagugauuaacugcuuauauuuugccagugcauaugaugugacauuuuucuuuaacucaaacacuaaauuacgauguccucagguuaucauaaaccccauuugacuucaugccucuacucucucagggcuggcgcugugacaacugccgcagaccugggggugaacccagucccgaaggcacuacuggccaguccuacaaccaguauucucagagauaccaucagagaacaaacacuguaagugcauuagcagcacaaguguguucccucauacuagacagucucuuucuacagguaucuuucuucagaaugaaccaaguguuuuaauuaauuaaaaaaaaaaacaacucauaaaugacuuaagugaaacacuguauuccauaauauaguuuaaguuauaauuuauguaacucuugaacaucuccuauugcccaguaugcugcuagguucuugaaacuaggaagaaauauuauccuaucuauaagcagcugucaugaguccccaccuccccgcauuuuuuuuucuguacacuuuacaguauuugccacuaauuuuuuuuuccuucuuccuuuuuaacagaauguuaauugcccaauugagugcuucaugccuuuagauguacaggcugacagagaagauucccgagaguaaaucaucuuuccaauccagaggaacaagcaugucucucugccaagauccaucuaaacuggagugauguuagcagacccagcuuagaguucuucuuucuuucuuaagcccuuugcucuggaggaaguucuccagcuucagcucaacucacagcuucuccaagcaucacccugggaguuuccugaggguuuucucauaaaugagggcugcacauugccuguucugcuucgaaguauucaauaccgcucaguauuuuaaaugaagugauucuaagauuugguuugggaucaauaggaaagcauaugcagccaaccaagaugcaaauguuuugaaaugauaugaccaaaauuuuaaguaggaaagucacccaaacacuucugcuuucacuuaagugucuggcccgcaauacuguaggaacaagcaugaucuuguuacugugauauuuuaaauauccacaguacucacuuuuuccaaaugauccuaguaauugccuagaaauaucuuucucuuaccuguuauuuaucaauuuuucccaguauuuuuauacggaaaaaauuguauugaaaacacuuaguaugcaguugauaagaggaauuugguauaauuauggugggugauuauuuuuuauacuguaugugccaaagcuuuacuacuguggaaagacaacuguuuuaauaaaagauuuacauuccacaacuugaaguucaucuauuugauauaagacaccuucgggggaa

SEQ ID NO: 12738 - RNA, 585 nt, Homo sapiens
acuuucccuuucggccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaaggaccucugggcuacaaaaaaaaaaaaaaaaaa

SEQ ID NO: 12739 - RNA, 96169 nt, Homo sapiens
caugcucagaguuccggggcacgguuuccccgccccuuucaggccuagcaggaaacgaagcggcucuuuccgcuaucugccgcuuguccaccggaagcgaguugcgacacggcagguucccgcccggaagaagcgaccaaagcgccugaggaccggcaacauggugcggucggggaauaagguauaaagaaagccauggacuugggcuuuacccggacuggggauccggagagggugguucggaagcaggaaucgugggaucgcggucaagacaaagaauggggcaagagaagaucaugguggugggcucagucaggagggccgggaccgagggaugcgcuaugagaaaagcuggagauuuggggcuccaagaccugaauuugagccucgcugacuccaccucuuccauuacccacccaucccaucccucuucucccucucuaccugcucuuugucucaccugccuccccacccgccuccccucucucucucuuuaucccauuccacucccuagccccacuuccucuauuacuuccgagccuggguucuuaagaucucuaugagaaugaaaauuagcugugauaaagcaacuaucccacagggcuuguuguaaaacuuaagagagggacuaucugugacuaaaauaacuuaaacuguaaagcgucguauuauuagcuuuauaauaacguaguaucccgcauuuauugaaagcccacucugugagggacggaucuaaaccuuuuauucuuaucucauuuaaucuucacaaccccuugaagugaaaacuauuuauccccauuuugcaagugggaaaaccgaggaauaaagaacugugggcuuuuccuggugaaauccggauuugaauccaagcugucugguuucagggcccuggagaaccccuguguugcuagaaaucuaugaccauuggugucccagaucaguaacagaaauuacaaugaauuuuaaagugauuuuuuuuuuucaacauaaaagagugguaguugucucugaagggucacuagagggagaugugguuccagggauuaaugaauuuauucaauacagauaaacaagauacgaguuugagcaacugaucccuaguucccucaacuccucauugagaaauguugauuaaaacgaucaugaacuuuuaauaaugccacucaccuccuuuuuucguccucuuucagcugcugaaaacuuuguagcucuaguggaggagcuguuuguugcagaugaacuggaaguaaaauucuaacagccuguauugcuucgguauagaaaugaagaguugcuaugcuacccgguuucucuuucucaguuuucuuacugcugccagauaggaacucagaaauauagaccauucugcuuccagacaauaaguuccauauuugaaacccuuugauggcacuuacuggauaccuaauucaugacaaaagugcuuuaguccucuagaguuuucugguuuaaaaguagcuuuuguggguguguaucaaauaagugcagcagcauauuuugugacucuuaaguuuuuuuagguuaucaugccccaggcauugaaacugggaugugcauuuuacuguucucaaaggaauuuugugguuuauuagcacguuuuuuuuuucaaauaaucuaauuuuacuucagaaaucucuuagugcauuguguuguuuguaaacuagugaaaaauaaucuuuucuuuucauguguugccugagauauaaccacauuuagaaaucaucuauaacuucccugauaggaauucauucagguuuuuaaaacauuucuagggucaagagaucacuuaaaaaagaguaguuucuuuauugaucacuucuaaauguuauuuuuuaucccucguauggagucgcaucagucucccuguaacuuccaucuguugaucccguugucuuucuuggcagaccaauccuuuuauacaacaguugucaaauaucuggggggaggccagacacgguggccuauaccuguaauccuagcacuuugggaggcggaggugggaggauugcuuaagccaaggaguuugagaccagccugggcaacacagugagaccccaacucuacaaaaaaaauuuaagaauuagcugggcaugguggggugcaacuguggucccagcuauuuggaaggcugagguagcgggaucacuugagcccgggagauggaggcaguagugagccaugaucaugccacuguacuccagccugggugacagugagaccaugucucaaaaaaaaggaaaaaaaaaugguggggaggaaaacuguuauguucccuuuaaucuucucaucugacuuaaauaucuaguuauuuccaacuguucuuuacaucauguauucuucagauucuucccuaagcugcucauuucauguucauuuguaauuaauuuuccugguaagauguuagcccagaacugcucacaguuuguuugaucgguacaaagcacugcgagacuaucagucagagucaaggaaugugaacuccagaaaggaccuuaaaccucaucuaguccaacaguuuccuaccuuuuaguauuauuaacagugagauuaagugacauucccaaggacucagaacuaauggguaggagagaugggacuagaucccaggucucccgauugcuauuaucuuuuuucaccagaagacccuucuuuucucuucuugaauucacuacacuguugauacagaccaacauauuuaggcgaugaaguaagauagguguggggaauguggugcaaaagacauuucacguuguugauugauuuuauaauucacacugaaauugugaguugccaucaauccaggucucuuccagcuuguguucagguaaaauuuggaagccagguauaaauaacuuuacauguauuccuuuuagguuauguuucucuuauuuucuuagucuccuacauacgugauugcuauguaauggcuugugccuuagcuuaugugauuccgucugucacuuacuuguucacaugauugacuccuacucauuaagacucacccaaggaaauccacauucaggaagccuuuucugccccuucaccgcucugguauccccuccaccagucuugaguggaugcuccuccugugucucucagugcccagugcauacuucuaucauggaacauuguucugguauuauuuguuaucugucuguguccucuacuagaauagauuuggugucuuuauuuuagaucaucaguuuacaaacugacucaaauugucaggguauaccucuuagcauauauauagauucuagcagucacuucuugugacaaaaaugcuucauaacaaauuaugccccgaaucagugacuuacagugaaagcaucuguucucauguuuguaggucugcaggucagcugcaguuugucugauguauauugggcauaaauggguuuaacucuggccugcagguuggcaucauauguacucaucauggguuuauucuggggcuuaggccaaagaaguggcagcuaucuggagcauguuccucuccugguagaaacuucuguagcuuuuagaaaguaucaggacuauuuaaggguuuuccauagugaaaauuuauaugucuuacacacauucuuauguagaacacaucccuuuuucacaccuuuccuaaauacugauacagguucaugaauacaauaagcaagggacauucuuacagucuuuucuuacgacuuauuuucucaaacacucuuuggaacuuuguuuccaggcagcuguugugcuguguauggacgugggcuuuaccaugaguaacuccauuccugguauagaauccccauuugaacaagcaaagaaggugauaaccauguuuguacagcgacagguaaguuucagauugacacugagcuuguaacccauguuugaacugcuuguugccucuaccuacuaaugcaagauaccagccuccuuauaguguccagccccucuguuuggggggauucuggggaguuuccuuacauguacucacauacaacuucaccuaccacuagagucugauauuuuuucuucccucguuuuggccccuucacuagauauuacaguuuuuaucggaaacaagaggcaguaaaaaguaauguuuaaaagcacaaucucuagagacagauggcuuggguuuguauccuugcucugccaugucauuuacuaaccuucugauguugaacaagucccucaacuuguuugugacuaguucaguuaucuuuugcuguguaauaaacuaccccaaaauguagugucucaaguaacauuuuaaaaauucaucauucaugguucugugggaugacuggguugcucaguugggugauucucuauugaggccucuuacgcaguugcaaucagauggcagcuggggcuggagucacccaaaggcucaacuggaccagauguccaaaauggcucacucacauggcuggaagacgaugcuuucuaguggcugugagcucaguuggggcuguccguuagaaucucuacaugugguuucuguauaguuucaauuuucacaugaagcagcugguucuaaggaguaucccaagaauggguuuucuaugagacccugccuauguggcuucuuaagaccuauuuuuagaagccccagaaagucauuucuguuuucuguuagucaagcaagacacuaagguuaggucacauuuaagggaggagaauuagacucccucucuugauaaaaagaguagccugcaaauacaaggagagaaagaacggaugguggcuaucuuggagguuagcuacuacagugccucagugucccauguguaaaaugagaauaaugauaccugucacauaggguaguuuugaagaauaaaagaauuaauguagauaaagugcuuagaauagugcuuggaauauuguaaacacuauguaagcaucagcuguuuuuauuucugccccuucuacuugguaugacugccacuuuugcuaaguccaugaguuccugcuucuuucauugucuacugcugcuccuccuggacacuucuguuucuucuguguguuuacacuuccguugggcacuaguacuucccaccugucauucuagauuuuuaaaaaucuugaugaccuggaguccuugagguguugugucaaggaaggugcucuaacccuguucuugguuauaguuguguugguggaauucaaguaguguggcuguccccugguaugcuguuagagaagguaaguagacaugagcagggcaggagagagggcccccgagaauguugggcauuugugaagccaugguuaggcaauuagaaauccgucccucugaagugaugagcagggcaagggaggggccccaaagcugucagguuaucaucgaggggaagacaggcgggcauaaaacuaucacuguaagguaauaaguggccaugauuggugucaggaauuacaggaaucuuaacagacagaaaacaccuggaguuagcaagcuauaauccuuaagguuucgagcaugcgcaguaaaagagcaagauggugaacuuuaacugguauaaaagcugccucugggggcgcucgaccaauaaugccgaguugccgcuacugagcaugcgcaugacuaguaaccacacuacgcaugcggcccccucuuaagcaguagcagggcuagugcgcaugcguugauuaauucgggcugcucaagggaggaacaaaggagacuggaagcccgggaaaagauggcgccggugguuggggggcggggcggucuaaaaacuaaacaaagaagggcgcagggcacuugauuuuucacguggcccucuugguucucuuccaaguguacucugcuuucuccaguaaacucucacuuugcuuaaaauaaauuuuuccuccugcuuuaaaccuugcuuaugucugucguuucaauuguuuacuucgagaagaccaagaaccgagauuacugcggagucgccacuccggaguuucucuggauaacugccgacuuacaccccaguaacaagaguauagguguuuuuuuguuuguuuguuuuuguuguagagagaaagagucagaaucaggaagucagaaucaggaacuuagugccagucccauacuacauucagaauuuccuccccucccaugacugagauuuugucuagggcaagauuaccuugccuuaagauggaugcuugucuaggcggcagauaccugcccagccaguaugcuacgcaugcuugaauccagcagcaggcacccagacaccguuaguccauguacaacugggaauuguuguguuguuuacagacuaaaggauuaaacagacccuacaaaaaugaagaaugacagaauuccauuaucucuccauacagcacucuuccccaucaauguaaaaaggcuuauguuaauaauuagacaggacugucuuuugugucagauacuauuuuuuguuuuuauauuucauuaugaaauauuucauaaaauaggcaaauauggagaauauacagguaaccaauuuucccauugucuuaugcuguaaauccuaauguuucauauuuguuugauuuuuuuuuuaauaaaguguuacagauaaaccuggaggcccuuccuuacccuuuuuuucucuucuccuuuucucaggauuuugguaguuauuaccauguauauuuuauacuuggacauaaguauauauucauaaauacuuaguauuguauaaagcugucaaaaguguaaaugguuuuauaugcuacauguaauucugcagcauaucuuuuaucaacuuauuuuagaucuauucauguugauacguguugcacaaauuuauucauuuuuacuggaguaugauauuucguuguauaaauauucugcaauguauuuuugcauucuccuguuugauaguuugcuuccaguuuuugcccuaucauaaacagugcugaaguguaaacuuccuaucuguacauaauuuuucuaggguauacuguauaugccugccccugaaauugcugggauauaggcuauccugcacuuuuuuuuuuaaccucuggaaaauuuaaaccuuagacauuccauaaagacauacuaaaaucuuuucacauuacccauuuuugguucucucauugagaauuagaguuugauuucgcuggaaaucaucaagaacacuuacuacccuccuauuuccacaccucaacuucugcugaaaugaagggugagacuuauggucaaugaaaaacaucuguucagaaccuaagaauugucauugucuguaagucucauguuucaucccgcccaauacuauauggccccagggaccugccauagggaggucugguuguccugcucccugaagguuagguauuuuauugcuuccagauuguucuaauaugguuuucagccaucugacauuuuuuucuagguguuugcugagaacaaggaugagauugcuuuaguccuguuugguacagauggcacugacaauccccuuucugguggggaucaguaucagaacaucacagugcacagacaucugaugcuaccagauuuugauuugcuggaggacauugaaagcaaaauccaaccagguucucaacaggcugacuguauccuuuuucugccagagaagacuuuaagaaauuuccuuuauucugggaaucguacagcaguuugaugagacacccccagaguuucagcuaugaguauauggguauauuuugcucugaggagggggagguaauguguuaauaggguuuaaugugaaauuaaucaguuuaaaacagugccugggcucccagcccuccacucacuucccuguucucugcaugggugauacugagagguugggaggcauaggaagggggaagauccuagggaguauaugugagcauugacuauaugcagaggguuuuaguggugcucguuagaaauguuuggaggcggauagaaaauauuuuuagaagagcauccucccaauguucucuccuuuuuuucuggauggaagauguuuuugugccagaaaucagauugauacccaaagugagauuuccaguuuacuccacagguccccuaauuuuaagggaucaucacucuuguucuuuuucuaaucaguuaguagugcuauuccugaucacugggaagugcuguuguguuaggagugacuugcaaaugcuacauuaugguucgcuucauauuuaagaauggacuguggccaccaagaauggguucuagauacuauuaaaugacauaauuuuugguuaaaugaaugcaauguguuagauuaccuuuuguuuauauuucuugguuguuuuuggcagaauauauaguuugauauauagaauguaugaauauauguuagugaacuuuggaagaagggcacucaggcaaguacuuuaagucaucacauaguucaguguccacaauuuccagcacgguggacuucauuggaaagaguugcguguucacaugaagagacuguuuggugauaucccuauccuuaacuagcugaguccuggaugcacuaaucgugagcauggaugugauucaacaugaaacaauguaaguguuccaaggaagagagcuggaagagaaucuuuuugcaaaaauuguauggguuaauguauugaauguauuuugugauucauuguuaaucaagcugcauguuugugugacaagagaaacauuuuauagaauugaaugguucaguccaaccucucuguuuuuuaaaaguuuuaaaaggggaagggcuguacucggugauuauuucucuggaagaaauaaaacauuuggcuuauuucaguuuacuuccuauuagacuuaagcugauuaccaggaauuuuaaaaaacacuaagugguauaagccauaugucauugauauuaagugcaugguaacucuggccaacuucccuuuuuuguuguguguguguauguuuuuuguuguuuuuuuuuuuuugaguuggggucuuguucugucacccagacuagagugcaguggugccaauauagcucacagcaaccucagcuugaucuccugggcucaagagauccuugcaucucagccuccugaguagcugggacuacaggugcacacccaaguccagcuaauuuuaaaauuuuuauuuuugcagagacggucucacuauuuugcccagguuuucucagacucuuggcuucaagcaguccuccuaucuuggccucccaaaguguuaggauuacaggcaugaaccaccaugccuggccugcuuccuaauucaguauuuauuuaauuauugugccuuggaaguguaucucuggagacauauaugugcauguacacauaccucuugccugucaggaaaaucauuugcacuaaaaucccagaccuaaaucuguguaaucauuucucaaucucuguacauccucugccaaaucuugccacacaaaaucugugcauggagucagagcaggauauuuagaaagugaaccugagcaaggcugaaguuagaguaugcugggagaauucuuuguuuacauucugccuauguggaggcugggaagggauauuuuuucaucacauuugaguucggaauccagaaacauaacauuuccauaauacccagacauuuuggccaagauguucaaaguauaaaguguaucaggguugauuaugaauuuaauaagaacuuaauuggacuacuagaauguaaucacauuuauuaacucuagauccauuucuaagcuucucuccucagugaccaaguguauuugaauuuguagaaaaauaauucaggagaaugauuucuuaauaugauaacucucucuuuuagaggaaagaaguuugagaagaggcauauugaaauauucacugaccucagcagccgauucagcaaaagucagcuggauauuauaauucauagcuugaagaaaugugacaucucccugcaauucuuguaagauccuaagaauaaugcauguagacaaauccuaugauuuccuaauauagugaaugggcccucuguauagaguacuugguuuaugggaauuuucgcuuucugcuccaaggcugaaucugucagaugacugacuacucagcaaacauuugcugguuacucucuguguucuaggaacuguucugaguggucgugacaaaaagaugaaagucagugauccagaagaauugagcuuaguggcagaucauuguuuaguguucuuagacucaaagaauugaggauuagaagaacccuuugaggauauucaauuugucuccuuccugcauagaaggcuuuacccaaacaauuagcagauugauggauuuuuuuuuuucuuaaacagcucuagagaacuguguccuauacagagugcauguuuuaggguagacaggaaugccaacuugggaaucauucuaaauacauaacauguuuauguuuaacucuuuucagauccaaaaguuguggacacauauauaaaauuuaauuugcuucuguuaauucagagauggaguauaaaacuucaggggaaaaauauguauuucacaauuuauuagggagagaauuccuccucaaaaaguaacuugaauauucccuccgggauuuacuuucucuguguuauaucccuaacaaaaauuucuuuucacuacacuaacccuucuugcugcauuugaaacauauuuuuucuuguccuauuuuuggugaaaguugagugaugguauagaauguugaauuauuaaucuucugggaauacucguuuuucaaauugagagcuaugccaagaagccucuagguuagagugguaagccuuuggcuucauaaaaugccugccuggggguauuaagaacuuguuuugcaugugugaguagucuucucuuaagacuacagagcgacaucuccuuucuguacgacuguggaaaaagaguucagaauaacccaucaaaccaauacuuguuaagaugguacuucagagaaauuaagugcuuuuaagugacacuucuuacugaguugagguuuuucucaguacuucagaagcccagcacagcuucugguccuuuuucauaaucucaggaugccuuuacauguuagaagcagacugcauuucagugaaugucauucgaaagagcuacucuuuuuuuccaugagcaauacagaaaagugcagaagaggaagcauagccuuugcuucuauuugcuuuuuauuugguuguauuuuuuucuugguaauaugcuuucuuccugugcuacaaaccuccagcauacaaaguagaguucauaguuuuacuguuugguguauuccauguacagcugauuguuguaauuggacuaaaaaaauaccagcagcucagagaagcccuguguucuguuuuuaauuuauuuuuaauuuuuuuuuuuagaaacgucuucuguaguggcauaguuauagcucacugcagccuaaaacucuuggguucaagugaaccuccuaccggagccuucuguauagcugagacuauagaugcauguuaccacacccagcaguuuuuaguuuuucuugguuguuguuuguuuuugagauggagucucgcacuguugcccaggcuggagugcaguggugcaaucucggcucacugcaaccuccgccucccaggcucaagcaguucuccuaucucagccucccuaguagcugggauuucaggugugugccaccacgcccggcuaauauuuguauuuuuaguagagaugggguuuuaccauguuggccaggcuggucuugaacuccggaccucaagugauccaccugccucgcccucccaaagugcugggauuacaggcgugagccacugugccuggcacaguuuuuaguuucuucuacugacuacugaggaagcuuauuucugaucuaacgcagaauagacagaacaguuauuauuucuuuuuccaggauaacuuccuuucucuucacuuuuacgacauuuguccuuuucugguuauugcuuugaaaacaggaguaaccugaugcaaacccugugucucacacuuuccucccuggaaacuuuuuaccugauaaaugcaggacaugcaaauuacaucaugcuguauuugcuaaguauaugaagaaaaauuguaaacagccuuauuuuaaguguagcaaauaaaaugagaaaucaccuuaaaaacaaauuuauuucucacaguucuggaggccgggaaguccaagaucacagcacuaacagauuuggugucugcugagagaucuuugcucucaagauggugccuuauugcugugucaucccaugucaaaagggcuaacacuguucucacgugguggaaggacauaaaaggcaaaaauggcaaaaagccucucccuucaaccauuuuuuuuaaggucgcuaauuccauuuaugaguuccccacccucaggacuucauuaccuccuaaagggccucugucuuaauaguaucauauuggugauuagguuucaaaauaaugauuuugggggacacguguagaccauuacaguguggaagaggccagucggagagagugaagccagcauaaaggcaaaugaagguaaaauagagacagagagaguaauccuugccacaguugagacccugggucuggacuuccuaaggccuugugccacccugcccuuucaguuacuugguuauguaguagccagugauuuuccccuuuuacaaaccaaagagguuucagucacuugaaacugggagaauauuggcuaagguagguaagagucguuugacagaugagaaauuugaaacuugaaaagguugacugaugugcucauuuucucauagcugaugaguuacaguuacaggauuagaacacuaacuacuguugaucuuucuuaauagcuugccuuucucacuuggcaaggaagauggaaguggggacagaggagauggccccuuucgcuuagguggccaugggccuuccuuuccacuaaaaggaauuaccgaacagcaaaaagaaggucuugagauagugaaaauggugaugauaucuuuagaaggugaagauggguuggaugaaauuuauucauucagguaagaauugaaaacauugaugggaauuuuuaauuguacccacguaaauuucucuuuugauuagaggucucccaaauguuuccuuuuucugggccacucucuaauuagucauugcuuaauauucugaguuuuauuaaagaaauaguacacccacccuuaaucacccuuuuuaaaguuuguguucuuggcacauguuucucauuuauuuccaggaccugugucagugaaguucaggaauauauagauaccaugagaaauuaacaagucaaauugcaaaagaugaaauaguagauuucuucauuaugccaagcuugggauacauuuuuugggcccuuuuuuuuuuacacaucuacaaaaaacauuauuaauuauagaaaguggucucagaucugagauagucaguaucuucuuaucauccuauuaagguuuuagaaaguagcauacuaugguauagugauuuuuuuuuuaaacuuuugaucacaaagcaguuugauugagugaaaaaaaaaaaaaccugcaauguaaagaguucauagccuacuuacuuuacgugggcguuggaaaggcaaaaugauuuaagaaaagugaauuccuugaaguaccguauaacaauaaagcaaacugcuuuuucaaccauccagcuagagacuauggaagagaccaucuccuuuauccaucuuauucuugguuggaauuggacauacaugcauuuugagcaaagaaccuaagaagaaucgguggcaucuagaauaguguguguccuaugggguucaauuugguaaaaguggcaauagaguacuuuacauagcaguauggcuugggugguucaaauucucagggguaauacugcuugauauucuugaauuauuuccagcuuaucagucuguacacaaaauacuggcuguuuaagcacauugaaguagugauugaacaacuagaauuuuuuuaaguagcuacaguguauaucuccuuaauauuuuuucuaaacgaccauuuuuaauauuucugaugagcuauaauugacaaaaauuauguucugauuuucuaaauacagacagccuugaaaaaugauagguaaauuuaggaaacagaauugcccacgggauugcccuaggaaucagugaggaauccugugaggugaaguuucuuggcguaauguguucuugucacaauauuuacagauauguguuccuaaguuguuucucuuucaaauuuuggaauaaaugccuuaagcuaaacauauuacccaugauaucacaaagaaaaauuaggcuggacacgguggcuuaugcuuguaauuccagcacuuugggaggcugaggugggcagaucacuugaggucaggaguucgagaccagcccagccagcguggcgaaaccccgucucuacuaaaaauaaaaaaauuagcugggcaugguggugcaugccuguaguccuagcuacuugagaggcugaggcaagugaaucacuugaaccuaggaggcggagguugcaaugagccaagaucaugccacugcacuccagccugggugacagagcgagacuccgucucaaaaagaaaagaaaaauuagaggccaauauagauuacucuuuaaaaaguguuuuuguuuguuuuuuaaauuuuucuguagcauaucagauagggaaauuacugacuaugcauuguuuuagcauuucgacgcuacuuugauuuuaggucugccaugaagguguagaccagaacuuugccauccaguacaguagccauuagcuacauguggcuauuuaaauucaaguuaguuaaaauuaaauacauuuuaaaauugagucccuuagucauauuaucuguguuugaagugucuauugggcuagcaugguuagaaauagaacauuaccaucauugcagaaaguuguacuggacagcacuggacuagauuaucuccauauagaucuuaggaagagaacuugacaucuaccugaggagauugagcucuacugcagaacugagucaguuguucuuagauuuuuuuugagacagggucuagcucugucauccaggcuggaaugcagugacgugaucucagcucacugcaaccucugccucccagguucuagcaauucucaugccucagccucccaaguagcugggauuacaggcaugcgacaccaugcccagcuacucagaucuuauauauuggaugcccgucuuuagaauuuucccugaaauagaaucuaaaucucauggugauuuuaggccaugagguuuauauucuguuugacuaguaauguuguaugagacacguuagaccugguucagacccauucauuccucagcaaauccaaagccauugugcaccauaggcuuuggaagcugggugucagguaagauaucuacuauucguuguaaauuauuucugaaaauuggagucucuugcgaccugucuguccauaacucuguggauaauguaaaauaauucucuuuaccacuuuguagaucuguuuuuuaucuguaccaaggaguucagccagaaagucuggacuguaugcuuugaguguauuuugucauuaauuucuuugcugcuuauuuuagugaauaccacaaauuccaccuaucuccuaucaucuucccuguuguguuugauuaugggccagaugaaaauaugauugauuuucacuuuuguuuaaaugaagcagcacuccacaacacuguuugcaccucuccccagcuuuucccaccaguaagaaaccuagaguuaacgugcuuuaccuugagacuaaauaugaacuaaauuccuuuauuccuuggauagucuuuaacucucacuauuauauacauauaaaaauguguaucuuuaauauucagaauuggaauuaaugaauuauagaguuguaaacagugaugauaauuauaggauggugcccucccuuugauacucuagaacagagguucuuuuuuuuuuccuuuuuucuuuuuuuuuuuugagacaaaguuucauucuuguuggccaggcuggagugcaauggcgcgaucucagcucaccgcaaccuccgccucccagguucaagugauucuccuaccucagccucccuaguagcugggauuacagccaugcgccaccacaccuggcuaauuuuguauuuuuacuagagaugggguuucuccauguuggucaggcugaucuugagcucccgaccucaggugauccgccugccuuggccucccaaagugcuaggauuacagguguaagucacuaugccggcccugagcagaaguucuuauccucagguccgugguuuucagggaguugguagugaauccuuuauauugugugcagacucauucaugaaugugcuuuuaucacauccucaaaggugugcugguccugaaaaaauguuaagaaccucuggcagaguugaaauaaaguauugaauaagaggaaaauagagcuguucauuuucaccuguuaguaaaguaauucagcuccucuucccuucuaagccaacucacucuugcccuggcuauaucucccaacuugugguuguuguuuuccggccaucuccugcuguuucucucuuuauaauuaacauuagcucacuucucauuguagaaaaucaaaugcaucauccagcacaaguuaacauuuaaaaauuguugcuuucauuuuauauuuuucuuuauuaagugagagucugagaaaacugugcgucuucaagaaaauugagaggcauuccauucacuggcccugccgacugaccauuggcuccaauuugucuauaaggauugcagccuauaaaucgguaaguggcagguacacauuuuuaacagaaauguuaccaggcagauaaauauguguauauaaggaacagacaauucauguguguguuacucggaaccauaauuacugcuuuucuaguuguucucccugcucauuuaaucucuguuuagcuuuuuguguaaaaggcaggcuaggagaggaaguuuaaagaauugucuauaauagaguuugauuuccuccucuuuuacuuucucuccauugguaauugauuguuaaucauaaguucuaggccugucucuuuuuuuuaaaagaaagaaaaugaaaugcauuaagcuguguuauuguaguaucauagcagaaauguagauaaugcaccaaaguuaaguucaguuuuggagcucagugacaccuaauucaauuaugaaugaucugauaguaacaacaucugugaaauguaaaaaaauguuuuguuacuguaaaauugcauuuuauaauauauguacauuuauauacaauagcacacuuuaaaaaaugaguugcuuuuggugauuauuugaugaaauucuaguuugaguaggaaucugaugcgugccuucauauaagccuccuugccuuuuuccuuuaaguguucaaaauaaauaggaacauuuuagacauauaaaauaaauauacaaaaacauguuuuuauguauuuaguuuuuuucuuuguauauuaaagaacuuaauuccaaaauacaugauauaucugugagaaccuuggggcaguucuuuauuuauuucagcuuccaucaaagccuagaauagugucccuaggaaugugaauauagucucccuccucuuuuauuuuggccugcuuuucaaauuucuuuguugauuucugacacagauauauugcuucuuuuuuuuuuuucuauuggaaacuaugauaaaauguauaguccucuuuuuauuaaacagucuggcugggugcagugacucaugccuguaauuccagcacuuucagaggcugaggugagcagaucacuuuaggccaggaguucgaaaccagccuggucaaccugucucuacuaaaaacacaaaaauagccaggcauggugaugugcgucuguagucccagcuacuugggugucugaggcaugaguaucacuuaaucccgggaggcggagguugcagugagccaggauugcaccacugcacuccaaccugagcgauagagcaagacucugucucaaaaaauaaaaauaaauaaauaaaaauauuagacagucugagguuuuguauagaaagugugaauguaaauauuuguggauuacuuuugggagaaaaugaaauguagagaagguuauccaguauauuuuguuaugaaauaaacuaaaauuuucauaauaggcaugagcaaacaaaauaauggagcuagaguaauuguucuggauuuuugucugugccagagaguguauuagguuuucaucuucuaucaauuggaauccuaacuuuccuuguuuucccuuuguguuuuggaauguaagauucuacaggagagaguuaaaaagacuuggacaguuguggaugcaaaaacccuaaaaaaagaagauauacaaaaagaaacaguuuauugcuuaaaugaugaugaugaaacugaaguuuuaaaagaggauauuauucaagguaugucaguaagaguuuucacuguugccuaaaagacauuuucuucaacaugaugugaugcaggcugggguuuguauuauucuuuguuuaaaguuauuucuuugaguuauagaaauauaacaguuugaaaggauaaugagacccuagguccuuuagcucauuuguugggucuuaggcagguugcuucucaggaguacacuuggguguuccaucucugugaguuuuaaaugucuuaagugauaguacucaauacuuggcuuuauuuuaaaguuugaaacucacuagcuaggagcauguuuaauaugguugaacuaagguuuuuuuguuuguuuuauuuuugacuuucauggugauuauucuucuaagggccaacuucagguuuuauguccuaccagauaugcuuccuuaauuuaggggcugaaaauuauuuguauuuauuauauugcuucauauuaaauaggauuuuuuaaaaguuguacuccuauguuauacccauuuggauugaauagugugucuagauggcaucuuuauccagaggacuuagaaacuagcugaggauaucuguauguucaagaccuaaaauuauuaagauaccaaaugaugguuaagauagaaacaagaguccuuagauaaauguuuugccaggcuauucacuacccaguauaguuuugauuugcaagucuugaaaagaauucuuuuccucugugacacuguauuucaucuuacaguguauauauuuguguguguuggaggaggggguuguuuaaaggugguggugguuaugauuccuuccuuucuccugauggauuauauguagaauauaauuaauacccuacaauuucuaccaguucuugaauucaauucuguagcauagaacaugaauuuuggaaucaaaccuggguuagaaucaugguuccaucauugguuaaucauuugauccuaguauaaugacuggcucauaguaggaagaauagcaugauuaaagccacaagaccuggaaaguagggggacuucucagagauacuaaguaguccacuuggguugguguauugagcauauacagguuaguacuugaggguaacaucuaauggacagccugcauuuucucuuuuaaucaucagcgaccaucuuauaaagcaggcacucuuuguuauuuccauuuuauagauaagggaacugaggcugaaagacacucguucacauauucaaagccccacaguucucaacuagcaggacuuggaucuaggccuguacugcuucagagucugugccugcauucuauucugaauuuggacugaguaaugaagggcuuuggauaauaggcuaagaguuuaugcauaaccuugaaaacaacguggagccacuuacaguuuugaggaagagaaugucacuggggcuauauuuuaagaagauuaauaugacaacugguuguaggauggauuggaaggagaaggaucuagugauaaggauggaugccaguucuuuugguugucagcaaggaaggcaucccugguuaucuuaggcaaaaaggaaauuuauugcuggggcaauggagagggaagaguuaaaaacugcuuggguucaaagagcguagaagugcaucuuuucuccuguccuccaguuuccagccccuaaucagcuagagguuuuugcuuuuuguuuuuuguuuuuucuugaacuaagggaccaguauacacaugugggcaaaggaaucugguuaaauguuguagucuauuguaaguauacaauguacaaaaguuggaguuauaugccauuucaguagaugaaccagaaaacaugaaacaguuuuaguuagaauguucauuacaaguuacacaauucacacgauucaaguaagaugaugacugaugacagagauuaagacaaacauuugguuuagguaccagucuuaaucaugugccauacauuucccuguuaauuuuuuguuggaaaguuugguuuugucacuagcuuuuuaaaaaagacauacauggaaauaaaaauguguuucuauuuugagacggagucuugcucugucgcccagacuggaguacaguggugugaucucagcucacugcaaccuccaccucccagguucaagugauucuccugccucagccuccugaguagcugggacuacaggcgcgugccaccaugccuggcuaauuuuuuuuuguauuuuuaguagagacagaguuucacuguguuagccaggauggucucaaucuccugaccuugugauccaccugccucggccuccccaagugcuaggauuacaggugugagccacugugccuggccuaaaaguguguuucuuuuuaauaaaauaaaugucaucaacagacuaacaggaacaaauaaacacuagaucacagaaucugucccuggauaugaaaguuuuauugugucuugggguaaagaugcaugugcuuuuccuuugcauuuguccaaggccagaauccuuggauuuugaugcuccuucuucccacaaaacauagaagauacuguguauugaaagggugugauuuuucauagaauauaggcuacagaacagggcuggacuuuuuuuuuuuuuuuuuaagaagccgagagccuauguuuauauaaauauccuauguaauuaaaaagaaaaauacaguuaaaucccagaaauaaaagaaauuuaaauauagaaaaauauauaacuuaucaauugaauguuuccaaacagaagaguuuuagcuucugucaggcauugcauaucuccagcauacguuuuugagaacauuuuguucugaaaauuuccuguuggcauuuuucucugugggucucuagguuucugaauaauguguucuuauguuuacaaaucaugcuguacuuuagucaaccaugguuuaucuuuggaggauaacuaguacguuaacauuugccagauuuuuucuuuuaggcuggguaaucauugagcuaacuagauugcaaaauaugcuacuuuaaaaaauguaauuagauuuuaaucaucucuauauuguaugugugguuuguguaucugcugcugcuuuuucaccauugaucacaaggggcagucaucugauuccagggaauagaagauggaggcuugcucuggcgugugcguguguuguuaauguaugcauggaacuaauuucagcuuguagaaaaugaggccccauaugcuuaacagaugcucuucucuuuuucuccaggguuccgcuauggaagugauauaguuccuuucucuaaaguggaugaggaacaaaugaaauauaaaucggaggggaagugcuucucuguuuugggauuuuguaaaucuucucagguaugauugugaacaaacuaaaugagcuuuuuccuagcuguuauuugaaaugguaugcuuuugauuggucauuuuauuuauaagguauauuuauuucacuuuuaauuuuucuaaaauguagucuggggguuaauguugccaugguauguauuuuauacauugggaaacugagguucagagccguuaaguaaaucuauaugagcauagcaaacuaaaaauacaggaugguuuuugaauggggaauggaagcggagaugagggguauuugaauuaugugggccuaacccucaucccuuugagguucagucuucuugagcugguauuauggugaaagugcucauaaugucucaacucuagaggugggagggcauaaaaaugcaugagaaacauugcccaauacagcacauugcauguucuugaaaauaaaccgcaggcuccagauuucauagaucagacaaaguugaucuugguagauaagugcaggugguuaugauuuucagaacucuucaauacucauuuucuaaucugguauuaguagagcugucuugaccccucuugauacugugcuagauaaguuaauugaauuuaaggggguggggggagagacaugcaguacuuauuuuugauuuaauuucucuuucuuucaacccuuccccucuaagucuucacucaagccucuacuguucaucagugccucaguguuacucuuaggaggaaaugcaaaccacuuagcuuuguuuuuaggagacuucaucaucugaucuuuguuaaucucuguaaucuaauuuuucaccuuuccucucacacaguggcacuguacuacuccaagagcaguucuccaaauguaccaugcuuuuacagcacuccagacuucuauugauacuguuuucucugccuggaacgcuugugcccagacuuuucucuuaguuccuauuuguccuuuuaagucucgacuuaggugucaccguuugcagaaaccuucccugaucccucaugaccaggcuuggugcccuccuuaugugcucuuaaagcaccauguaacccuggaccauaauacuacacugcaguuaauuucauauuuaucuauugaagcuccucaagggcaagauuauguuuuguucacuguuguguuuacagugcucagauaaucuugaacgcaugcugggugcucagauauuuguuguguuguauugaauuaaacuucagguaauaagguguuuuuaguaucugaauguuuuucaguaagaggauuuugaauggaauuucuuggcaaugugugucaugguuauacauguuacuuauuuuggaucaaaagcaauucuuuuccucucuuguagguucagagaagauucuucaugggaaaucaaguucuaaaggucuuugcagcaagagaugaugaggugaguuggcagcaggucuuugagguagugcuacagaauugaauuguaagucuaugaaagcaaguuguuuggggcuuuuauaguuuaaaaugacaugaauucuugcaauaggaguggggaaauccacugauguuuaacugaaaauggagaugugguaaauggauuuguguuagcaugagcacaagacccgaggacauggagaccaaggaaguauuaaaaacauuuugaaccacugcauuuaggaaugggaauuucacagucaaauguuaaggaggguuggggucagguugacauuuuguguugucauaagcauccuggaugugcacuucagugacucacuagacugcuuuugucauugaggaaaugugucuuuucucuauuccucucucuugguacucuuccugccuccccaagauacucuguuuucaggcugguuuuucucuagcuaacagccuaugacugcugcauucuauacucacaucugcccuuucuguaaauauuuacuguuugaucuccaaguuagaacuaacuuuguuggagauacugauuuuaacuggaagauugcaaucuacuaucuguuuaaggcagcucaagcagguuuccaaguuccugaaguauuugcauuuguaauuaauaaacuggauguagaaggcuuguuugggguggggguaggguggugguauaacuaguauaguucucuuuuucuccucacuucuggaagguagcugguugcugauauaguggauggguaugccauuauuaucucagaacaguuaagggaagaaaauguuuggcuucuacccuguucugaaugaauuauuagagcacaauauuagcauacaugaaucuucaaauuugagaauccuacuucauggauuucucuugaaucaaauccuguugggaaucauggaagucuaguauauacugucaaaccacaacuuagcugaaguuuuauuuuguuuuguuuuuuuaagagacaagaucucauauguuucccaggcuggccuggaaccucugggcucaagcgauucuccuaccucuguuucccagauagcugggacuauaggugugcgccaccauuccuugcuucugcugaaguuuuaacuuccacuuacugucucuuuaugcaaagaacauucugaucacuucaugagacuugcuggguaugcagugaggaaucacaaaguuguguugagacacacauguuggguaaugauguaggcuugcuagcuaagggcagccuuguggauuguguaauucaaaucuggccuuauacaacacuaauuucuguauaucauaggaucacuuugagauaacucaagaaaaacagauuuaucuccuaauggcaaagggauacucucuagugucaguuuuugagguagucaaaaaaugauaauaucuaauuggagcuucugagauaagcaagggaguaaggaaacaaugucauaugaggacuuccaguaaaacaaaacaaaagaaugccuggagaagacuuguguagguaggcagggguguaggagggauggcagacauaauagcacucuucaugcauuuggagaauuaucuuguagaauagaaauuaaacucugcuucguaucagaggggugaacuggaaacagcagguggugcuuuuuguucaagaugaagaauuauuuugucaacaaggauuacuguccccacuggauuguuuucuuguaagaugaucagauccccauuucuguaaguuuacaauaaaagucuuuaucaccacuagucagauguacauguggauuguuaaacuagaugaauacuguuguuuuuuagcucaaauauucugauucuuuggauaauucccucuuuaaaaaguuuucucuggucauuagcauauaauuuuuuguauugagaaucuauacuuucaugugcugauuugcacuguguguagaaaacaaggagggaaaagaaaggaaggaaauggagcuuuaguuaaguuauacacagcuguaguacuguuucaccauguagcagucauucacagccccauccuuccuucuuguuuuuuuuuuuguuuuuuuuuuuugagacggaguuuggcuuuuuguagcccaugcuggaguacagugguacguucucgguucacuguaaccccugccucccggguucaagugauucuccugucucagccucccgaguagcugggauuacagaugccugccacaacgcccggcuaauuuuuguauuuuuuguagagaaggggguuucacgauguuggcuaggcuggucuugaacuccugaccucaggugauccaccccccccccuccucggccucccaaaguguugggauuacaguugugagccaccgugcccagccccuuccuucuuuuaaacauccuaauugguccugucaaagacauauaaauaaaaacuucaaacaaauuggaaguaaucucuuccucagauucucauugugcuuaucuagcccuuucuuaugggacuuaacuauuagaacauacauguuucauauuugcuacauaucucauuucugcuaauaaagaauguauuagguaagugaggucaaggacuuggcuuuguuuuuucacagggcucaagacagugccuggcaaagaacaggcacugaguaaaguagccuuugaauugaacugaaaaaguaaugauucuguuaugaaaucuguacaggauucuaauggccaggucuuggggucauaguuuuuuuguuuguuuguuuguuuguuuuguuuuuacaacagcauggcugggaggucauagguuuuuaacuuugauaagguuaaccgugauagugagagaaguacauaguguuuggggaguuucugcagagagagagagagagcugacuaagguaaaucuggaauggagaggguaucaauuuacuaagccuagagaaaagguuagaagcuggagagccagagauuaguaaaggggcauucuagcuaggagguaaugguaugagcaaaggccaaguaugagaccugcccccagucagugaucagcucagugaugccagaauagaggaacgacuggaagggagugacgugaugagcucugggaacagagguggcugucagggaagagauggauuugagagacaguauagagguagaauugguaguuucgugaacacuuaaaaggugagggaugaggcccagcacuuugagaggccaagguagguggaucacuugaggucaggaguucgagaccagucugggcaacauggcaaaaccccaucucuacuaaaaauacaaaaaguuagcugggcaugguggcgcgugccuauaauuccagcuacucgggaggcugaggcacaaacauugcuugaacgggggacacagaagcugcagugagccgagauugugccacugcacuccagccugggggacagagugagacucugucucaaaaaaaaaaaagugaaggaugagaauggugcgguggcauuaucaaagaccgggguuuccagugugguugauuaggcaaugauguuaauggaaauagggaauccaggaggagaaugagggggaaagauaguaaguuuagguuuuagucuugucguggugaaugugaacaguucauacugaacaguuugagauaacugaagaugccaugucagauauccaccagcuagcaggcagucuaagucuagaucuuaggagaguuuuaaaaaugaauguacaggccuggugcgguggcucacgccuguaaucccagcacuuugggaggccgaggcaggcggaucaccugaaguugggaguuugagaccagccugaccaacauggagaaaccucgucucuacuaaaaauacaaaauuagccgggcgugguggcacauacuuguaaucccagcuacuugggaggcugaggcaggaagaucgcuugaaccugggagguggagguugcggugagcugagaucacgccauugcauuccagccugggcaacaagagcgaaacugugucucaaaaaaaaaaaaaaagaaauaaaagaauguacagauuuuugauucaucaacucaugggacuggaugaaauaauccccaaguagaauuuuagagugagaggaggagggaaaggucuaaaguagaauuuacaaauugguggagaaaagagaauaaucaggggagaauguuguuuuugaagccaugaaggagaaaguauauagagacaguggaauggugagaugcuacugucaaacaaaaaaaucgagaaccaaggaguuggcaauuagaaggugaugggugacuucagaggauaauuucauuaaggaagugggggcaguagcuggacuagacugaagaauaauaaugcacuaagcaguggaaacagcaugccuauuauuuuaagaaauucagagguaaagacaggaaagauacugauagcaauuuguggagagggaaggacaaacaaaagauuuguuuaggagggcugacaugaguuuauuuuuaggguaaagauaaaaauuuagagaaggaagguugaagcaguaagacggauuuaguuaaugagguuaagucccagaagagcuacaguaaauguaaucaaaagcaaaugugugcacuucguccuucaagucagggggcacccuaaaaaauguaaaauagaaagaaagugauaacagucuuaaaguauugaguucuguugugaaaacucucacauguugaauauguguuaauacauccaucuuucuuaccaggcagcugcaguugcacuuuccucccugauucaugcuuuggaugacuuagacaugguggccauaguucgauaugcuuaugacaaaagagcuaauccucaagucggcguggcuuuuccucauaucaagcauaacuaugagguaaaacccaaagucuuaauguuauuuuuuuucuucaguuccuuuauucuaagcaguguuucucagcuguuaauguucaugacaauuacuuggggaucuuguuaaaaugcagauccucauuguguaguucuggggcagggcccagauucucuguuucucucgagaaaugcugauacuggucugugaaccacacuuucgguuggaggaaaaaguauacguuauaaaaauaauauaagaaucuuuuaauuauaaaguaucauaagaaucuuuuuauuaaguauuaugaaaaucguuuuagauuaaaagaauaaucaauaaagguucaccauggccuuuucuugguucucauccuucuugacuuauuggaaccaaauagagaaauuaccuccauuuuuacaaaugagaacuaugaauaaaggcugaggauaugauuuuguugugaucuuugugaaacgguuuauuuagggcucucuuguguaaaauacaguucuaaauuccuuaucauuuccucugucucagagaacuuacuguggccgaacuggaaagagaaggcacauaucuugacuuccaggucaaccuucuggucacccuagucuucucauuuguuguauuggucaugcauuugauagcaguccuuuaguauucuuuuauacauuucucuuaugcuuaauauucuuuauacuguuugcaguugugaacagccaguagcagaagucaaaacacuucacuuuucauaugccagaguugggcuguccgauuuuugaaauauuucuguuaugcuacuuucacagaauuugggaucaguuuuauauuuuuucauuaauuucaucguuucugcuuuuacccccuuucuuucucauuaguguuuaguguaugugcagcugccuuucauggaagacuugcggcaauacauguuuucauccuugaaaaacaguaagaaauaugcucccaccggugaguuuguuuucauuuagaucacucauugacuacacacacuguucuugggaaaucaccugucugcuaguuguugguuggggcuagguauuuauagggugcaauuaguuggauuuccaaucauacacuuagacacaguaaugaugaaggugguuuacuugguguuuuuccaguaguagggauagguuugccuuaaacucacccaacacugucuaguuuuugccuuggagcauguaccuaggggaaagcuugaugguaauggauguccaucucuaguugugagcagaguuugccccugccgaagugaaucugagcaguaucaaaccugugacuuuaguguucuguguaaagucugauguagcuuugaaaugaaaagugacagugcugaagauuaacuuuucucuuugcccuguuuuuguaguuugcaccaacaguccaagucucauuguuacuuauuucuggcuuuuaggaguuacuucaggcuugaugugaaagcuccugauugagcaucuggcugcaaaugucaggguccuauauagaauuauucuuagagccacagguccagucuuccagagagccugucauuuaaaacaauuguaauaaaauauaauagggggcagaaguagaaaacauaccaaaaagaacaacaaaugaugaguagauguuuuagguuacaaguuuauauauaaugucugugucuguguuaagauuagggaauugugaggugagucucggaacucaauucuuucuguuauuuuggcuagacccuuuggaaguagugugcuauagaaaggccaagaaucagaugggucccuagggccuguaucuuuaucuuccuucuagaaaugagucugucugcaucacgguggaggcaggcauggaccugauuauauggaaguugccacuguauuacaguauuacucugucucuauuuccugauaauuccaaaauuuaaaugaguagaauauuuaauuauuuauuuauuugagacagggucucacucugucaccuggcuggagugcagcggcgugaucauagcuuacuggagccucaaacucccuguguauuaguucauuuucauacugcugauaaagacauacccgagacugggaagaaaaagagguuuaauuggacuuacaguuccacauggcuggggaagccucagaaucuuggugggaggcgaaaggcacuuacaugguggcagcaagagaaaaugaggaagaagcaaaaguagaaaccccugauaaacccaucagaucuggagugaauaaaucuauagacuuauucacuaucaugagaauagcacaagaaagaccagccccucugauucauuuaccucccccugggucucucccacaacaugugggaauucugggagauacaauucaaguugagauuuggguggggacacagccaauucuggcucaagcaauccucuugccucggccuccuaaguaguugggacuacagguacgcgccaccguggcuggcucauuuuuaaaauuguuuguagagauggaaucucacuauguuguuguggcuggucuuaaacuccuggguucaaacaauccucacaucucagccucccaaacuguuggaauuauggguguaagccaucacguccagcccagaauauuuuuaaaaacccaguuuauugauaauuuauuuugucgacauaaaucacucaggaucugaaacauuaaauaucuucuguuaucuauuuucugugaguuaacauuuguuuacauuuucuccauuggaaaaauggaacauuaaaguuauuucauguauuucccaguagaugucuauguaggaaugcaaugccaggaugaucuggccuccugcuaccuuguaguaguaggugaaaaucacugaauguucacauguacaaguacugcccccuaccuguugcugggagggccuugaauuagcaaguucaagaugguguuggcugugccauugccugaaaccuccaugguuucaccaugaaaaguccauaaauggguaaaaaagaaauaucugaugauaaauaucuguaugcucuuuuauuuuguuguagcuguacaaaagggauauuugaaaaggugcagaauagaaguauaauguacuuuuuaggaacuacuuacucuuuuccaccuuuugccuggugacugugaauguuccagaaauagugccucagguucaacagcugaacugcuguaugaaucaguaaaaugaaaguuacacacaguaguuuaggcagaaguauuuuugggagaauugccuuucguccauauugcuuugggcuguaccauuuuuauugacugaguagauuuuuauugaggagcacuuguuuuuuauuaguauuaggagagaccuaaggaaagaggaugucguauuucugcucucauggaacuugagaguuugaauggaguagggcaagacauguacgcaggugugaguagugucauggaggcauuaagagaggagagagcuuauucagccucaguagauugugaaggaaucagcucacccugauccaauggugucuuccuguuaaggugcuguacucugauaaaaguuauauuaaagucauuaaaaugcuuaugcuucauuaccagagagguuuuuucuuuuuaauguuuuucuucuuuagcuaauuacuaguuuuuaaaauauuagcucaauggauacuaaauauuuuguuccagucuccuuauagggauugguuuuuauauggcuguauuccucugaaacaaacuuucuugcuuuugaucugauacuccauugucagaggcucacugaaugguagaacuggaaccuaaucagucagucacucuaaaucgaucuuuucauggauaagaaaaccaagacuuggguuaaauacgugcauagcuagagaauacuuuggcagggccaggacuguauaaccugccaauauugccguggauaucucuacguagaaagcauuuguuuuaguggagaauaauggaaauaaucauuuuucuuucggcuucucuguuuaagaggcacaguugaaugcuguugaugcuuugauugacuccaugagcuuggcaaagaaagaugagaagacagacacccuugaagacuuguuuccaaccaccaaaaucccaaauccucgauuucagagauuauuucagguaagagaagaaggaugaacaagucauauuucuuuuaaaugaaagagagcuaagugcaaaguugcgguaauuggccaguccuaaauaaaugucuuuuuucucugaaggccccauuugcucuauuuaauggaagaauaacaucuuccucuccuacuucagaagguaaaaauauucugagcucuuaaaaagaaaaauaaaguuggaaugcuuucuuucuuuucuuuuuuuuuuuuuuuuuuuuuuuuuuccuggaagaagcuuacuuuaacaaaaaaaauacaggaaggccaguugccuaugcuggagugcaguguugugaucauagcucacuauagccucaaacuccugugcucaagcacucuucccgccucagucuccugaacagcugggauugcaggcacaugccaccaugccuggcucauuuguaaaaauuuuugugaagacaagucuuggccacgugcggugguucaugccuguaaucccagcacuuugggaggcugaggcaggugcaucacuugaggucaggaguucaagaccagccuggcuaacauggugaaacccugucucuaccaaaaaauaaaaaaauuagccgggcaugguagcacgugccuguaauccgagcuucucaggaggcugaagugggagaauugcuugaaccugggagauggagaguggaguuagccgagaucacgacccuguacuccagccugggcggcagaaugagaccgagucuuuaaaaaaaaagaaaaaaaaagguuccuaggcuggucuuuaacuccuaggcucaagcauucugaguagaugggacuccagguguauaccauugcccccagccagaugccucuuuuauauuuuuucaggcuuuucuccuguauuguauguaaauaacacuuuucuuuguuuucuauaucaaaauaguaggagagcuuauaugaacucuauaauaauauaacauuguuagagaagaaguguucuaaugucacauuucucaaaaauuucauaauuaaagggagcauaggggucagauaaaaagguuauauugugaaauuauuaaagaauaauuaaaauacagaaaauauaaaaaaucuucugaaucugaguccaaaggaauuggaaggcagagauuggauuaagguaaauuggggaaguugacaagagagcugacuuaugcugaggaaggggagggcuagaccaagguugaaggagaaaggaauauuccaguccuggauucaguugaugacagcaggacauaggcuucucugacccccacaaaacugaaaaaaaaauuauauaagcagcuuuuuaaggcaagcuguugcucacagaggaguagagggcccuuuucugcagguuggggguaacagggcaugugcugcagagaccacagauucucccuuaugacucacuucaugaaacaucuguaacuaacuuaaguccauauuggggcuugugauuugagggauccucuacuugaaagaaacugccuguuuuuuugaugcuuguaauucuuuuaaguagugaaaaaaaucuuuuguucuaaaauuagagaugugaagcuuaacaugugaagacuugacucugaauacucaugccccucaguuuaugauggggauacacgccuauaaacccaucuaaguugagaauauaaguugaaaaugcauuuacuacaccuaaccuaccaaucaucauagcuuagccucaccuacuuuaaaugugcucaaaacacuucacauuagccuacaguugggcagaaucaucugacaauaucaugcacuguaaagguugucuacccuugggagcugcagcuugauaucacugcccagcauuguaaguguccuacugaguucuacugaaugaguaucgcuuucacacuguuguaaaguggaaaaauuguaaauugaaccaucauaaaccagggaccaucuguacucuagcaugcuaaguguaaugaaguauaaauuacagauauaaaaauccuuugguguuuuuuuggcaaauguacuugaagaccuaaagccuugugccauuuguaggaaagguaggagcagaccaguucaaagcuuaccaaaaugguucacuguggagaaaaagagaaacuucuauuaauacuauuuugcacacuuaucuacaguagguuguauuuaucuuuaauaaaugcuuauuggaauaacaaacagauacaagccauaaaugcaggcauuuuuauauuccaaagcugcugcaagcacgggcuuugauuuuuauuaguuuguuuugugggggagaguuuuuaauguggcuuaucuauauaaagaaguaucuucacuaggauacauaaacuuaaaaaaaacuuauuuauugaguacuaacaaugaaccacgugcgaaagauacuauaagcugcuuuuuuuuuuuuuauuuuuauuuugagacggagucucacucugucacccaggcuggagugcaguggcgugaucuuggcucacugugagcucugucuccugguucacaccauucuccugccucagccucccgaguagcugggacuacagaugcccgccaccacgcccggcuaauuuuuuuuuuuuuuguauuuuuaguagagacgggguuucgcuguguuagccaggauagucucgaucuccugaccuugugauccgcccgccucggccuccccaaagugcugggauugcaggcgugagccacugcacccggccaagcuuacuucuuuuauggaccccucuagaagaaugagaaaaguagagagagaaaaaaccaguuguuaaaacaguggugggaaaacaccaugagaauaagaagaaaaagauuuuugcaagugggugacuuagggaaggcuuugcugaggaauuagcauuuggacagaguucuaaaagaacaaaggcggugcaugugguaaggagggcaugccaugcaaaauaaauaacauggaaaagcaugaaaauaugaagagccaggauguggaucccuuuggcugcagaauaaguucuguauggggaaaugauggaaaacgugacagagaagguaaguaguaaguagguugugaauaccuuguaugccauacucagucauuuggauuuuacagcaguggguaauuaaagaauuuucaguggcccacuugaaggcuuaagaguuaaagcagugauggagagaguggagacgagaaucaauucuuaaggcauuuagaagguauagauagaacuugagugauugauggaaaauaaagaggacuugaagauaacaggauccuagcuugggugacugaaaagaugaugucaccauucaauaugauaaggaauacagaaugagcagguggaaaagauaauucauuuauuuucacaaguguuaaauuugagaaaaucuauuggauauccugguacagacacucauugggaaguuacaaacaggguugcagagccuagaagacaagucaggucuaaacacagauuugagaguccuccucauugaggcagaaagacaagugaguaagauugucugggagagcacacugggugaguaggagagagaacaaaguagagaacugcaacacgugagugaacaauuagacauauaaaaaaggguuguuacaaaaccaaaccaaaugcuccuaccuccauaccccaauaaaaaucagcgagguagaaaacuaggagaaaugcaucuuggaaggcacaggaagagacgaguuggaaaggaaggaaucgcaagucagaugcacaauggggaguagaggugagcuuagcaaagggucuuuaggaauuuguaguccaguuugaggacuuuggggacacagaaucaguugaguaauggugugcaagccagguuacaaugccuagaugagaaagacuuucugaugaagggagagagaaagagaggacacaguaaucuauaggagguugugggauccaggaaggccacuuuuuucuuuuugaaauaccuacaguuaaggguaaaugagcuuggagaaggagagagagauuaauaauuaauuuguuaucaagagguuaauuuaauucuaguuuuggaaagaaaugcugaaaauauaucuugucaaguauacaguuaaaaccacuuuuuaaauaauugauacaauggugcuaaaaucaguauauugguaacuuuugagcuauuguggucuguagguuuuuccucuaaucuuuuucaaauuguaaaaaucacauccaguaacaguugcuuaaaagagaaauaaauaggugaucucagcuucccaucuacucagaaaugucacuuucucauaaucccauuuuuuuagugcauugggaauuuuuaccugaaugaauuuuguaaguaucucgcuuagcuuaauuugccuaaaaugugaccuuucagaaaauaugagagggagguugguaccucagaacaucucuuguagauccuuuauuauugacuuaacggaugaugacacugaaaagauugccugggguuuaugcugaaaaucuggaauguuuuacaguaggaagguuggguaggauacuuguccauugguuguucuagcccuuuuccaagaaaugucaauuggauaucacagauagaaucuucaggaguuuaugagagguagucugcuauguuggguguuugauuacugcuuuacaucuuuaggacuuucuaagcuguucagguauuuuaaugaaccaagggagagcacugugaauaaaggauuaugcauaauaagaagguggugaggggguagauucacagaguuugggaucuuuuggauuugcuuaaacaguuuggggauuaccuugcuuuacauugaauaggccugauguuacugaugcucaagggaaagucaaguaauuaggaaagaagaaagcaggcaucaaacucagacaaacaaaugaauauacuauggagaaggaauaguugugguuggugguugaaauggggaagggagcagggagaagcgcauggaauuucuggaggaaauugguacuuaauuccuacuucaggguuuucgaaacuuacaggacauugacucuuggaugauacuauuaaaccuaagcaucuuuuauuuuuuuagaauagaaacuuucagcuuacauuuucuucaguguaggaaaggaguccaggggaccaggggauaguauaaaucacaugcuuugugauaggagcaguauuuugaaauuacaggagcucuucagcucccugguguuuuguuuguuuuuuuuagaauuaccaauuuauaaguuguuuaaaagugggaauaguuauaccuuaauuuuggaauuaaucuucaucgaaggaaggaaaacaucaauaaacugauaguuucauuucuuucuuuguuuuuuaaugacaucuaaucuuacugcuuucuauacuccuuuuagagcauuuccuuuucugggcaggccaaggccuggcccaguagacuugaggcaggauaggugguugaaugagguggcaugcuguguagaacuucacucacaugggcaguggagaauuugcccuggccuugaucuuggcgccccucccccuugguguugcuucuugacaccgcugucaacaacuagagcccuggaaaagagcacuuuauuccuucagcuguuaucggccaggugcuuauuaugugccagguaguauuuuuggugcuuagaauucauucagcaguaaagaagagaagagcccuacuuguaaggaggaggguuagauaauaaacaaguaaacuaaaaaauugauaauuuuagauaaugauggagccuauaaaaaauauaaaauaagggaagugacagaaaaugacuggggugguagaaugggguggaggggcuacuucauauagagugucagggaaggccucucugcggagauaguauuucagcaaagacuaaaaugauuuuuaaaaaaagggcaaggguggagcugacucuugagguuuagggaaagacagaggaggcagagguaguguuaagcccaggccccaaaguuaggaugagcuugguguaugagcgaagcaggagcccagccuauugggguugugagugaggagaacaaguggcuggugaugcgaucgaggaggcaagcagggcugcaucauaggacccuaggguauggugagcaguucauucucggaccacuuccagucagacaguggaaagagaagcugggaaaccaguuagaaggugacugguaggccagggaugaggugauagggcuugggcaagaaugguagcaguggggagagagaaagguggauggacuugugcugaaaagugcaaacucagcacucagggacaacucaguauucucaucucuuuugcagaccucucucugggacucacugagcaugggcagcuucccuguagccaccuguuucauccaccacauggcauucucugagauuaagugagggagaaagcacagcaugauuaagagagauaaaaggauuauaacaagaaaguuauaaucccagauuaucaggucuuagaaucagguauuuuagggaaucuuguauauuccccaaguaguaaaaacaacagcuuugauuuauaaggugaggcuccuuuccaggagguccagagcagaagauacuguugcuaggcuuggaucuauuuuuacaauugguuuuagguauugaccaauauccugccaacaaaggugguucuaggugaauccucuugauuguuuuuuacaugugguaugaaucacuuagcccucccacacuaaagauggaggaucccugaucagaaaauauaaagaagccauauaugucuccaucuguguuuuaaaauccuuacuuuuuccaacagugucugcugcacagagcuuuacauccccgggagccucuacccccaauucagcagcauauuuggaauaugcugaauccucccgcugaggugacaacaaaaagucagauuccucucucuaaaauaaagacccuuuuuccucugauugaagccaagaaaaaggaucaagugacugcucaggaaauuuuccaagacaaguaaguacuugguauaguugcauuuaacauugggguacauaagaguuguggucauuuuagaguggcucuggaagugucacauaggggucuauggaauuuaaaaggugagaggaagaagccuuuugcuauuuggcccuuauauugaaauauugauuucuuauaucugucugcugugaucauauuuuauccuugcuguucacuuuggauuuagagcuaccuucugggcugaugacuuuuugaucagcaucagauucuuggugaauuauauauaauguauaauucagauaaguuucugaauaucuaaggcuaaaugucacccuuuuuaaaguaaaguacugagaaugaguguguugaagaucauagguuuuuuggguugggaggagauuagauguuggggaugucaaugagauuuuuggaggaaaagugggaacaagagugaaaaacuaucaauucuucagccguucuauuaguguaucagugauguauuugguugugcuauuggggagguguuuguaguuuuaaguauugcaaaaugcuuuucauauacacuuaaaucaagcuuacaacuggcuauuaaguuuuuucccucuucuguucacaaucugugucagcuuccauucaaaacaaaacaaaaauaaaacaagaagaaauuguuguugcuuauccagaauuauuugaguauguaaaauugauuuuuaccagguuuaggucaaccaguuauuggugacuuuuuuuucucaagcuggaauaaucuauacauuucuuuuggcuguauuuugaaaucugauuuuaaaccaugaaucuuuuccccuuuuuuauuugauuuuucucuccacaacuaucuuuauugacaaagcuucuuauuuauaaauaccccaguggagaaguauugaguaauuuccggaagucuucacagguuucuauaaaucauugauuuagagaauuacugucuaaauugaauagaaaguugugcacauucugugacuuucuaaagguuaacauccaagcuuugucagaauugaaaaaaaaaaucauguacuugguuccgccgcaccaacugcccgccccccauaagaccaucucucaaggaaauugauagauuguuucuugauagauuuuaugaugugcauuucuuacacauccuggagagguuuucauuucuguuuagucuaucguucuacacaagaagacugucccuaaaaauucacuuucccccugcuauccuuaucuaccuucuggauuuguauuuuaaaacaguucaauaaaagucugcagccuuuucuuucuaugacaccuugcugaagucucacugcaaucacagggcuauucucucucuguguguuaaaucuccaguccgugaucuugauuaccuucugguguugugggaaagaaaugggccauuuucugcucuucccuuugauuaaaauguaaauuagcuaguuaaaaaagcacaccacccagacccagaaggaugcaguucugucguuugaucccugcuaugaucacaccuuuggcucugguccugcugggcacucuucuggaagcuugggugugcugagcuucuuguucuuugcucccauaauggcucgcagcauagcuaaguuaaucuugcaggggccugagaaguaucuuacucacacacgcuugcucacgcuccuauucucucucucuucugagaaagcuuaguuuuuaagaauuguggaaaugauucauuuagcaaauauugaguaccaccuguauucaagaagaaugguucaguccuuucuacaagguucuaaaaccccucaauuuugaugauaaagcuccagucaguucuagagguaguuuuuccaaggaaagaaaaaauugccaacaauucgcaauguuuuuguauauauucaucaucucuggauccaggguacauauuucuaguggaggggagaggggcuaagaucaggaguggacaaaugucuguucaggaaguuuaaucaucuuaagagcugggaaucauuccaguuuuuucacuugauaugauuuuggugaaauaauuuuaccuuuaugagauuuucuucaccuaaagaaaaaucucaagagauacuauaacaaugaacaaagauauuaaagcacuuugagcaacugacauccuucacuuaacgacagggauacauucugagaaccgugucauuaggcaauuucguugugcgaaugucacagaguguacuuacacgagcccacaugguagaaucuacuacacaucuaggcuaugugguauggccuuuuguccucaagguacaaacccgugcaguguguuacuauacugaauacuguaggcauuuguaacaaagagguauuugcauauauaaacguaucuaaugauagaugccuagggaggcugaggugggcagauaaccgaggucaggaguucgagacagucuggccaacauuuuuaguagagaauccccaucucuacuaaaaauacaaaaaugaacugggcgugguggugugugccuauagucccagcuacuugugaggcugagacaggagaaucucuugaaccugggaggcagagguugcagugagcugagaucaugccacugcacuccagccugggcaacagagcgagacuccaucuuaauuaaaaaagaaaaauaaaagaaaacguaaugcuuugcgcuaugaugucaugacagcccugaugucacaaggcgauaagaauuuuucaguuucauuauaaucuuaugagaccaccauuguauauguggcucaucauugaccaaaacgucauuccguggcccaggaauguauuuggagggaaggcaauagucaaaaccuaaagcaauaauaguaucauuaucuauaaaaacauugaaccuuugagaagaucugauauuugucuuggacuuguugaauaccuaguguuagaagugauuucauuucaagaggauaagagcaccauuugacacuguagacccaaaauauacuaaauauuacccucaucauauaaaagcauugcuuccauuuauguugcuguacacccuugaaaugaaaaugucaucucuuggacggggaacuugcaugagaauucggacaucucaggucuaauccugcuugugcagcugauguauacgugaucuugauuucuguuuaugcagguggucuaaagcuuucugcucuuuucagguccacgaagacuccuucucacuuacucucagcagacauccucacuugguuaaugguuaagacuucagacuccagagucagccaauaugagucagaccccuugcucugcaguguggccuuaggcauagguuacauauccucucaaagccucaguuuccucauggguaaaauagggauaauaggaauaucugucuuauagaguugucauggggguuaaugcgagcaguguaugcuguucacucuuguaucccuaggaccuggcaaagugccuagcaaauaguaagaacacaguguuuggaguaaaugauuuuaaaaauccuaguaauaugccuggcauguuaguagugacaaugacaguagaggccaauaggugguguauuagcaucacucaugcugcuauaaagaaauacccaagacuggguaauuucuaaaggaaagagguuugauugacucacaguuccacauggcuggggaggccuugggaaacuuacaaucauggcagaaggcgagggagaagcaaaggugcaucuuauguggcagcaggcaagaucgaguguauaucagcacagaagaaacuaccuuauauaaaaccaucagaucucaugagaauucacucacuaucacaagauuagcaugagggaaccgcccccauaauccauucacuucccacccgcucucucccuaaacaccuggggauuacaauucaaaaugagauuuggggcucggcucaguggcucaugccuguaaucccagcacuuugggaggccaaggcagguggauuacuugaggucaggaguuccagaccagccuggccaacauggugaaacccugucuccacacaaaaaaaauacaaaaauugguuggcugugguggcacaagccuguaauccagccacucgggaggcugaggcacgaaaauugcuugaaccuaggaggcggagguuugcagugggcugagaucacaccauuacacuccagccuaggcaacagagugagacugucuuaaaaaaaaaagagagaaaaaaauuugggugggaacacaaagcguaaccguaucaggugagaacuccgcaguuuuguggcccaucuuaucucaaaacauaccuguuuuugcauguaccucccuucuuuuccugucucagugaaauaggguauuuauuucauccugccuaaagugaauuccuuuaccugugcccuggauccuuuuuuuucuuguuuuuuuuuuuuuaauuuuaguuuuugagacagggugucucucugucacccaggcuggagugcaguggcagggucacagcucacugcagccuagaccuccugggcucaagugaucucccaacuugaggauccucaguagccuccugaguaacucacgccggcuaaguuuuuuauauuuugucgagauagagucuuacuuuguucccuaggauggauuccuuuuucugcuucaucugguaccuuaggccacuaauaauuucuucucucuuucuguauuuuuagcuucucccucgcuaccacuaacuccuuucuucucucauguuaaauuucuuucauuuaacacaaaauagucccccuagcuucuucccucuaauuacuaccuguuacuaauuacuaaucuaauuauuaucuuuccuuccagaagccaggcucuuggaagaauagucuauucugcaaccuuucucagcucucauucucaccagcuuuugcccccaccacauccuugaaacucaucuuucaaaagacacuaacugcuaaauucacuucggcuuugugguucuuugcuuucuugaccucuuugaagcacuugacacugucaguuauuccugcuuucuugagacucauguaucugucuuaacuucagcuucuccaaauuuuucuuuuucaaucuuuggcagcucccucucagauuccugugggggcugcuuuuguguguuuuuguguugauauucuguagaauuuguccucagaaacagcaaacauuuauugaaccuuaugcugaagauaaugggaagccauuaaagcaaggguuuuuaaucaggguuccaaagauugauaucaaggaaucugugaacuaccugaaauuacauucagacuucaaaacuuaauauguuaagugcuuuacaugaugcuaagugcuuuacacacauuaucuguuuggacccacguugccauccuaugaaguagauucuucuguugacccccaacuuaaagcucaggagacucaggauuagagaagaugagaaacuugcccaagauuguaguugguagguguuggaguaaggauuuaaguguaggcagucugacuccagagcuuguacuucaaacuguaaugccacuuugccuuagcaaugcaugucccaagaccucuuuuuuauuucagagccucaaaaacuacuaaauaccuaucuucagcucggauuucuaucccaucaacuaaauagcuuaggugccuguaggccccuccaguucaguaagccagaaauggcuuuguuaucugcuuucuucuuccugcuccuuuccaaccccucuucaugcuauuauucucuauuucagugaaugacaccuaauuucuugggagucuuccuuuucuuuuacauucuauauguaauugguuuaccaaguuguauuauauuuaccucaaaucuaacgcuuucacuuaagguuagucugguggcuaauggcauugauuuuggggucgaauuuggagcuaaacucaagcauuuccccuuaaaagcaguugaaauuggcaaguugcucagugucaaguggcaauaacaaaugccugccuuccaggagguugguuaggagaaugggugaguacaggauuaguucuuucccuuuacugugugcuuuaaacaagggaucaaacuuucuucaggcuuaguuugcucaucuguaaaaggaugcugauaauagcuaacucauaggguuguugcaaaauuuaacugagauaauuuaaauguguguaacauagugacuagcacaugguaagcauuaaaaagaaacguaagcucuuaauagcaucgcccacugccacugcuuuuauguaggccuucucauuuuagccugccucacugacauaagcucuucacuaauuucccuaauuugucuuaccccuuuccaauucaugcugcuaccugagugaguuuaaaaaacaaaccugaucccaucacugucuugcuuaaaauucuuaaaaguagugauucuuaaucaugugugaaagacagagagugcagugaacucacuugauacaaaaucuaugaacugucuucccagaaaaaugcuuuaacauacuaaguuuugaaguuuggauauaauuucugguaguucacagauuccuugaugucaucuuuggacccccaauuaaaaaacgcuugcucuaauggccucccauuauccccagcauaaggucaaacucuuuuacacagauaagagaauccagauaagcagaaagaaaagaggcaucuauucauaauccaacuaucuagagaaaaccauuuucuuuuuuuaaaguaaauaaaaaugaacuuauuaaaaaaaaccauuuaucauuucacaacacaucaauaaccaaguagaaaauaaaaaaauauauaaaagccugggcaacauagugagaccucaucucuacaaaaaauauaaaaauuagcuaggcaugauggcacacaccuguagucccagcuacucuggaggcugaggcaggaggaucauuugagcccaggguucaagguggcagugagccauuauuacaccugugaauagccacugcacuccagcuugggcaacauagugagacucccaucucaaaaaaaaaaaaaaaaaaagacaaggaacuaauaauuaggauauacaaggaccucuuggcaaaucaaaaaauaauuuuucaauuuuuccauggaaaaauggucaaagauuauaaaaaagcaaaucacaggagcagaaacucagcuggcuuacaaguguaugaagagaucuucaaucucaauuaguaaucagaaauguaaaucaaagcaaaaaaaaacauuggcaaauauuuuuaaacauuagaugauaccaguuguuggugagaauaugggagaaacaggaacuucuguguacugcuaagggggaauguaaacuguuacaguaggacauuagaagcaaccaguguacucgucacuaggggaaaauggucuguaaacaugguagauccauaucauggauuaugcugcaaguaacagccacauggacagaucucuaaggucaccacugaaggaaaauuaagaaaaagaauaagaucuauaauagccuauaucaucuuguacuuaaaaagcacauacauaaagcaguacuguguaacuuaauaaaaauauauacacaucuaagauguaucugauauaucgguggguacaagaggguaaguggggugcagagggagugggaaaauaacuaugaaggggaaagguacuaaaauacaacgagaagggccuggcacagcccauauuugauaaugugcuaagaagucauuagaaauuuugaaugacugaauucccuauaccugaggucccccuuuaaaaagcucacccuucuuauagacgaagaagcgaagacacuaaguuacaaugauauaaauuaagcuaccaaugacaaagugcucagucaaccuucugccuuguguugauaacacuaaucugcccuaguuauaucuaaagaaaaauauacuuucauacagauuucacagcuuuucaacauccauauaucuggaaagauaagaacauuuguauauccuuccauaugaguccuugugauucguugaggccauagguuaaguuuccuuucagucauuccaaggagaaucagcaugaccaagcaaagcagguuccaaaggcaggaagcagaagcaauaugaugcuguggagguaccuuucugaaacagucucuucugcuguuguggggucuuugggcaacccuucaauuuaagugcuuggcaacaagucugcugagauaggcugaccuuguagcuuuuguagucucuaucguacagcacuggucagaucuacauaagccucaucgaugcugacgcauucaaucacagcaaaacaagacuuccuccaucacuucaacacuggcuucccgguacuuggugagguuagcuuucccaugguacucacgaacuugugccaguagaagaccuggacuuaacuucuuugcaucaucugccuacauauagugaccccaaaugcaagagcuucauaacucacugcaauuauucuaccaccuuccaugauuuguacuacacagcugcacaagauuuauuccucaaaugaggauuuugccgcugcuccauuggaacaaagucuauguccaugagaguaaccacacaauccuguccaguagccauuuuucaagguaacagacaccuggccagacugccagcagugggugccgcaaaugcugggcucggugcccacuggaaggaaaauggaagaagggcuuuugaauaucuuuucgccuuucuggggagaguuucgagagauuuauuccccgugaugacagaggaacagagaaggggucgugaaggauccugcccaggcgaccguccccacaguucagcagggaucagccgagagcagugugcccagcaacaaagccaccagacugaggacagacagcacgcacgcugccuagagaaaaccauuuucuuuccucacguuuuuuaaugcuccuaauuaauguguuuucuagcuccuucucucacuacgucccagcuuuugcaccuuaugcuuuaacccaauacaacuauuuucuuuuuuuuuuguuuuuuuuuuguuguuguuuuuugagacggagugucacucugucacccaggcuggagugcaguggcgccauuguggcucacugcaagcucugccucccggguucacgccauucuccugccucagccuuucgaguagcugggacuacaggugcccgccaccaugcccggcuaauguuuuguacuuuuaauagaggugggguuucaccguguuagccaggaugaucucgaucuccugaccucgugauccgccugccucagccucccgaagugcugggauuacaggcaugagccaccacgcccggccaauacaacuauuuucuauccucugaaagagauaggccuaucacaguauuuuguuaauugucuauauguauacuucaauuuuuauuuggcugaagguguugaugguauauuaauuuuuguauauugagaguuuagagucuagcuuaguggcugauauauaguacauauucaguaaauauuaggcuaaauaagugaauugcaaaauucauacauguuugugaaagaaaauaagaaaggagaaagaacaaauuacccauggucucaucauccagaugcaccaacugcugacauuuauaugucuacugugaucuuguguguauaaauuucuacuuucuagagcuuagcgccuucauagauaauuuagggaagagagucauuacccuuucccacuucacauagagauuaugaauuuaguguaugcaaaauuccuaauaaugcuguuaaaugauuuggccuggagaauauuaaccauacuaaauuuuacuguguugugcauaugacuggggcuacuuuuacuugccugguacgggaaaauuguguaugugucuguuuacccuucuuucccuagaaccucauuuuggaggguugaagaaauucuucaugugauucaacuucauauucccccacaacuuagcuuuuuauguguaauccuucuuaauacuacuauauaagcuaaucuguauuuguggaagagaauaguugauauacugaugguaguuuucaucauagugcuuuccuaaggagcagacugaagcucagagagguuuguagcuuacuagacucuaaacucuagauagauaaaaauuaguacacagugaacgccaucaagaagguguaagauuucagggcuagucaguggcaaaaucgagacuagaauccaggucuuuugacuccaacucuucaguaguuuaauguuguuggcuugucucuugggaagaacuggcaaagguuaauugaaaugacuggcucugaccuuuuuuuuuaaaacagacucaacuucuaauggaauuucauucuaccuuggauuucuccuuuuuuucuuucauuuuuccacgaaggcuguguguuuauuuuuuauucuacuugcaagaaaagaguucugggugacuuaccccuuguaauguuuccugguucccacccuucugucuucuacuuugcucuugucuacuucucaaagggaaaacauuuaguggugaaugggaaagaugccaaauagugaaaauuuuaauucauggauguauggcugugaugauuacuuuaguucuuuuaccuaccucuaagaggaaauucauuauugaaauugaggaagcccauauauguuuuauuuucucuuggcuucauuuuauuuuuaaaauuuauuuuugcuucauuuuuaaaauaacuucauuuucaagccucauugucugaagguugaggcuuugagcaaaaaaacaacacauuuagaaauucuaguccugaaaauugcugagaaauuuuaacuguucucauaauaaaauaaguaaaugaaauaaugcauaugauaauuagcuuaauuuagcuauuucacaauaaaugcauauuuuaaaacauuuuguacaugauaauauauacaauuuuuauguuaaaauaaaugaauuuuuaaaauuucuagaucuugguuacuaauucucuuaucauuuagccauuucugauggcugcuuuugcccuagauugcauuucucucugggagaaaaaaaucuuaauuucuuuauguucagcagcuuaagggagauuacaggcagagucuuuggauuugauuuucuucucuuuugcaauuaacuugaccuccucuugacuuuaagacaggcuguuaaagccagcauguugcuugaggcaagauguuugauauacuuuuccuuagcacacagaugcuacuggacuguuagcauauugcacaaaacagaauuagguuuauaaaagaacaaauuaaaaaguuuucggggaaguuuuuuuuuuauaguuuacgacuucuuuaagagggaaagcucuugcauaguuaauuaaggauugucuaguaaguuuugacaguuguaaacagaggcuuauaaagcucuaacauacaugauagagaaaacggguuguuagacacaaaggucuucuguguacauggaaagcuaauagcugucaauucugagacaggaacuagaaaauaauaucugaagaguaaauggauuucuuacuuaaauguuaaauuuccauuaucugugcuugcaguuucaucuuuuccaaggaccuuaugaugugauugcuuaauucugauucucauacugcugugaaacaaagccagggcugccucaaguuaggcccuuaggagcccgguggcuaggaaagggaggcagcuuguuuguagaaggacuacauguagcuauuguuuuucuuuucuuuuucuucuucauuauuuuucuuuucuucuucuucuuuuuucuuuuuuuuuuuuggugcuuggaaaauaaguuucacaauagcaaucugguuuuguauuguuuguucuaagagaaauuuuuuuuuucuuuucuagccaugaagauggaccuacagcuaaaaaauuaaagacugagcaagggggagcccacuucagcgucuccagucuggcugaaggcagugucaccucuguaagcuaagcuuuucaagugcgcuucccccuuugcaggaagguuggggcuugagggagagugcaucaauuuuuguuaguccguucuuaccacuuucaaguuaagaucaugaucacuuucucugguccuugcucuauagaagccaaaaagacccauuccauacuucuuuaaguaauuauuaucaugaauugccuacagaauuaucuauaugauauaagguauauagagcucuuuauagaacguggaacaucucaguguugagauuuugcuguuggcauuauuuugcagcuuuucaacuagucaaaaugauaggauaaguggggguuagugauacgagccuuaaucuucaaguacacacaauuuaaguuaguauaacuuuccuauuuucuaacaugcaacuuuagaacaggauucacaaguuuaggauuuccccaagaauguauccuuugauacaugagauuuuuauugaaugagaaauuuuuuggaacuugaaaauacuaccuuaauuaauuaauuaauuaauuaauuaauuuuuauaucuuggucagccaggaggaagaauauuuuauuuaauuuuagagauagguugucacugucacccacgccggaguacaguagugugauuuuagcucacugcagccuugaaauccugagcucaagugguccuccugccucagccuccuguguagcuaggacuaaggguacaugccaccauacccggcuauuuuucauagagguggggucucaguauguuacuccugggcucaagcaauccucccgcuucagccucccgaagcacugggauuauagucaugagucacugcacccagccaaauagugccuuguucuaagcagcauuagugugaaucaacaaaucuuaaaaauuggccgauaacuuuuuaacacaauguacuaggaaggauagucagggaauaaagggcaugccuuuauucucaccucaaacagaaacucagaaaaauugaaugugugaaaaaugauuuagauuucauuuagauguuuuauauauaauaguaaaggaaaaagucaugaucuuguucugagagcuuuucugcuuccuauauccaagcaaacuggaagcuuuaguauauuuuggaaccccauuguuuucuuucuuaugagcugagugguucuuaggcccugugaggguuggggccagcagauuaaaaacauagguauaaucagaaaguuccauauaauauggcaguuucgucuuucaaacuuccucacccagcacugcaguacaucuuuguacauaaucugcuuuuacuuucugaggacauguucaaccuggguaugcuuuguauauucuaccaaaacuucagugccaaagggucagcagcagucccacuaaugggcacuucggugaaucaggcauuaagcuguauuucucauguuaucuuaguggggcaaaucuauucgaaaccgaccccacacugcagaauccucggcuuucuaauugguugggugacaggauauacaggcagucugugcuacacaaagccuuccagcugggcuggcugguggcuugaguuguaauacuuuuuugacccuucuggaaagaaaucagcuuucauaaagcaaggugagugaaagcacagagggcagcucuuggaccacugaaaucugccggccuuucacagagcccuagaaaugaaaaugaauagaaaagcccuucucuuugucuuugguuuuauuuuauaagagcacacuuauuacauuaagccaucuuguauugccuggggugcugcuaaaaagagaaauaaccuguagguuuaucaucuguugguauauuuuagguuggaagugugaauccugcugaaaacuuccguguucuagugaaacagaagaaggccagcuuugaggaaggugagugguugacuuugcauuuaggagaagcuguuuaguuaagcuaacuaauuuaaagucuagauuaagaacuguagccuuuuguuguaacacuuuagcauuuuucuuuacuggcggaucuuugugguuuucccuuguuagggagcucacugaggcaacauuaugagcacaugaaagugaacucagcacagauuuucucaaaaggaacuaauuuguaggucucccuacagaaaaacuuugggccaacaccuuggcgcuuauagcuccacuucauugaaguuuuuuaggauuuugucgugagcuauaaauaaaacacuuuuaugucacaucuuccuauuuuauuuucuuccuuuuuuuucuuuuuuuuuuugagauggaguuucucucuuguugcccaggcuggagugcaauggcaugauuucagcacaccacaaccucugccucccgaguugaagcgauucuccuaccucagccucccgaguagcugggauuacaggcgugcaccaccaugcccagcuaauuuuguuuagacgggguuucuccauguuggucaggcuggucuugaacuccugaccucaggugaucugccagccucagccucccaaagugcugggauaacaggugugagccaucgugcccggccacaucuuccuauuuucagagacacauaauucuuguuccaguccuaagaguuuguggcccauuuauaguagaccuagaaagaccuugaugcugccccuaaauuuaauccuucucaaaauggcugcauggucacuuuuccuuaucagguaguaccuagaaucucauuuaggcuguggcuaacauaaaaauagcuuucagggaugcacagagggccuggaacuaacauucauucacuugauugcauucagguuucuguucauuuacccuuuaaaugguggcaacuggcaguuguuaauccugcagguuuauauauaaacuauuauauucauuauugcugguccaagucuggccugucugcgagcugacuucuacguaugugaguguuuauguuuguucauguguguauagaacuuucucuuccaacauccugcagggagcaggggaaucacuuuuuuuuuuuuagugacagggucucgcugugucacccaggcuggagugcaguggcaggaucauagcucacuauaacguuggaccucugggcucaagugauccucccacuucggccucccaaagcucugagauuacauguguaagucaccaugccuggccaaaaauuacuuuuuuucuuuuucuuuuuuuuggggggacagaaucuugcucuguugcccaggcuggagugcaguggugagaucucagcuuacugcagccuucacccuggccuccugaguagcuggaacuacaguugcauacccccacgcccggcuaauuuuuguauuuuuagcacagacgggguuucguuauguuggccaggcuggucuugaacucuugaccucaagugaucugcccaccuuggucucccaaagugcugggauuacugugagccacgguggcaugagccaccgugcccggcccaaaaaugagaguuaaaugccuagaagcacuacugccugcaguaggucuaaugcaucuuacuacuugcagucuaggaauccuggcaagauccccagaucuacugugcuguuguccagaggcaagcaugagcagcugagccucagagagagcuuacagucuaccaggcuuaaauccugucagcaggaaugccaaaggccaaaccaugagaaucuccagaggaagaacagcuucguuaucacaguaaucugcagucucuuaagugggguguauauguuuuugguuuugagauggaagaagagcuuuuuguccugcuaaaaguugccauauaggagaaaaacuuugaguuuuaacacaaaacaaaaccucauguaaauagaaggagaucugaaguucuaagugacaguuuucuaggauuggugaaaacaguacuucagaauuucucucuuuaauguauuggagugaucaagacacuuucacaguauuauaccuguugucuguucagcuguauauuguuacagggugcucggaaaguggcggagaugcugcugugacaagucaaugaacucuugucuaucaagacuauuguguuuuugaaggaaaauugagacuuuccuagcuuucaauuguaugucgucaauuaccucagccagucaaaguccaaggucccccguuuggaagugauuggacucugugguugguguaggcauggucuuuucagggacugaaucuagcugucaucaccauuauaugguagccacuagcgguuucauauuuacuauguucaaggcauugugcuagcacuuuuauguuauuuuaauuacccugcauuagcaguucugcaaaaucuugugaagaaaugaagaaaauguuagagcuuuaacagcuuuugccagaauuuucugagaggauugcuuuacuugggaaaauaacuuugauaagugcuuaggguagagaaugagucuccauccccagacuugguuggcuaguccagaggcuucggaggaaaggaagcuccucagcaucauagaaguagaaaaacuggagcugguuuaggagaggaggggcuuagaagaagaggggagaggcagggagacaaagugggugaauuuacgcacagucacggccuucuacaauacguuucaaacucaugaccacaaauuacucagugucaguacaacucuggaaaugccagguuuaagugcuguauuuggggaaacuggcaguuugguaucuggcauuauuucaugcagagcagagaaagcaccugagcacacaggaggccagagucugaaaagaccaggagagagucaguuacugagaaucuacucacaucuuaggaaaauaugucuuaccccuggccaugggauuggggauucagagcagucuugugaaaauagcaagggcaagcggacccuagauagcauguaaguuaacaauuaguauuauuaucuccauuuuacugauggauaaacuguaaaauuggaggagaugcauuuucccaaagaucacauaggaauucaaacacaugucucuuucaaauacuggauuuuuuacguagccauauuguuucuuuugauuccuaaugacuuccuuuccuacgcuuuuuaaaacaacauuuuaaggucguguaucugaaaccuuguaccuacugauaggacuuuugaugaauagauuguucuuuuauauugaauuugacuuugagacccagcauguugcuaguauuucgacaaaagaugucccucugaccuccgucuaagacuuggugaaucagagcccucuagugaugucacaaaaccagacucuccacagagcugucggaaaauggauugcuuauuagcaacuaguucucgugauuuuaacuuggcuuccguuuuaucccuucugccguucuuggugccagcuccagaauugauguccuguucuuuguuuugggcaucuuguuuguuuguuuuuccgcuagggcaucuuuuuacuaacgcccuuuauaagccaagacucacuucucuugcaggcccaaagaguucucccucccuaguaguggucuucuuuuagagagauuucuguccagagucgggagacaggaaucccuuccccuuuucuccaguaaauuuauuuuuuaaaauucaguugucaaaagggcgaucagcgauagauaguugguaagauuguuugacccuuagguagaacucggcuguuuuaccuaucauuauaaauuaaaauauggguguaguuacuuuuucucaggccugauaguagcauaaucaaacugagagucuugugauucuguccccgacaucagcagucuauauauaguaggcagcuacacauuuucuuaacuucugguuuucagugugagggauguaucuuguucuaagcuuacuggcagagaggagauaaccaaugcccugaaccccaggaagcauguucuuucuggcugcccuuuucccagucccuuuccuccauucucccuacccaucaccauucuaucaccacagaguuagaauagaaaacaauuuuuuuucucuuuuccuuuuuugugaaggggucucagucugucgcccagacuggagugcaguagcaugaucacagcucacugcagccucuaccuccugggcucaagugauucuaccaccuccaccccgccaaguaccuggagcuacaggcacacacuaccacaccaggcuaauuuuuguaguuuuuguagagaugagguuucgccauguuauccaggcugguccugaacuccugaguucaagcgaucugccugccuuggccucccaaagugcugggauuacaggugugagccaccaaguccagcucagaaaaaauuuugaccacagcuguauauauaauaaucaucuaucaguuaugaaaguaggguuguuucccuacauacacuauucauaagcacaucauugccaucaucugggauuuguuaccugucguuguggguuucagagucuccagaggcucuuuacauugaguuuauccacuuguuuggauaucuuccacccagcuaaucaacagaguugcuaaggaggaaugccaugauuuucagcuccuugcgcuuucccaacuuaggaagaaugcuaaaauaaaauaaaauaauaaaaugucaaaagauagacagcagguucaagaaggaaaagccacauuacuucuuuccuccggacaauuccugcgcgauuaugucugaauuuauaaauucccacugaguaugggagauaauguaaaauagcuugaauguucuuggugugucaaaaacagguuuugugaggaucuuaagagccagaaaggauggauauauggggacagauaaaaggauggaauguaacuuaacuuuauaaugagacgauucucuuucagggaccuuguuuuugccacugagauuguaguuucuguauuaggcuuguguguagugacaggguggcagagcuccauguuaccaaauugaauucacuugagccugacugguuuaaaaaaagucugucaagagaagaccuaaguagaaauaauacagaccccaaacagccuuaacauuugacucauguacaagagagcaguaauauguacuuguccauuugauuagaaggugaucacuucauuuuuuuccccuuucacuuuguuuggauuacgucucauccuagagucuuuuugccuuuguucuucaaccuucuuuaaucucacuuacuagaaacauccuuucauuuuuaaaagauauuuccuaaaauucacuuuuuccaagcaauuucagcacuagauagaauaugguacaauuaguaauaauaugauauucaucaaagccaaauaguuuucaguguugguuuuguaugguauagcacuaucccauuugcauagcuguuuacuuacauacauuaugugauuuucugccaggagucaagcccuaaacagugaaccuucgagaauugugaucuagcagaaaucucucucguguguguguguggguuugugugugugugugugugugugugugugugugugugugugugugauuuuuuuuaauugauccugauucauguaaucuuggguaugaauuauauaaugaauuauacucugcccagauagauaagaagauaaaaauauggcguuuuucuacacagcgcugguaaauuuaagaaaaauaagcucuuucaaauaccuugagcaucuuaaagaugcuaaauacaaacagucacuaaaauuuuaaacaucuuuagcccuauaaaaguuuuuuucuuaaagaauuugacauacuuuuuuaguccuuucuccaaauagcauugauacaucuaaucaugagaaaauucaugauuaaggauuccagagguuuagucuguacuuuguauuuuuauuaaauaucucacuuguuuuucacugguuuucuuuuugacucauuuuaaauuauuaaaccucagaaccugacaauccaggcuuauuuuaugccucauuuaucaggacaaguggucucauuguaacacaaaaaucaguguguuuggaauuguagagaauacuugcugaaaggguguguuaucugacaucguaauuaugcaccauuggccuuuaagguguuguucaucuuucaugugggcggacugaggcccagaguaguuaggaugacuuuucacagauaauugcaaauaugugaaagacucuggaucaaauuccagagagccaauucuuggccucuguggcuuaaaccuuuuuacugguuguguauauuucauuggauggcacagcaccacccugaaguuuacaucuuaauauaaugaaacucagcagccaaauaauuuagaugaaaucauugaaauagagaugaaaagaaaaaauaaaaagcacaugacguagaaacuaaagaccauuaugcacacauaaucauuuuaaguauuuucauuuuucagcgacucuuccuaaaaggcuuucaucuauucuuacccagccuuuaaaauccuuuuaaguuccugucaaucuguaucagaauaucccuaauuacaggauauagcucuuguaaaauguagccuggcuauccauuaagaaagagaaaugugugguagcauaaaaaugaaagcauguuugcuguaguuacauucuguuaacugaaaaaaaucacaagaucuauaaauuuagaaaaagagagcuuuauuucuuauaaaggguuacagcuugcaagguggaaauagcaaggccaaguggacccuagaucgcauauaaguuacaguaaguauuauuauccccauucuacugauagauaaacuaaaauuggaggagauacauuuuccccaaagaucacauaggaauucaaacgcaugucucuuucaaauacuggauuuuuuacuuagccauacuguuucuuuugauuccuaaugccuucuuuuccuacacuuuuuaaaacaacauuauagggucacauaucugaaaccuugugccuguugauaggacuuuugaugaaagccugggaaaggcuauuccuagucuauucaaaggcugggaaacauggccuccagccaaagcccagagacaggcacuaugaaggaggguuugggguaagagcauuauugcugaccugauugacuaaacauacauauucagcagguuacaggaggagcuaugaauauucaugaaggugguccugaugcaugaguauuaaacaugcauguuacguaauacccauguucaccuugcagggaagacuugacauuuaaauauuacaguuagacccuguacaucaaaaggucuuuucaggacacagcaugcaaaugugccaucuuuguaaaacccacuagaaccaguccgugguugguggucuucuuaucaggagaaaguuaccgaaaucacucucuuguccaaucaaagcuguaguuauggcugguggaacaagaguucaguaagucagcaucugguagagcugcaaauuguuuuaaaaacaauauugcuuaucccaaggccagugcuuuuuuagcugcuuaagaaaaagaaaaaccuuuuggcaguuagaacauaguuuauucuuuaaguuuaaggggugcgacuuaacccuugccuggcauggccuuagguccuguuuacuacaguuuguucucucagucuuaugauaccuauuuuaaaauuaaugcuggaagguugugucuaaauugcaaaaaggagggguauaaugaaaugcaccuggccgggcgcaguggcucauggcuauaaucccagcacuuugggaggcugaggugggcagaucaggaggucaagagauugagaccauccugggcaacauggugaaacuaaaaaaaaaaaaaacaaacuuaggugggcaugguggugcgcaccuguagucucagcuacuugggaggcugaggcaggaaaauugcuugaacccgggaggcggagguugcagugagcugaaaucgugccacugcacuccagccuggcgacagagcaagacugugucucaaaaaaaaaaaaaaaaaaaaaaaaaaaaaaaaagaugcacuugaccccuugucgugucaugaccaaaaacucaguuaagguuuucugggauccccuuugucaagaggggguccauuucaucaguggggagcuuaggauuucuaguuuacauuucucagugagcaccugaauuucuuccugagagcuuuuuaaaaaguccuuaugaaauauaugacaguguuccuguuuucucccaguguuuuguuuucucaugcuacauaggaaaguugcuucccuuaaaugugcugaguaauuuuucucuuuuuauauuaaaaauggaaagaauaauuucccaucuggcugaaaauggaauucaugaaggcuuucucagcaucauaacuagaugagcccagaguccauucaagccuuuacuuaauauacuaaaucacuccugauaccagucuucuaugaaggagagagagagagagagagacacuuuuaaaccaugagauaucaaaagaacucacugucacaagaacagcaaaggggaaguccucugccgugauucauucaccuccuaccaggcuccuccucuaauuugauaugagauuugggcgggacacaaauccaaaccauaucauuucagcuugcaucaaugacuugggccaucagugcaacaaggcaggugcucacaauugguuccgauggaaaugcagaacucuugggugcuuaggagaaagggccugcagcuugcucuuagaauucacccuugcaguaagugcuaaugaguaugauuugugagacagagagcaguucaaggauuuacucauggcaauuugguucuuucuuuccaccuccuguuaaauucugcaguucuuccuuccaugguaggucauugucaugucauguaggguauuguacuugguucuccuugaauugggcugucuucaagauugcuccuuaagcccagcugguugaaaaaggaaaccgguuucagauugugcugaugugcaaacugcuuuaaucaaugacuugaagugacugcugguggcaaacaacagacgcucuuaaccaauuaagauauuuaggaaaggauguuaggcuuuuguuaaaauagucacuaaugaacugaaauguguuaagaggagccaagaaacagcuaggaguuccacuuaaaugcaauaaaaguguuuggguccuccccuuucaaauugcaugcccaaggcaaaaaauaugcugacacagaaagaaguggcaaguguaauuugguacaguuagccugucagauccaugcgugucuacauaaaaccuagaaaaaugucgugcuugcuucuuuggccagaaaagggaagggaguuuaauuccuuuauagaacaguuucagcagggcuggagaauauuaccagcuuagaugucuuuggaaaugggagaaaauuuaacuuguuuuuagagguuccuuauguuuuagagguuggagaaaaaucuucaguuaauagucauaauuaaaggcccguuuuuauuuuccucugucagauuaaacuacugaaaucuguaguuaucuguucaugucucucagugguaaugaggcucagccauaacacucaggauaauaugguauuucauugguagccauuugaagucaggagccauugcucauauaagaacuacuuuuuuacaauucccuugcucuuggaauccaauaauguuuucuuggggcauugagaguaagauacacugucuaaguuuucauacuuauucugugauagaaacaucuaguuucucucuucugucugugguaaaucucuacaagucucuuagauaaauugcacuuauuaauucuacuuuuuaaaauagcuuuauugaaguaaaaucuucuacuauaaaauauacugguaaguauaauuugaugaucuuuuguaaauuauagaguugugaaauuaucaccacaguucaaagaacauuucucucacacccaaaaauuccugggaccuguucauagucaguuugggucuggagugcacacagguggugggagguugcaaggugaugcuggccuacaugacuuguucugauaauccugaguuauugcaccaucuguugaaugggcuggcgccaucuugggccugacgaguuguaaauuagcugcagccuucaaguaauaacccggugguggaacauucuauagauaccuggauugucucuggaacuucuaagcaaacauaauuagacaagcuagcaaugcaguggagugucugguggaaaggaggagaguaaagguuguuauuucauaacuaaaaaguuaauacaaagggccucagaaggaaaaguuuaagaaaaaaagacuaaaaaauagaauacucggauacacuccaacuuuguucuuuucuaaaaauguuuuaacuacucuaugucauuugcguuuccauggaaacuuuagcaucagcuuuucuuuucuuuuuuuuuuuuuuuuugagacaaagucucacucugucacccaggcuggagcacaguggugcgauccuagcucacuguagccuccaccucccggguucaagugauucucgugccucagccuccugaguagcugggauuacaggcaugagguacuacgccuggcucauguuuguauuuuuuuaauagagacaggguuucgccauguugaccaggcugguugaacuccugaccugaggugaucaaccugccuuggccuccaaguuuugggauuacaugcgugagcugccgugccuggcccagcuuuucaauuuauaugaaaaacccacugguauuuugauagggauuuuauugagucuauagaagaguuaagggaaaauugccauuuuaauaauacugaguuauccaugaacauggaauaguuacucauuuauuuagaucuuauuuuuucuccauaauguuuuauaguuuuuaguguacaagcuauacagcucuuuuauuaaauuuauugccaaguauucuuuuugaugauguugugaguggaauuguuuuuuaauuuuauuuuuggauuauuuguugcugguauauagaaaugaaauuauuuauuuauuauaucuugcaaccuuauuaaacuuauuaguucuugugguuuuuuaaauauacuucuuaggauucucuacauacaggaucauauugucugcaaauaaagaaagcuuuacuucuucuuuuauaacuuguaaguuuuucuuucuuuuuuuuuaauuauuguacuggcuggaacuucuggcacaguguugaauagaaauaagagugaacauccuugcccuguuccugaucuuaaggaaaaaccuuugucuuucacuauuaguaugauguuaguuguaaguuuuacccagauuuccuuugucagcuugagaaaguuuccuucuauuucuaauugguugaaaguuuuuauuaugaauggauguugaguuuuguuagaugcauuuucugccucuauugagaugacugugauuuuuauucuucugcuaauauauuaauugacuuauaguuguuaaaucaaccuugcauuccaaguauaaaauccagucguucuauaaaauccuuuuuauauguacugaauucauuuagcuaaugcuacaguuugaauaaugucacccaaaguuuauguguuggaaacuuaauccccauucuaacgguguugagaggugggaccuuuaagaaguaauuaggucauggaggcaucauucucaugaaaggauucaggccauuaucacuugaguggguuaguuauaaaaaggaugaguucggccugauuucuucucugucucuggcuugcuucugccuucugaugugggguggucuccuccagcugccggugucaugcucuuagacuucccagccuccagaacugugagcuaaauaaauaucuguucuuuauaaauuacccagucuuggguauucuguuauagcagcacaaaauacacuaagacagcuaauauuuuguugggaaauuguuuguaguuuucuuguuuugugugaugucuuugguuuugguaacaggaaaauacuggacucauagaaugaguuaggaaguuuccuucucuucaagauuucuauuauuuauucuuuacauauuucauauaauuuaccagugaagccaucugaguucuuuguggggagcuuuuguuuuguuuuguuuuuugaauuuugagauuguuucauuugaaggucaccuuaaugcucuuaaauucaaaaauaugcuaauuuaaauaccaaauccuauuaaucuaaaacacacauugcaaacauacaaauaucucuucucuucacaugucagugcccauucaugucaugguuuggaaauggggacaguagauuccccuugagcugcaagucagcauauguuucuuuauaguuaacuuuagcaaaauuuauacaaaauaguaauuaacaauaaucuucuuuauuuguuaacucaaaagaaaauaccuucaaaacugcauuuuaaguuucuguacuaaaauacagaaaaacuacacaaauauugaaaaguugaaaguucuuuaauuuuuuuauuccuguuaucacuaccacaauuuacagggcaauauacuugauguaaugaaaaagaaacagacaaagcuacaacagauaaaagagcucaggaauguacgucuaaucgacacuauauugcauucauuaauagcugcacuuuugcaaacuguggcuaugauaguccugcacaagaaggguuuucuguuuaagcugcaauaacuuuucugaccauggaucaccauuccuucuguggcagauuuuuacaguuccucuaaugcauuugggaugacuaucucaaauaaccugcaacuuuugugacaacuccuuguucuuucuccugcuaagaauuguagccccucucugcuguuuuuagaaccuucugcuaccauauccgucacgucuaccgccagauccguaaccaccaccaccacaggaacuccccgagcuucuuccaccaaaacugcacccuuuaauggguucauaauuugauuguuuuugucugcuaaaauuuccagaaucauuauaguucccaccaccaccauaguuaccacugccaaaauuuccuccuucauuguaaccaucauauccuucaccacuauccccauacccgccauugugguuuucauauccugguucaccaucuccauagcccccacuacugcuguaggcaggcccaccaccauuguugcccaccgucaccuccacauccauuauauccaccauuacacccuccauaaccaccucugcugccaccaccucuacuucuaccaccagagccuccucuuccaccaaaguuuccaccacagccaaaauuacuugcaccacuuccagaguuuccuccacaacccauaaaguugucagauccaccuccaucaccucugugauccugcagacugcaucucuuguuuagaaagggccuuuuucacuuuacaguugugcuuguuaauagugugguguuucuaaacaacaguuuuaucaauuguaucaugaucaucaaaaguuaaaagugcacauucucucuuuuuccacucugucauccauaacuuguaugguuucagucuugcuauaguuuucagaguaauuucugaaacuguaucuacuuuaauaccaccagcaaaaauguucuucacuguuaggugggcaccaggcuuuacagaauccucucuagaaacaacugucuuugguuccacuccacacccaucaaccuuguguggucaagcacacauugcuguguccaccucuucaacacaagagaaagccauaaaaccaaagccccuggaauguuugcuugggguucugucauuaccacacaaucugugagugugcccccuuucucaaaauguucucuuaacccaucaucuguaguuuuaaagcucagaccaccaauaaacaauuuucucagccgcgcuggauuccuuuggaucauggccuuccuccucuuggcggcaguggcaaugacaacggccagagucagccuaggggcaaccggguagugguuuuaccuccauuuuaagacuagacuugccuccuccaacucaaguucaacauggaacugugaggaagaggcugugggaagcuuuuuaauacuaauucaauuuuuuucuuuuuuuuggauacggggucucacucuguugcccaggcuggaguguaguggugugaucuugacucacugcaaccucugucucccggguucaagccauucuccugccucagccucccaagcagcugggaugacaggcgcccgccaccacacccggcaaacuuuuguauuuuuaguggagacgggauuucaccauauuggcuagguuggucucgaacuccugaccucaagugauccacccaccuuggccucccaaagugcugggauuacaggcgugagccacugcaccgggcccaauuuuuaagcuaauaaaucuggucaguuuuaaaauuucuuauugaaucaguuuuaguaauaugucuuuauaagaauuuguuccuuuugucuaauuuuuuaguauaacauugauuauuauucccuuauaauaauauuuuugagaucuguucuuuauuucugauuuggggauuuuguaucuucccuuuuucuuggucagucuagguaaaggcuuauggauuuuaucuuuuuaagaucccagcuuuuaguuaguuuuauugauuuucuccauuauucucauuuaauuaauuucugcucugaucuuuauuauuccauuccuucuucuuacuuuggcuguaauucacuuuucauuuucuuguuucuuaagguggaagcuuagaugauugauuugaaaccucuuuucuaauauaggcauuuaaagcuauacauuuccugcuaagcaguuuuuuagcuucacaccauaaauugcgauguguuaugauuuuguuuucauuuaguuuaaauauauucuaaugucuuucaugauuguuucuuugacucuuggguuauuuaaauguguucuuaaauuccaaauauugaagauuucccaauuucuuccuguuguugauuuuuaauucuguuaugauuggagaucauacuuugaguggcuucaguccgucugaauuuauucagacuuguucuuauguggucucacauauagucuguucugccaguuguucucuauggccuuaaaaaguacauguauucaccuguuacuaggacaagugugcuggaaaugucagggcaauuugguugauaguuuguucaaaucugucuuuugacuuucuaucuaguuguuuuccgugacguuuugaguauugaaaguuauucaccuugagaccuugugugcuagugagaccuuuaugauuuuggucucaccuagcuaaaccagcuugggucaugagauccuagugaauuuuuacagggugacacuaaagaaaacacugucaauucagguaauagaguauauguuaaauaaaagucuucagguauuggcauuuuaggaaaaauaaacuuagcuaugugugcugcaagacuguauguguuucugaauccucugcuucgagggaaaaaucauauuaguagaggauaaguuuacucaguacuggaaaaauuguguagauuuuaggaacuuguuggagcagaaaggcgauuaauugugagaaaugaaagucaauuuuaguggcagcagguauaucaaguacaucaagucuuaguucaauguuuauagauuuugaaaauuuauagguucauuauuccuuucauuuguuucuucuuuugucccauuuuugucaagcauguauuuauuuuguuugaauccuuuuuugucucauggacugagaagaaaauauaacuaagguuggauuaucccacaauuugcucugugucuaauuauucugagguggauuguaaugaagccagcaagacuuauacauuggaauuuuaaauguaugggauuguaaggaggguagaagcuacaaaccaaagauaagauaugccugcagaucugcuucagauuuccugagggcaguagaugaaauuauuucuaagggccuuuuucaccacugcucuuuaaguauaugaguaauaaacaaaaagaacaaaguaugugguucagaaggaauaaaacaaaaaagaaagaaaaggaucaaugaaauagaaguauugugucaccccaugaaaauugucuuccuguugagagcucacuagaaauagaaacaauuguuuuuuaucuccuuguaugacaaucucuuaacuguuucgagaugauuuacuugcuucuuaggcuuccauuaaaaauaagcacaugcuuauaugggggaaaaugcaaauaguaauauaauagcauauaaaguuaaaaaguggacaucuccuucuuuauugucucccucccuuugaaacucugcccauacccacauucugugucuucauaggaauaacccuguucaucccuacugaugcccuguauugugaucaagaugguuaauuguuuuaggguauaauaaauuggggauauagucagagacaguacauuuugggagaacccuccauucccaguggcaucaagcagcuugaucaaagaaaagaaaaagguguacaccaagaugagaugaggcauacuuaguaagcaauaauaaaacgucaagaugucuucaugcauauaaucaugacaauguuggaugugauaucucaucccuguacaucugcauauauaucuuauauagcauguuauucuuucugcauuucccccuucaauagagcuuuauuguaaccauuuccaucucuguaaaauuaagggagggaggggauaaaagagaguucuagacugucuacuccccuaaguggcagccagugcuaaauacacagcuuauggguuuaaacugaacgaacaacaaaaagacauguucauuccuuaggcuuuuagaggaauaaaccagugaggccuacaccauuuauucauccauucaacaauuauuuguugaaugccuacugugugccagucauaccaagauacagacaguaaacaaauaagaaaauauaugucaaauggugauaagcauuuguguuaguguccuagugcugcaguaauggaguuccacaaacugagugccuuaaagcaguggaaguuuauccuugcaguucuggagacuaaaguccaaaaucacaggacugcuuccuucugagagguaugggggagaaucuguucaaugcucucuuguagccuuuggugacagcuggcaauucuugcaucccuugacuuauagauccauuacuguaaucucuccuucucucuuaacaggggaguucuuguaugucuguauccaaguuugccucuucuuauaaggaugucaguccuauuggauuagggccuuuccuagugaccucaucuuaauuugaucacacaucugcaaggacucucuuuccaaguaaggucacguugugagguuuugguaaggacaggaaugugggggcgggguggggauacuauucagcccaugacagcacuauagagaaaaguuaaagcaggauagugggauagggaaugcuggguugagaugggcuuauaauuuuauguagaggaucagggaaguccucacuguugaacugagaauugaggauagugagagagagaaccuaguggauaucugggaggagagcuuugcagacagagggagcagcauguucuugagaagcucaagaugacuaugcuuggcuagaagcaucagggagguccgugugacuggagcaaagaaaguaggagcugagaagucagagagcuggcugggguacauaucacauaaggccuccuagaccuuuugcuuuucucugagugaaaugugaaaccauugaagaguuugaaguagcgaaugaucugguuuuauauuucauaccauguugaggaaaagggcaagguugagguaggcagaugaguuagaaggcuucggcguuaauccacgugaccggagguaguaagaagagguccgauuuuugaucuguuuugaaaguagaauugucaaguuuugcugaucauuugaauguagagugugugagagagaaaaaguuuaaaaauaacucccaagauuuuuagucugagcaacuggacgaauugccauuugcugagaaggagaagauggucaugcaggucuggacuucaggaaaaaggucugaguuguauguauaaaucguggagaaggagccauagagacuuuaagacaugagacuggaagagauccuugaguaacggagaggcaugggaucuagggcacagguggaagggguaacuuagauaacacacagacaguucagcaaaggcaauaggauggaaggcagacuauaugggugcagaugcagguaggugacuacuuugaagaauaauucguggaggggccggguacagugguucacgccuguaaucccagcacuuugggaggccaaggcggguggaucacuugaagccaggaauucaagaccagccuagccaacauggcaaaaccccaucucuacuaaaaauacaaaaaucagucgugcaugauggcuugggccuguagucccagcuacucaggaggcugaggcacaagaauugcuugaaccugggaggcgggagguugcagugagcugugaucaugccagugcacuccagccugggcaacagagcaagacucugucuuaaaaagaauuccuggaggagguuggcauaaccugguccauuaugguaaagguggauaggagagggcccaaagaagggcauucuaaggaaggcaaccaccuaagugauggcguguccugauguuauuaaugggacuuucuccagaaauaagcaguguuguuaacuguuguuuugccccuugaguaucuuuuuuuuuuuuuuuccgagauggaguuucgcugucguugcccgggcuggagugcaauggcgcgaucucggcucacugcaaccucuacuucccagguucaaacaauucuccugucucagccuuccugaguagcugggauuacaggcaugcaccaccacacccagcuaauuuuguauuuuuaguagagacgggguuucucuguauuggucaggcuggucucgaacucccgaccucagaucauccacccgccucggccucccaaagugcugggaauacaggcacgaaccacugcgcccggccuugaguuucuucauuggcauuucugacaacuuuguauccauuucucuucugcuuucuaaucaucuucuaauuuacuucucaggucugucuuuuccuuuccaucuuaucacuauccgaauucaggcuuucauuauuuuaucauuggacaguuccagcauccuucauuaauaaccuucaaaguucuccuucauuccugcccauauguuuguacagauuuaaguucuuauagcacagauuuuauucugggucagcccuuauuaauuacucccauucagucccccauucaaggcuugccacaaucuggucccauucugccacucccgacccauucuuauacagauucccucugugaaccuuguauucaaaccauguuccugcuaaugcccuugcagcaucggcuuucuaaagcugauuaacucuuuuaaaaaaauggccauucuuaucuuuacccccaaauccuacucuaaagagaugcuugugauuugagaaccgguauaucuuuggaucccaaugccgcccguaguuuuauuguaguaugacucauuagauacugcugcugcuuuaccaucagugagacaaaaugaccuccaucuggcuuuuuugguuuucauugcgacuuuaauaaaacagugcuugggaguaauaagaauuugaauuuuugaauuguagcagauuuacuucucugguucuuuggaucaauuccuaagucuuagccccaucaaagaagaagugcagaaucuaacgugucuguauuuugaccucuagaauacuguaaaacuuucuucauaaaauuagaaaggauagaggggggaaaaugaaaagaaaaagaagaaucugagaggucccuaaggaaaaauaccguauaaaccaaggcauuauuuaucaguuuuuagaaggaguuaucacauagaauguggucuuucuaaaauuucugguaccuaauauuuccuuucaaaaaagacucaaauucuugaggcauccuagaagacuugugugcugccucccccuuguccacccuccccaaaagcacauucaacaauggcugccuguuucucuccuuggugaggagucugacucaucauucacucugucuuuucaacugauaccugcguuucaguuccauucaauuaccaacuuuuaauuggaucccauugccagauugauuuuguguuccuguucccucuuggcugcacuguuacuaugacuacuugguaucuucuacuuacuuccuauauuaguuugaugacaucuagucagguaugaagcuagauagauacuauaaaauugcuacaguaccaaucacuauuaucuuacauuuuuccuuuccccuacugcucauuuggaauggaaucaagcauggugauaagguucuuaauucuucucuaucaauuuuaguaagcauuggcaaguuuuagaauucuaggaccuuggaaaauuguggagacccucuuccucugcccucccuagucuucaccccccaccacaacacauucuuucaggcauauggcauauauauuuccuaaaaagcugaaagauaucauuuccucauuuaauuagaaagucuuccuuuaguuucuuucuuauguuagcauaaugucucaauauucuacuuuaaguguacuccguuguagaauuggggaaaauuaguuacacuaggcagugcauguucuuuggucuuuaguuaacugcuguaugcccuauaaauauuaauugaugaccuucaggcuuuaugggauauguuuagugguuuuuuaaugguuaaacugaauauuuuuaauaaaaaauuacaagaccauagaaugccacagaaccauuccacuuaccaggaaacuuaaaauuugccagcugaccugggaacagaucuggucauauacccaagcuauuuaagaagaggaauauuauucaucagaauaaaaauguuauaucauaaugcucucuuacauaaaaugagcuuacagccagugggcuaacuggauaucauuuuucugguuucuuguuagcucccacuaccauauuuguuacacagagugaacuaaggccaagagaccuuccauaucauucuuccuguggcuacaaacuaggauucacagcuagcucaaauaaaaacagaaauaaaaggagagagaucucauagucugcaggaauggauucugacaauaaagaccuugcauuuacucuguuccuugugccugggguuuuuaauuuaacacaucaaugaaaaggcaccauuuaaaaaaggggggaaacacccagcaggacuuacuuuuauuagugcaauuuguaagaaauuacugcacuuaaugagaaaaucauuaagcaugaaaaaaugggcucugacugaacuuguggaacuuaaauggugagguuuuaauugaguuuuuuaguuauugguaagaauaauaauaauaauuuaaaaauacaggacugcaucuguguguugagguggucagcacuuugcauaucuuaguccaauuuccugugccacuggucaugcauaauauuauggcugugguguucucucugucguaucuacugauuuuucuguucugaaagggaagcagggaacuucuuuuuuguuagauugaggaaguuuggggcaaagagcuagcagaacaguuucuagaagguggaagaacuguaggcuaaggcaaagagcagagcuaugucugcuucucaguccagcugcuuaaaaaagaugacaaauuucaaugucauuuucagguuacucaagcuuaugcuuuuuuccuaguucucuguuucuuuuguugccauccagugauuuauuuuuccucaauaagaauauuucauuaaagaccaugcaacuagaaaacaagaauaccaagagcaaagagcacucuucaguccgaacucuuuuagaaguggaagcagaaagaaggguguuuaagaaauaagucagcacugugugugugugugugugugugugugugugugugugugugugauuuagagaaaaaauauuuaagauaccuucuuuuuguacuuaaaauuucauaaguacguuugacuucugagaggaccagaaugccaugggaagugcucaguugcauccaguaccuguuguuuauugucaugguccacacgguugcaugucacaaccguguuagaacugaaggaaaggaaauguauguaacucuaaagacguuucaaguagaagugaaaacaauauuuuuuuacauaauuuguuuuuuauagaaauacagcuuuuaucaaaugucugggagaagcuuuaaauaugcuuuugaacuucuucaguaacuuuuaauugaauuucauuguauccuaccucacuagaaagaaagaaaccugcaaauuuuagcuucccuuauaauuuaaaugaugccuugcuaauuucuguguuuuugagauggagucucacccugucacccaggcuggagugcaguggugagaucuuggcccacugcaacuucugccucccaggcucagaugauucuccugccuccgccucagccuccugaguagcugggauuacaggcauaugcuaccacacccagcuaacuuuuguauuuuuaguagacgggguuucgccauauuggccaggcuggucuugaacuccugaccucaggugauccgcccgucucggccucccaaagugcugugauuacaggcuugagccgcugggcccagccugaugccuugcauuucugucuccuggaaauacccaauucuuaaaagaggccauccccuugugaguucauaacacacugugcccuuagauccccuccucacccucccuucuucuguaugcccugcaucugagggaggugugggcagagcuggcucuuguagguugcauuucccaggcuccugugucuaaagacuuccuacuggguucggcaugagagauacuggugggaaguagggagggagaaaccgguguaucucuucuucccuuucuauguuggguagcaucuuugguccucagugucuucagcucccauaggacagaucccugaacucuauuuauacccuuuucuuuuuccugaguaccaagggaugcuaaggguuucuugcuguuaccaaucccgggguuacagcaccauucucaguuggcuuuaacacacuucguaaccugcaaaacaauuuccugucuuaagucuccuguguuaaauauuuggagugguuuauauuccuuguguuggucccugacugauacacacaccgccucuacccacaauggccaauuuauauccgauaguaaagaggcauaaagaaagcccgcuuuugauacguuucuuaaauugccucuguuaaaacagacuuucuuaucaggcaaauaucuuuuauaaguuucuggcuuaaacaaugauuauaauuuacagguggauuuaauuuaugguagacuggacugcuugccuagacuuuuauuugcugaugggcauuacuccuuuuuauucucuuaauaaugaauuaccugaccuuauacuuauuuugauuuaagugcuugauuuuuauugucacuuuuaauuuuguguuauaaagaugcaauugucauuggcuacauaaauuuguuuuuuucuuuucuuuuucuuuuuuuuuuuugagauggaaucucacucuguugcccagguuggagugcaguggcaugaucucggcucacugcacccuccaccuccuggguucaagugguuucuggcuaauuuuuguauuuuuaguagagacaggguuucacaauguuggccaggcuggucucgaacuccugaccucaagugauccguccuccuuggccucccaaggugcuaggguuacaggcgugagccauugcgacuggccauaaauuuguucuuaacauuuaaaauuuauuuaacugcugacauuugcaaaauguacagcauuucaauaaguaacauuuacaugaggcauugagaaagugagaagaauuaaauugggaaauauccuaaaugauggcugaguucagccaaaucauuugaggugucuucacagucuuuuauauauaaugugugacagaugagggaaccuacugcuuuuugggcucugucagauggaggagaaaaucccacaauaaaugacuuccuuucacuuuguuggaaacaucuuugcaaagaacagagguagugaguaaauguaaagucagaggcagacaugcacauggcccuggguguuuugaccuuggugacugugcaaugagaggggagguguaguccauuuuauaggacuuugggugguguugaauguauucaguagagaagcagaauguguauuucagauuaaacaagaaaacuucgccauuuuccucuucuguaacauuucuaaaucuggauaacauuuugaauaugauacugaaguauuguauugagauuaauuuugggugucaacaucuguacucauuuaagauacuggguuaguauaugaugcccauaucuaaagguuuugcauuuucuaaaaccucaaaauccaaaacagacauuugaaguaauccuggaaauaaaugacagccauuugccugacuuaguauccuaagauggauggcccuuccaauggccauuuuuuauuuuagcuacuaaugaguauuauugagucacuaacuaauuucgaaaagcauuuuggugaauuauaauuggggcugugauuuacugaguuugaagacugauaagccauuccucagcccuguaauuaauguagaagcagagaaaagcacccugaugaucagcauuuccuuuauguggggcaggggagucaaaagcauauuccagccaaauauuauagaauauuauuuuuucagccauuucugcauuuuacuuuuauuaaaaauggcagggaaaugugaagugccacaaaacuuuggaaaggaagucucuuguuuacaucccuuuugauacucaguauauucaagcgucauccaucacagcuauucccugguguuaaaugguucguuauagucagugaaccacaaaaguagucuggguagagggacagaauuuagaaucauggaccagauuuacaagccacguaacugaguauuccuagaaggccaaaaucugguuguuuguauucuuuggguuuauuggaaguuuggauauguuuauccaucuguguuucugaacccucuggaggaaagagcacaacagucuaacauguaaauaagaaaaacuaaauccacauaggcccacagauacauuaggacuucauuuuuuuuuuuacaaagaaacuggguauugagacuccugcuacuuccuuuuacaaagaauuuaugguagacuggacugccuucuuuccuguaucguugcaaauggauuguuggcuuggguauuuauuuuuguuucuuuugaauauuuuucucuguaagauagcaacuguguguguguguguguguguguguguguguguguguguguguguguguguguguucuaucauauuucaggauaaaaugagucaggaagcugguuguuuugguuuuuuguuuugcuuuguuuuuucgcaaagcaauuuaguaccuguguaguuguuucaugggcucccagcucuuaggauucccuacguuucuauccuuaauugccuaugcucuuuuuacucuuuuccguguagucuuuaugcaguaguuuggacacagcagacaacucuuuccuuuaaauaaucucuucucuuaguaucugugaugccaugaacuccugacacacacacacacacacacacacacacacacacacucucucucucucucucucucucucucucucucucucucuccccgucucccugucucucccucucucucucucugacuaauccuucuuagccuccuucuucagcucccuuuccacuauccaaccgcuaaaauuucuucuuucuucuacacuuucuaaggagccacgcuguaccccuaccucaggacucucacacacacuuucucuucuuggaacucccuuuccuccagccauuugcugucuaauccucacucuuuuuucuuccccuauuucuguccauguaugaggccauuugcuuuucuccaaacacagcuugugcuuucuucuucauacuuaggcuaauuguguuuccugcuguguaauugccaaauucuguuuuucauugccuagcuaaaaagccauguugauuugugaagcuuucuguaaucaccaaagauuuuuuaaaaauucaaaccaauuaauauauuuccuuaaaacucauagcccucuucacauuauuucccaguguuaauuuuauguauaugcauuauauucccuauucaacugcaaacuccucaaaggcaagggccuugucuucaacuuaauucugucucccacagaacauaacauaguaucuucuacauaguaguugcacaauaaguauauacuaucaaacaaagagaaacauuuauauuauagcuuccuaagauuuccuauucucauuucaaaagaaauggagaauuuagagucucuaggauuauugcccuuggccuguaaagguuuuuauuugugcccaaauauguaaccucgagugaacuuuguaucagaugaucugggaaaguacaccgcuuucuguuaucaaacauuucuguuacuuugcuuuucaagcugaaaaggggagauaacuucuguuugcuuugagcuuuuguugaugguuuucugcucugccuacuaaucaggguuguauuauuuaccuuguuuaaaaagguucaucugaacauucucucucuauuuugaauuguaauuggauauuaauucacugcugcgggauacguugguaaagauuuuugaaauugcagggaaauguuucuuuaaucccucaaguuuguuaagugcuuucuuauaauggagaucauaaucuccgaguugguagaagggaugaaacgguuacuggggauauuuuucccuuguuagaaaauugcuguauuaaaaaauacuucauccaguuuuuuaauccuuuccacaugcuguaugguccuuaggaaauaaguagauucuuagcaccgauuucauguuuuuaauaaggaaggcauugaguaauguucaggucacugugauucacagaguuaguggccuggggccuuuauugguaaagcuugaaaguaguuuucuuuagcauugugcauacacagguagcugcuagaaugcucacaggaggcugugauuuggggaaacaggcagucauagaauaucuugaacauucagcauaaauugccaaacagccacagcuagugaaugguuucaggggacaagggagaggagccuuuaggcaugauuacccacaucucccugauuuguucuuccacacacagaucuuaagggucaguuuugaucugcacagcauuaaguuuccucaugacuuuuagauuuccuuuuuccucugcuuuuuauucauacugaagaauuuuuuguuucuuuguaagguguaaucuacuuuggaaaugauaacacuaugaaugcauuuucucuuucuguagcauuuaugacauugcuugcugacaguuacuguuuauuaaguauuuguggcuuuuggaguagugagcaauagggagaauauucagguccagcuaagggcauaagguagauagcaaugauuucucauucgaaagggauauuuuguuaagacuagggcugaucuuuucuaauuuaaccuuggauugguagaagauggggugucccuggcucauuauuuuucacugcccagcacuguucgacaauuauccugaguagaauuaggggagggacuagaggaucuguuuucugugaauacaauaggaaaggcaguuuugaauuauccaaauggccccuaaauucugggggaaaauaaaauaacaacaacagcaguuuuaaaaauaacuacaaccuagguucugacaucccaaaaaggaauauuucaacuauaauucucagcauuuuagaaauuaauuucuugacaaauaucaauagguaucauucagacuuugcaaauacagaguuuugaaaucagaauuuugcaucucaucucuccccuaaaagaaguauggcaauugugcuugcugaccaugaggcuugugaacuauaauacauacuuauaggcacaaacacagaagcauacccucucucaggcaucacucaaaucuaagaaaauuuguugucuuauguuuuagcgaguaaccagcucauaaaucacaucgaacaguuuuuggauacuaaugaaacaccguauuuuaugaagagcauagacugcauccgagccuuccgggaagaagccauuaagguaaugcuauccuagcaucucuuuucuuccuaaacaguuggcgacuaucacagggaaagaggcauacagcauccuggaaaugagucugggccguggaaauuaucauucucaauaugaauagcaguguaugccaguggagcuaaaaaugacuuaaauucauguuacuaucacugucauuucugagaugggauaaagaugaguagguaggguguuuuaucccugaaaguuggcuuuuuauuguacugaagaccuggccuuugcuuucuguuccuauuuagggaaccaaggaaauuuccauuauaaccucugguggcccacucacuauuguaaaggaugggcuauuuuagggaaauggaugggaaauauauauugguauaauuauugagaaagauuuuaugaagacaggaguagggaucuaaaugucagaaaaaaaagaacacugacaauaaguuccucccaugccuuuuguguggguuuugucuguuugauuguuuuauuaggaauucuuagaaaauauuucuaaaacuuuuccaaauuauguauaggcuuuuauaucucuagguaagaagugagcaaguuuaaauuagaaagcauauuuuuuaagugggcacaguuguaguauauguucuugugugggugcuuauuaaauacuuggcgaacguaugaaugaauuaaugcuuaaauaauuuaggugcuuacaaagagugacaagaaaauggaaaaaucauuaaaauuagauucaauaacagauucagaaguagauaaccugaauacucuuagauaaaagacaaauuuuagaaaaguagagucaggacaagacugcagaugauucaguuggauggagaaagauuugguucaauggaaagagauaguaaaaguguauugcuuuuuuaaagcacuacccaggcuagguggagugucuuauaacaccucugugcaugguugccacccaguguccuuaaaaauacuaggucacauuauaucucuuaaaaaaaauaaaagagagacaagagaagcagaagagacuucagugacauaucauucagucuuaauggagagauuauuauuuuuucuuuuccuuuuuuuuuuuucuugagacggacuuucacucuugucgcccaggcuggagugcaguggcggaucucggcucacugcaaccucugccucccaggcucaagcgauucuccugccucagccucccgaguagcuggcauuacaggcgcaugccaccacgcccagcuaauuuuuguauuuuuaguaaagaugggguuucaccauguuggccaggcuggucucgaacuccugaccacagguuauucgcccaccuuggccucccagagugcugggauuacaggggugagccacugcgcccggccaagggauauuuuuugaacuguaaaaagauuaaguuuuauggaacaauuaggaaaaugagaauacuggcuaguuauuugguucuauuaagaaguuacuaauuuuuuaugugguguuaauggcaugugaguguuuguuuuaaaagacuauauuuucuauauuucauacaagaauauucauaaaugaaauaauuugacugaaauuugcuucaauauaauuggaggguuaugggagaagaaggucauaguauagaggaagcaaaauugguuugguugauaauuauuucuuuauuuuauuuuuuaucuuugagaaggaguuuuacucuuguuucccaggcuggagugcaguggcaugaucucggcucacugcaaccuccgccucccggguucaagcaauucuccugccucagccuuccaaguagcugggaauacaugcgccugccaccgcauccagcuaauuuuuguauuuuuaguagagauggacccauguuggccaggcugaucucgaacuccugaccucaggugaucugcccagcucagccucccaaagugcugggauuacaggcaugagucaacaugcucggccugaguugauaauuauugaagcuggguuaugagugugcgagcacucacuaaauuguucucuguuuuuguuugggauuuucuacauuaaauguuaaaaacaaagggcuaggccaccgcagaaaaacugacucugggaagcucugugccuuccacagauggaaggauuucugguccccagugaacacaccucaguuuggaaugccagcuucccauguaccaaagaagaacauuuuauuuuuuuguaauaaauaaggugauucagaccaaacuuuguuuggucuggggugaauuuguuuuuguguuugcucugacuugcugccuccucuaccccaacuugcuaccacaguuuucagaagagcagcgcuuuaacaacuuccugaaagcccuucaagagaaaguggaaauuaaacaauuaaaucauuucugggaaauuguuguccaggguaaguugucauuugccuuuuuuuuuaaaaaguauuuuuaaaauacuuaugcuauuuuauucuaaauauacauauaaauucuaaauauaaacuguauuguauaaugaguuaugugggaaacaugaugacuuucuacauggcuuugggaaaugcucaguguucggugaacucaaacucucccuuaauaagcauaaauacagagugauaaauaauaaauaaacauguaaguuccaucuuagacucuuuacgcagcaugaccuauuucauggcugugccuuucuguuuguugaauggagcagcugugugggcgaacauuguccccuuucucagauccuuaggccauuucaguccugcugguuccacagcccuuugguugaccucacccagguuuuaucucccugcuacuuuucauuuaccauguucuuggacuuuccguuucaacagaccagcaucuucauguaccaaaaccauucaguucuucacuugcacagcaaccaaugcaaguuaaacccagaaagaagacagcacacauucuuucaguguuaggcuugaucuuugcuuuuuuucaugcccuuugccccaccuuuuuuaaaacaugaccugauuuucuuuuagaacccaaguauaagauauuacuuguuuaaaauacauauuaugaaaaugauuauguuuaugagauaaacuuuucacuuauacuagagaugcaaaauuuguuucaaucucuuucugugugaauucuauauaaaaagaauugcauaccuaucuauccgccuucuaaugggcaacucuucaucacacagguaacuguuuuccugacaguuaauuuuucagcccuuuaacuucugcacuggagaacaaaaggaauuggaauggguagugaagggggcuuacucaaaucacuuuugugucucugcuguugaccccguaaaugaaggagauugguuuugguauuuauugaaugccuauagcguauuauuugcugaaaagaaacuuacaggucauaugcaaaauccauauuuucugauagcuuauaugccacugagagaauacagaugaccaaggccauucauagguacacauggguguuaaauacaugugcuuuuugaacaguuuaucagguaucagccauuugauguaggaaaauaggaagaagagcaaacuaaagaguagauuuucuacccuugauuugcucuuacugagcuaaaauugauuaacuguccuaaaugauagacaugccccuuggugaagaccauguuuucuuccucccuaguccucuggccacucuaucaauagccaguaacauggccacaagacaaaaugcauggcguaguuccauauugggcaccggaugucuuggacaaaagcauacagucauuuaauuaucauuuauuuauugagcuucugcuauguucuacaguaaguccucucuuaacguccauagguucuugaaaauugugacuuuaagcaaaaugacacauaaugaaaccauuuuuuucucaucaguguuauaaugaaacaauauuauuuaaguaccuacuuuuguuucacuuaaagucacaguuuccaacaaccuauugaugauaguuaaguaaggacauacuguacauugaggggaauauaaagacuuauaagacuuagugucugcccuugagaaaauauauucuuaggagagagaacauguguacaaauaguuacauaaaauacgacaagagccauuucaaaggaauaaacaaagugaucugagauuucuaaagaaggggagacuuaucuagaguugaucaaggaaggcuucauggaacacguggcauuugacaugcggccuuuauugcuuauuacacaggcaaaaacuggagaaaagauaauuuaagauggucauuguuaauugguugccuuuauaguuuuauauuuuuuguagaacagagcaccuuuauaguuuuaaaaaucuccagcucaggcugggcacaguggcgcaugcuuguaaucccagcacuuugggaggccgagacgggaggaucacuugagcccaggagucugagaccagccugggcaacauagugggacccugucucuauuuaaaaaaaagaaaucuucagcucaaaggugggaggaggugugauggaaacgaaaaugggauugggguugauucuuuguguuuugauuuuacucucugaauuacuuuuuagauggaauuacucugaucaccaaagaggaagccucuggaaguucugucacagcugaggaagccaaaaagguauugagggguaaaccuuugucuuuaguugaauuauuauaguggacuuuauuuucuugauacccucgaagaaguuaaauuuuauggguaacuaaauuaguguacucauuuuguauucaauauguaaauugcuucaaccacagcauccccaugggagaaauuauaaucuuacucaguuuccuguaggcugugguuauauuucuggaacucaccuguaaucccagcuucaguaccccuagagcaugcuguugaaccccauagugcgcaaacuuagccucggcccugguaaaggcuaugaaauccacagugauucccacccuggccacacauuaguuacuuggugagcuuguuuuucuuuuuuuucuuuucuuuucuuuucuuuucuuuucuuuucuuuucuuuucucuuucuuuucucucucucucuguuucuuucuuucuuuuuuuuuuuuguuaauacugauuaaaaaucagaauuacccuagagauucuguuagucugagauggguccugggcacaguugguuuguuugcauuuuaaaaccccucaggugauuguauuguauagugaauagagaaacacuaguauucuagcauaagggacauccaaguauuuucaguaaaagaccccaugcaguccccaugagcuucuuauucacacacauuguuaggccuaggccuccuuguuugguguguauugaaucugauucagccaugagucagauacaugugguuauuuaguucaguaguccuucauuguaccucaagguugugaugaaauuuuaaugaauuaaguugaauagcucaaaaguauauacuucguaacacucaguuucaguuacagucacugacugauguaguucugcuggcaccugacagcucucaguuacuaagcuucugcgauaugcuaggcacugugcuggaugauaagacagcaccccugcccucuagaagcucgggcaguuaaaauggagcagagggaagcaacggagacucagaaaauaacuauacacacuaagggagagcuuggucuggggcuggugaauaggaaucuguuagggaagugacagaugcaaagcuggaaauguuaaucagauggcuaaauucaggccaaaauuuaaauaucuucaauuuucaacucaagaaaggcauuuggcagaaaccauguuuggaaaagaaauuaaaauuuacaagaauuuuuauuaagcacuuugccuagcaaaagauuuuuguuaaaaaaaaaaaaaaaacuugucaucccuacuuucagggaguagaauccuggaauuuuugaagcauacuguaagauggugauuauaucucagaagggguuccguggugucuguacccucucugccacaggcaauacugagcaccauaggcuugaguaugccauuuaacuguuugguuuuguuucuguuugucacuuuauacaauguuugauaauaucuccucauugaacugggcuauuucagucaagguucuccagagaaacagaaccaagagaacguacaugugugcgugugucuguguguguguaugcacauacacacacacauauauauagagagagagauuuauuggcugaauuucagaaauuggcuugugugauuguagggcuuggcaagucugaaauuuguaggacaggcuagcaggcuggaaacucaggcaggauuucuguguuacaguccugaagcagaaaccucagcuuuugcucuuaaggucuucacuugauuggaugagaucuacgaauauuacuaagauuaaucuuuacuuaaaaucagguaauuuuagauguuaaucacaucuacaaaauacccucacagcaacaucuagaguaguguuugauggaacaacuggggaccauagcccagccaaguugacacauaauauucauugucacauggugugaagaccuaucaaucaauuuuuguuaaacaaguaaaucaggaaaaauauuuuuugucauuauuacauuaagaaaauuuauuauccaggugacaguacauacuagaguuuuuggaagaagugaggagccaugaccuaaaaaagcuuguguuuccugccagcagcacaucuuaaccaaagauguuccagcuaaguuaacccagaauauuagacaggaaagaaaucugaaaacagaugaugcacuugcaaauugugcaaggcuuguucuguaaugcaaauaggaugucuucuuugaaauguaaaggcacugagccuaagcaugaggaauuuuaaugucuaaugaugaagcuauagagagaaauuucaguuaaugaccagguagguauaagaugguguccuuagauaauucugauaucagaacugauguuaguuguaguuuaagacaacucuccugagacaggagaaccgcuugaacccgggaggcagagguuggggugagccgagaucgcgccauugcacuccagccuggacaacgaaagcgaaacucugucccaggaaaaaaaaaaaaaaaaaaaagacaacucucaaaacuucaccaucuuugaauagagagaacaucauaaaaaacaaguggagagaaucucuucuacuucagccacggguugccuggcucugacuggcaucuucuuccuuuuagagcauaguguuuccauagucaaggcacagagagugugcuuccaguacuaccagcaaaacugaacuucacugucauggcagauaagaaguuaggaaauucaacauaaaauguauugaguaccaccagcucuaugccaggcacuuugauauauauuaucucauagccuccaaaaaaaguacauugcacauucaccuagcagacucuuucacaucuagaaaaugccauuuccuuuuuuuccccacauuuaucagugcuuuagccaauguaguauguauaccagauauuuagauaacacuuugacugcuaaagaaccauucacauuguaugguguuugucuacaacacuauauacaucauaucuagauaaugguagaaaauaagaguaguagaauuuuacuuguauccaacucccgaaccaaagagcccaguauuaucucuguaaucuucacaaugaucugcuaagaauuggcaagagcaggaacuaccaucccuguuaccacugggaagccaauccccagaaagguaaagugggguuacacuuugagcucaccgagguagcaagaggauuaaaaugcacguuccuuugcaccacaccagaccuucguuuucaaguggauuaaguuuugugaauggaaucuuggaccaaucauuucuaaaauacaguacucccugucugcuucaucucaacaaaugacuuucuggccuagagccagguggugguuagaauaaccuggaagucauagaguagacccuguaauuuugacucaccuucaguguacgcuguguuauaucugucaguucucauuaguauaguggugaguacccccaccugucacuguaucaugccugacugugagauuaugcuuuugugucugcuuuaauaucacaugaacccuuuauuuuguuuuccagagugaaaacuugauccuuuguaugaaaaaugcuuuuauuuauuuauuuauuuauuuauuuauuuauuuauuuagagacagagucucccucuguugcccaagcuggaguguaguggcacggucucagcucacugcaaccucugccucccagguucaagcaguugugccucagccucccgaguagcugggauuacaagugcgcaccaccccacccagcuaauuuuuguauuuuuaguagagaugggguuuuaccauguuggcaaggcuguucucaaacuccugaccucaagugguccgcccaccuuggcuucccaaagugcugggauugcaggcguguaaucccagccaugccuggccugaaaaugcuuuuaaauggcaucuguugauuuuuggagagaaguguagaagggagaguguacauguaaaugauaauggggagaauugcagaggaagauucuggcucaaggaagcugauuucuuuugguuuuaauagaagagacaugcuuuagcuauuucucuuagccaagugagagaaguauuaucacuuuugaccaugcacugaaauauucauuuauauugccuucaaauguucaauuuggucacuucccaaauaaucauuuaaggaaacuugacuauaaucacugagguuaaagaacaauccucacagucuauuuaaauucuuuugagguguuucccauaaguuauuuaaaguuagcaagcugucaaauucuugcuauuaaauguugacauuugaaaggaaauaauuauccagggauguucauuuuaaaugaaaauuauaacuuuacauuuguauaacaucuuaagagcuauuacccuccaguuuuucuagaaauauguggauuguaugauucuuugagaaauagaaggaagucagcucugcuacagaaauagaaaguuuuugcauggcgugaguuuagacagucacuuucuuuuaaguuuccugguaccucucauuucauuuugaaaccuaggcauaaaucauucuuuaauguucauuuuuauuaucauuauaaccugucaguucuuccacuuuuucuguuucuaguuuauaugauuagauaugccauuagcauuugauguuugguagaaucuuuguauagccuuugugugcucuucaucugucaguucuccuggcucuguaguggguggaagagguaaagugaugugucugagagcucacaguaagucaccggccaggaaucuaguucuagcacugcccuaguccuucauucuccuuuaguauugagaaagcagugaagaaagaggauuuauccccauggcauugggaucuuuuuuuuuuuuuuuuuuuuuuuuaccagauuccaagaggcugagcuauaucuaaauaaucauuugauguaagcucugugaaaaaaaaaucauuauuuuagcacuuauuuuucuuguaacugccuaauuuauccuucuuuauuguuguugacauuuauggauuuuccaccuuaguaucacagacauucauagauagcaauuggccauuuuaccaauugguguuggccauuuuaccaacaccccugucuagagagguaaaguuuucugugccucacagcaagcuaguggccagcagaauugacuggaauccagacccccagaugcccgcuguagucgccuuaucaccacaccauggcaccagcucuucacgccuucaccuuauaaugccgccaaccacaucuaccuagagaaaggaugcucaugcucccuuuuucaagaguacaucugguucugugugugagagugcacaggaauucuccaaagcuuagugaaggauugaagacaaagguuaagaaucauuucuugagagcaguuuugucaaacugcuggccccuguuggaaccugugacauuuuucuuugcuuuuuucugcuuucauuuucugccuuaauucucugguguaguuugcuaguacaagaaaaguaauaaugaaaauaucacaguguuacccaauauuuauuuaaggcuugauacauuuaagauaugauauuaaauuuuuuauugagguagaacauguguacaguaaaugcacagaucuuaacugugcaacuugaugaauucuuacacauucauguaccugggugcucaccacccagaucaaaauaauagaacauuuccaucaccacauaagccucccugguaccuuccuagucagaagcccccaucccuugagguaaccacuauucugacuucugucacuugagagucaucuggccuguuuuugaccuucauauaauuggaaucaugccuuuuuuucaucaauuaugugauuauagcuauguaguaaucccuuuuaugauuuuaccacaauuuauucauccauucuccuaaugauggacauuugcuuguuuguccuuuggcaguuaugaauaaagaugcuguggauauucuuguacauaccacuugguggacauauguuaaguguauuccuaggaauuagaacaugaaacuuacaauaccauaaugaauuuuuucauacuuuaguuuaucugagacucaacaaccccuaagauagguaugguaaguaguaguauucacauuuuguuuuugagcgaaauuaguuaugaaaaggucagguggcuugcguaagguuccugagaaacugacaggguuauaguuguguucuccacacuaggcugcaggauuucccucuugcaccauguuaguguuuauagcauccauuaagcuacaaguggcauuaaugaaacccaaauauaugucauuuuaggcaaaguacaugcaaacugacuuuuauucuuuuugaugcuuuuuuacacaucuagauugucaguaauccuuuggaaucaccugaugguguuggaaacaacccaguggaagucauguguuuuuacuuugggggucaguaagggucugagcacaagaugauagucuuuuagucuuauggugguauaggacuggcaguuucuauauagagguuauugauuucauuacucugcuuguggccaggauuauauuucaguguacuugaaaaguaguagguuauccauuucauaaaguucuccagguaaggaggcacuuuuaugguaaccccagguaagugauggugguuugaggaagaaggaauaugucacucacacacaugcccuuucuaucuguucucuacuuucucagcauauugcagagggaaagaacacaugagaaaagaugagaauugacuccuaccccuuucugcagaagagauucggagaaucucuugcuuuuauugagaaagcaggccagucauugaguucucugcucuaucuugcuucccugucacugcaugggcuagaauuacuugcaguuacaaacauuaaugaugaggagugauauguggaagagaucagccuugccuggggcauugggaaggauaauggauggcagcccagcuuuuaaacauaauuugcuuacacagaaaugugaagcagaucugucaggaaaaucaguugcagacgauacuuagcacuuaaugaaaauguaggauuuuuguugcugcucauuucuuccuaggaauuuggccuagucucagagaugugccauuugugcuuaaguauauauaccauggucauacugugccaacaauaaguccuuaucuaaggggucauacaagauguaguggacuacagaaccauuaagccuauggaguuuuucagauguuuggaagauaccagucauuuguggcccuacagagauuuauggcaggaugcagcucuacuguuuauucucuugccccaacuggauaagucuuauccuguagccauauaguccugauaucacgaaaaucaugcagggguuaaugacaaugaguaggagaggagagguacaacauaaaaaguaugauaauaacccggaaaaccccaaauaaaaacccauuugagaaucuaggauagaguaguuuauuuaaccuuuacagauaaaucauaugcuaguaaauguauagauuuuuuauucauuuaucuguauuuggcugucagauaucuuuauucauaaucacccagaauaaacagaaugaaugaaacagaagcuucaucacaauucuguuacagacugucugccuccauugcugggauuuccucucucuuauaccauugauucucagucuugcacauggcccaguuuagggucaacaaagagcuauggaaagauccauaaauguccuuaaaagaagauaaauuccuuauucgcucagucauaaaagaaguuaaugaauagugagguggucuuaacugagggaaaaaaaguccaagagagugguugagucaacaaacaauuauguccauggugcugacaaaggcacugcaccuuaaggcagacacagccuccacuguuaucacuuuguuaccuguguguguuuuuguauaugaggacuagaagaacaggcagagcuuucuugcuuccugaaacuugccacaugcagccucauauuucaugguugacuuugguuugacuuuuuaaagagacauauuuuaguuuauuuauaggucuuagguuucagaggucaugauuguguccauuguaccauaaaaguaacaggaauguagagaauggcagcucuuaccauuuuuucauguugagagugaggaaaguauaauuauacuuuuuccucuuggguggaagcaacuacaggagagcauaagugggcuggaaggcucucucaccgcgugccugcuccaugcacucucagccugaagaaugccagaaugccucuaggggccagucaguugugguaccauaacugauucucuauuuacuguuucuggcccccaaaggaaaaguagaagugccccacuuuccacugcccucucuaaaacacucacuccuacaggcaggcaugcuaccagaaaaucaccuucucguguuaggauagauaggcauugcuagauagauaugcauugcuagaacccagcucuuagaggcagcugccacaugccuugaaggaaaaggcuccccacugcuaucccuuggagggacaggauggaaaaagaguguucagauaauuuucaagggcacucaccucacuacccuuuuaaaaucugagugucauuccuagauccucacagacuucacuuccuggacuuugcuguauuacuauguaucugccuuucagaagcuccagaucuagaacagugaugcugaaugguuuucucauccauuucucaucugccuguuuucaaacaauuucuaacacaaauugaaagauuuccauaaaaggaaucaaacaaccuuccaagcucacucauuuuugcauuucacguuucuuaugagaagucccccuuuuacugcuuuuguccacaguggaauuuaagaguagauuauucuaagcuuuuuuuuuuuuuuuuuccugauucuucaucauucaacuugagauuauucuaaucuugauuugauucucaugcuccuuucaaaagagcauacuaguuuggggugguugguuauuuucuuaaccuuagcaagccagcuuauuuccuauggaagcagaacuggaaacagcagauguccaccaugcuuauacaggacacuacacacugucucgacaagccauguucuuuccucccucuucgugagcacuuucucuggugaugaguuaguauggacuacuugaaccucaaaacugggccucucacccaaagccaaaugaaguagcguaugccaggaugauguuucuuuugggccguuggcagugagacugcuaagcaggcugccuuagguuuugcuguggcaaugcuagcagauuguucccucuuucaaaggggcaaaaauaucauuuugguaugauaacugacuuucuauuuacaguuucuggcccccaaagacaaaccaaguggagacacagcagcuguauuugaagaagguggugauguggacgauuuaguaaguacuuuuaauaugcaccugguguucuaugauugaagucaccugagcuguaaauacagccacaaaggcugauuaucuuacacuuguugcuuauuuguguuuuaauuuccaauacaccagaagcuuccuacaccauuauauauugccauuauaaauucaaucagauagguaauuucauaauagaaauuccuguguuucauggugucggcuauauuguucauucagauuaauccucucccuugaagggcugaaaaagagcuagggaggcuauuccauuaguagcaaaauguuguaauucacugaaauugcuguuaaccaaaaauaaguaauacaacaugcaguuuguguggguugacaaaugaaacagcccuuaaaagggcuacuucuuaaauguucucaauuaacuuaauguaaacaaaauagaccgauaggcauuugaggauuucuggaccccauuacaccauguuguugaugucugggaagcuguguaguaaaugucuuuuguaucuauccuuaauguuuggaaacuucccgccuuuaagcuucauaugacaacugaccaacaaacacuacguacuaugaugucaaucuuuuuuagagacauucucauuacuaaaaugaguggauacuugaauguuuaacuccuaaaauaaugagcggugaauaaaugagcaaguacaugcaugccuuccaauguagagucauuuucauuaaacccucucucaccagagaagcagugguaugaaauuggccugauuccuuucuaaguguguuguucuuguucacaguuggacaugauauaggucguggauguauggggaaucuaagagagcugccaucgcugugaugcugggaguucuaacaaaacaaguuggaugcggccauucaaggggagccaaaaucucaagaaauucccagcagguuaccuggaggcggaucaucuaauucucuguggaaugaauacacacauauauauuacaagggauaauuuagaccccauacaaguuuauaaagagucauuguuauuuucugguugguguauuauu

SEQ ID NO: 12740 - RNA, 633 nt, Homo sapiens
uuuauuuuuccuuuuaauuacauuuauuuuaaugcugaauuuacucccgugccauaaguuuuuguuucuucaguuucuucugggauaucuuuuucuucugggcaaccuccucuucugguuuaggaacaaucuguuccuuuuccguaaggaucaucucaauguggcagggagagcucauguauggguuaauccgaccaugagcucuguagguccggcggcgcaucuuaggugcuuuguucacuuggauaugcucaaugaccagagaaucuacaucuaaacccuuaaguucagcauuacucucuguguuuuuaagcaugugcagcaaaaauucagcacucuuuuugggccaccgaccuuguguccagccccacugcuuggccugcgcacaccugccaacuccaccauuguaacgucggaaugguacacacuguuucuguaaagugacaucuuucagauacuucguggcuuuuuguauaugcauacccuugauggccugagcaguuucacgaguguucuuaaagugaacacgaagauuggaaccucuugauuugcaugauuucgugggguucuccgggucaagugaguagcgaaccauuuucacagauuaccucaggcugcuuagggaaagagcua

SEQ ID NO: 12741 - RNA, 2654 nt, Homo sapiens
cgccuaauaccgcgccugcgcaccgcgucucuuccuuucugggcucggaccuaggucgcggcgacauggugagugugggucucugugcggccuagaacucuaucugccugcaucuguccuuguuuucuucucccgcacccaucuccucuccugccuuaccccguguucucuccugucuccaugccuuugcaggagacaccauugucggaagcuccccaaggcggaggggcgggggcgccuuggcugggccuggcgcgcuccagccggguuaacgccgggccuucggagcgcgcggccagcccugggcacugguuucguuggguugaauuuagggaaaacuaggucauauguaauucacaugucggucacacgucagugagguggaggaacgguguguggaggcuccagggccugccuggguuccaggucuaucacugguuucucccuucacucuaaacaggccaaacguaccaagaaagucgggaucgucgguaaauacgggacccgcuauggggccucccuccggaaaauggugaagaaaauugaaaucagccagcacgccaaguacacuugcucuuucuguggcaaaguaaguaaggcaaagucucuggugagaggagagggagggcagguuucuuacccaagugaggccugacuucaagguauuuuauaagccgugugcuggugggcaguuggaauuacucauaccguugauuaugaguuuuaagauaaaaguguugaugguaacuucagauuuugugagacguuuuucauuuaaagaaaaccgcuuaaacguuaauggguaaaauaaucauuugacagagugcccccagccuaagccaaaccugcuuugugggaaaugauuccaucaguuuugucuacugauguuucugcaccaacucccaagaugucugugcaucuaauaccauucuacuuguucugcgagggauuuuuguuugauaaagguuugaacguuuaugugcaaaauacugcauuacagcaaucccuguuuuguuuuugagggagaaagggaggcuuucacaucccugacaauaaggugaauccaaauuuagacuucuggaugcuuguaagagaaaauacuuacuugguucauagugaaaauugguucucuuuuauagaccaagaugaagagacgagcuguggggaucuggcacugugguuccugcaugaagacaguggcuggcggugccuggacguacaagugagucuaguuccuugugguauuuggaaguguguggaccacauaggcccaaauuccagguugcugcuggaugggcuaguuuuaacacuuucucaggacugagagaauaaggaugccuuuguauuuucaggauucuuccguggugguuuauuuucaguuauugaaagaguaaacacaaaacuaccaaaauagaagucggaaaucuaauucacagacuacuuuagaauuugauggucacugggcacauuguugugaacauugucaugauacugugcagguccauuaguggggcugaaucuacugaacguugauuugcacugcaaguuuugauaaaaauaggugaaggggucaguuaguucaaaacuguauuuggaacuugaggccaucaggaccaccacaguuucgucuuucugaacaguauuagacugcugcagguuugugaaucugcaacucaguaucaccugacagggcgauacuacaaacacuauacuacaaacuagcaucuagaccuguguuguccaauacacuaagcacauauauggcuaguguaauuaaagaauuggauuuuaaaguuucagucaauuuaaacuuaaaccgaagcaguggaaaauguugaaauauauauauauuccuuguggggguuuuuauuagggcagaauggaaaaugggaacuagagugcuuucuugguucugauaggaaagugaauuauuuauauacuuacaauacaggauggugauuuucagguauaguuccugaauuuuaugguaaaacuuuuguagucauuucaauagcugucuuucccaaaggcacuuuaguguccgcucuuauuuccuuaaucauuguucucacuguaucaucuuguaauuuauucauuucuuguaaucuguccauucccuuuuaauaaguuuaggucagccucuuagaaccauuucuuuuucaugggaugggguagggggaguuaaagcuugcuuguccacaacugaguuacuuauaaaaaaaaaagcaacucugguugagaaaucagaugcaugagauuguaugucuaauucugcaagauccugaaggcauggcucuuaaaggaugccaucauguaguuuagaagccacuaauuuccgaggaguaaucuaauguugguuagaucuuuggauugacugcagcaaaguauugguagagcagucuaucucaguauaauucuuucuaggaaaauuugggaagcgacuuuaacacaaaaacgaggcagauuuacuuauuugccauuuucuauguuaacaugcuuaauuauguuggaaacugaaucuuucuuuccaguaccacuuccgcugucacgguaaaguccgccaucagaagacugaaggaguugaaagaccaguagacgcuccucuacucuuugagacaucacuggccuauaauaaauggguuaauuuauguaac

SEQ ID NO: 12742 - RNA, 2654 nt, Homo sapiens
guuacauaaauuaacccauuuauuauaggccagugaugucucaaagaguagaggagcgucuacuggucuuucaacuccuucagucuucugauggcggacuuuaccgugacagcggaagugguacuggaaagaaagauucaguuuccaacauaauuaagcauguuaacauagaaaauggcaaauaaguaaaucugccucguuuuuguguuaaagucgcuucccaaauuuuccuagaaagaauuauacugagauagacugcucuaccaauacuuugcugcagucaauccaaagaucuaaccaacauuagauuacuccucggaaauuaguggcuucuaaacuacaugauggcauccuuuaagagccaugccuucaggaucuugcagaauuagacauacaaucucaugcaucugauuucucaaccagaguugcuuuuuuuuuuauaaguaacucaguuguggacaagcaagcuuuaacucccccuaccccaucccaugaaaaagaaaugguucuaagaggcugaccuaaacuuauuaaaagggaauggacagauuacaagaaaugaauaaauuacaagaugauacagugagaacaaugauuaaggaaauaagagcggacacuaaagugccuuugggaaagacagcuauugaaaugacuacaaaaguuuuaccauaaaauucaggaacuauaccugaaaaucaccauccuguauuguaaguauauaaauaauucacuuuccuaucagaaccaagaaagcacucuaguucccauuuuccauucugcccuaauaaaaacccccacaaggaauauauauauauuucaacauuuuccacugcuucgguuuaaguuuaaauugacugaaacuuuaaaauccaauucuuuaauuacacuagccauauaugugcuuaguguauuggacaacacaggucuagaugcuaguuuguaguauaguguuuguaguaucgcccugucaggugauacugaguugcagauucacaaaccugcagcagucuaauacuguucagaaagacgaaacuguggugguccugauggccucaaguuccaaauacaguuuugaacuaacugaccccuucaccuauuuuuaucaaaacuugcagugcaaaucaacguucaguagauucagccccacuaauggaccugcacaguaucaugacaauguucacaacaaugugcccagugaccaucaaauucuaaaguagucugugaauuagauuuccgacuucuauuuugguaguuuuguguuuacucuuucaauaacugaaaauaaaccaccacggaagaauccugaaaauacaaaggcauccuuauucucucaguccugagaaaguguuaaaacuagcccauccagcagcaaccuggaauuugggccuaugugguccacacacuuccaaauaccacaaggaacuagacucacuuguacguccaggcaccgccagccacugucuucaugcaggaaccacagugccagauccccacagcucgucucuucaucuuggucuauaaaagagaaccaauuuucacuaugaaccaaguaaguauuuucucuuacaagcauccagaagucuaaauuuggauucaccuuauugucagggaugugaaagccucccuuucucccucaaaaacaaaacagggauugcuguaaugcaguauuuugcacauaaacguucaaaccuuuaucaaacaaaaaucccucgcagaacaaguagaaugguauuagaugcacagacaucuugggaguuggugcagaaacaucaguagacaaaacugauggaaucauuucccacaaagcagguuuggcuuaggcugggggcacucugucaaaugauuauuuuacccauuaacguuuaagcgguuuucuuuaaaugaaaaacgucucacaaaaucugaaguuaccaucaacacuuuuaucuuaaaacucauaaucaacgguaugaguaauuccaacugcccaccagcacacggcuuauaaaauaccuugaagucaggccucacuuggguaagaaaccugcccucccucuccucucaccagagacuuugccuuacuuacuuugccacagaaagagcaaguguacuuggcgugcuggcugauuucaauuuucuucaccauuuuccggagggaggccccauagcgggucccguauuuaccgacgaucccgacuuucuugguacguuuggccuguuuagagugaagggagaaaccagugauagaccuggaacccaggcaggcccuggagccuccacacaccguuccuccaccucacugacgugugaccgacaugugaauuacauaugaccuaguuuucccuaaauucaacccaacgaaaccagugcccagggcuggccgcgcgcuccgaaggcccggcguuaacccggcuggagcgcgccaggcccagccaaggcgcccccgccccuccgccuuggggagcuuccgacaauggugucuccugcaaaggcauggagacaggagagaacacgggguaaggcaggagaggagaugggugcgggagaagaaaacaaggacagaugcaggcagauagaguucuaggccgcacagagacccacacucaccaugucgccgcgaccuagguccgagcccagaaaggaagagacgcggugcgcaggcgcgguauuaggcg

SEQ ID NO: 12743 - RNA, 23478 nt, Homo sapiens
ggcuaacugaaugcauaacuuuauuaaauaaaugcuuugucaugacaaaagacaaagaucaaggaguaacauaaauuauaaguugaauaaauaguauacagcaaucuucacuuuuuaagaaaaugugagauccuuuguugguuuuuuauuuccuuaaguacaaaaugcuaaacgggagccgagcucuuccgcauucagguguuuuuuuuuuuuuuuucggcuuuuuuuuuuuuuucucacaaacugguugcauuuguugauuuauuuuuccauccuuuucaccaguaaagauuaucaucguuuauuuuuguuuuuaaaguugaaaacaaaaaagaggagagaacagaguuaugguaugaauguauguaaaacuauagagaacuacaguaauauguacugugguuauugcugucuucaaaaaaaaaaagaaaaagaaaaacaacaacaacaacaacgaaaacaaccgguaggcaacucggaaucugaaggaaucuugucugacaacugugcuauccaugugggcuacggugugacaguggcgguagagaggagacuccggcuggcgaccggggacugguggaguggggugagcgggcacagggaagcugggguccccuuccccucggacccuccccaccuucccuuuccccauccaaaaggauuucaggagaggaggccagagucugugaaaugacuaaacuauauacuccauuagaaaaccaagaaaguauguuugaaauagaaacaaaagccuaagagaaaauaaaaaguggagaaacagugcaauguaauucuugcacuuuagugguuuuaaaaacacagacaguacaaggcccagguugcuggcuggugaaaccccugucccucgucccuccuccacuuugcaaaacggagccuccuuucucuuggaagccagacauauccucucugacgcuaugggguuucuucuccuuagagcucuucucugagguucccauucugggccggagcccucucaggagugaguggauggguccgggguacugucccaccuugaggggggcuuggcgguugccguggcagcccugucucacuaaccggugcguggcgggagcaggugguugaggcccacccucuaggggaggccagcccuguggggguaccauggaggccacagagguggugguggggagauggggugggagagaaggggcaugaucagaaaagggccucccuggaccucgugcgccugccuuccuccccucauggggccaguguccccaggccugucugucuaggccuggcugucaaagaaagguuccagucucuuccuccccaugugcccugcuuugccaggugggucagggcaggcuggaggaaggagggucaguccuggcugggcuucccuaucuccuggcagucgugggaaagacagaggcaucuuccucacugguggagugaggcacgaaucuaaaggggaugggaagaccuucugugggugugagcaugggagugggcagcacuuagauucggagccauggauaguccggaguccaaggucucugggugagcagacagucggccaaaggccagccuggagucaaagagaccagaccccugcuuagauugccauacucgcaccauuccaaaccugccucccucacacccugccaugggggaagaggugccgucuuccuccagugccucccuucccaggaucuccccacccugggcucagccagaacucccauuugggaggcuuaguuccauguguccaugaaggcccagcuucucuggggagugaccagcugcccaggagaaacuccugcaugcagaagagacucacagguuuggguucgcaggcacgaacuuuggaaaccggaagagucuggcgcacuuacaccaggcucuaaucccccaccugauggcuggcagcaaagagccaacgcaaggggcagaagccugcucaaaguccagacacaguccgugaagagagagccccucucaagaauuagguccaggcugggaggaauguggggggagcuuguaguuccuggcucagucuuuucucaggggaguggcaccccaguauccacuuggcagauccuaguuggauaacugcucaagaugcaaagggagaauggguggaaagaacagugacguggaagagguuugggauacuggccuaagacauacagaaacgugaguuggguuuaggggacagcugugcagagagauggggcaugcugacucggcaggucaaggccuuguggcugcuggcccuaucgggccccuuugucucaugaagauugagcacuucuccuguccccagccaacuguccuguccaggggcauaggagauagcccccaaguucuauagcuauaggguucccaucaguugaaacagauuugcuuuuucgcuauuccucuucguagccccaaauucguuguuggaggcggucuccgcugugucaugccaugagcaaagagugaagagagcuguguccacagcacgaaggggucuccuuggccaguguccaagcccccuuuccuggauaucuucagccuuaaagaacagucacaaggccacccauugguugaggaagucauuggagaaugggaguuucggaaucuggcugccgagugacagcaucccugaaucaugcguucccugcuugucccagcuuuccuuccauccuccaccccagggaggaugcagggacuggccagaauggaggaagagcuggaaagacucgugggccucagucccucauugcaggcugaaggugggcagcggagcacauagucuugucccuuccaaagcauggccaguuuagacugauucuuccuaucuggcuucuaaagucuagcacccuccuaaaguuacucaccuucccuggcucugcggccuggauuaagcucauuucuauuuugcaacccauucccccauuuuccucucuuuccucucaaauccuagaaaauacauaugguggggaagcuaaggaaauuucuauuggcuuuucccccuuucugcugcuuugugccaaagcuagaauggaacagucagcccccucucccuucagcccucuguuccuccccacaucgacucuggccggaaccauccaucuuacuguucuccugcaucuaaaccuuuuugccaccaucucccucugccaucucuuacuucagucucccuccugcucugccagcauggagagugagggaggcuuccaaaaaugcacauucuguucagaugaaaggaaaaggcuggggugggacugguggauccaucguggaccuguugggcucauguggugugguguccggagacugugacuuccugaggguuuaaagacuaaaaugggauggacugaggcgcgugcugugugcaccacggagggcuggccucugccuggcucggugggugcagaugaacacacguggggaaucacugucaaauccaguacugugccccacaaaaaagcugaguuuauugcucacgggaaacucugccucgaggcaggcaaaaaugcuauuacggguuguauuaggagaauauggguuuucucaguuuucccagaaugaggaagcuccucaaugccccuauaggaacuacuuugaaaaguuaaugcaaaccuuugaaagaaaggaagaaagaaaaaaacaaagaaaaagaauagauuuauaugccuauauaugacuauauggaguccuguagauaaauacgagcccacuuuuuuuuuucagccuauccucccccacagaggcugcugcgcuacuuacaaauugaauuaaaugagggcugaaacggcacgcuucagcauguacuguagucaccguggaagaacaagucuuuccaauauuggggcauguauugauuucuaaaaaaugucugccuggggaaugaaauaugcacauguauuucauauucacagaucugcuuccgaaaaccucucuauuuaauaucacucaauuaugaauuuguuuugcuuucagaggaauggaaugcauuuuaguuuuuauaaauuuggggagagacaacacucugcccagguaagaggagaggaaguucagggguccagcuguccauacugcuggcuagaggaggagacagauccgggagagguccuggaguguuuugccuuuuccuuucucccccugaccaauccauccugggaaaccccaauagugucauugauugccacauccugggcugcaucuucuagcgcccaccucucccgaccccaggccagggcuggacgugaaaguugggccccugccuggucucggugcauguccuuccugcccaccugcuugucuuccuuuuccuaacucuauucgucuuucucucucuucuacacaaacacuuccuucccuucucuuccucucguucuuccucucuucccuucucuguucauccaacuugccucaaaaagaaaaccauuuaaagggggggggugucuuuuuagcuuuuugcaucucuguuguugccauuuucgaaguugagcccuugcuagagauuccgagguccucaguuuccucaaauagauagauauauauuuuucccuuaaaugagaugaaaugaguggcguccugggguggagggaggcgcuggcuggagucggggcugggggugggagggggugagggaaagguuggggggggacgcaucacucaacguugcugcugucgaagguguggcacugaaaguccccgucaacguacuccaugccuggcagcuucaucccguacuuguccacgcaccagcagaugccacguuugcggccacgggaagguuugcacuggggugaguagagcaacaggcggugaggacggccgcaccccagggcucugcuccucccugcccugccucuugucuaccccaaggcaagacucucauccccagagaguugagggcacuagacccgacccuuggguuucugguguccccauuucacggaaagacccagggaaaaugugaauuuaggcagccuacccuuggcaagcuccuucaaucccuuucuuuccuuuuuuuuuuuucagacauggggucccguuauguugcccagguuggucuaaaacuccugagcccaagugaucuuccugccucagccucuggaguagcugggauuacaggcgugagccacugugccuggcuuauagucccguuuuaaauauuacccauuugaguucccccaacgugaaacucugcagggauucucaagagaguuaugauccaauaauaaugaugaugguaauaauaauaacagaaggaggcaugauuugugguguuaucauguaguagacaccacucaacguuugguaggcaguagguacuguucuaagugcuuuacaaagaccaaucacucacuccucauucaccauuuuacacaagggucuggaggcacagagacauuaaauggugaguaacaggacacagcuaguaaguggcagagccaagauuugccccaguguggccuggcucuuacauuuagauuauuggugcccuuaaagcagcaucagggucacguguccaccccggaguccaccccaggucuaccaaucagaaacugcagggguggggcccagccaucagccaugcccuccagggauaggaugcccuuggaaaucuaagaaccauugcccaaaggagagccuggcugugaagggacaugaacugauuucaggugguucacagagaaaauaugguuuaaauuccugagugugcggugcaccaaugauacgugcugugcgauaguguuacagaguuaccuuuugcaaggaauucauguagcuaaggcgaccuguggaaagcauaguggauuaccgcauaggagagaaugaggaaauggauuacagcauaguagggaauguggaaagucaugaucgugguauaugaauggguaucugaggcccaggaaacacuaagugguuaacgguggaaaccuuaggcacuugcccaagguggaguuuccuggcaggugccauuuuuggagcagucugagccuggagcucagggcaggggacguaccugcuuucucuuguagaauccuuugcggucacaauugggcagguacacagcacggggcaccaugcgugggcuggcuuugagcuccugcagggaagccuccaugugucugcggcaggggcccuguguggacaggagggugagaggcguggcgagaccaagggaaaaccacccagcugcgcugacgaauggcccagggggugggggcugaagggucucuggaggaaagucaccaccuuugguucuaaucaucugcuaccaaagaucuuuccucccugucaccugucacgugcgcugggaucauacaaagccugccuuuggccagguacggagucauacuuucucuuuuguguuccaguccacccccuccccugcagcuuuucucuucugcugaguaacaauguccagaggugcccauuucuagaugcucuaggagaauauucagucucugccuuggacuggacacagcugcagggcccagguaccugguacguggccgcugggcuggcacacacucuccucaaaugagcaccgccucuauucccacuuacuugcacaagcccuuggcccugacaaguguaugcucuggaaacucuacucccacguccuaagcugagccacauggugggcuguagguccucugcugggucuagucuagcaccuccugccgccaugaauguccauuuagaugcaggaaaaggucaaaagcugggagggaaugagggaauccccgagaugcaccugcucagacuccugucucaucucaggugcagagaugauccgggggugggcaguguucucggcucccccgacaaacuuggacugggucagcuucuuucugcgguccuucuucacugcuucagccuucagcucggagaugcggguguguuugggccggaagaucuugggggaguaggucuccucggccaucucagagguggugggcuccucgugcucacgggagucucucucugcaggagaaggagccggagggucagcccccgugggccaaggugcacacggccagagcccagggcugggcaguuuggggugaggggaguaauaaaggcugaagcagaugugucucugcccuccuggagcacacccugaaagcagggggauaagaaccaggaagcagagggaaugcucauuuaaguggcaggaaguuucuggcaugcuuggagucaagcagagagugcaggcagggaggcuucacagaggaggagaaucgagagacugacagacugaugggugaggacggagcaggccuucugggggcaguaaggaggaagggcaaggaaaauggccucugcaaggaugaagguggcagcgagcgguuugcuugcugggggauggccaaguagaugggacauggcuggagguggggcugagaaguaggaacccgggaaucugggcccauggaggcagaugacacagucagggcguggacgagaagggcaaaggcuguccuguuagugagaucuuugcacuuucagagcugcuggauguugaggucucuuuggaccuggggaaccuaggaggaggggguccuggggucuggagcagcaggguggugaggaccuucauaagcggcaggaggaggggaggggagagccagaaauguaggcccggaggggaccggcguggggccaaguggaagucggaggccuugcuccugcucuggcucagaacuggcgcggugcucgggggccugggaggcugggacguuacucagcucuggacugagagaggccgacagcuggcugagaccgggacaguuauauauaggaguggcuugcugacagucuauacuuagcuggcuuuugaccuuuagagaagucagacuuuguugauguauuuguugauccuuaauuccacccguccggccuuuucuuggugcgcaguuuuccccuaaauucugaucucauaggcauccaucccuggguccccuucuccucucagauccuugaccucccccagccucagaggaaccagaaugggggaacuuuagauuguuguuuccaggcgggcagcguguggccaggaugccucacagugggaccagaugcaggggugaguggagguggggggcccugucuucauugccucccucuuuuuucaaauacuggaaagagaaaauagagcuuugagugaccuuaaauaacugaaaugaggugaaagaaaauucuguucuccaucuacuccaugaucacugggauguccaggaacagugaccgccagacaucugggauggggaacagaagaaguggguagaauuccaggaaguggggguggggugcaaggaaagagaagcuuuuuugagaagacgcuguuuuaugccucugggcagguauagaaccugacuucugagcuugcagcccugggcaaguuccaggugugaguuaggaaaggcauuuggacaccuggccuaaccugggcaggauggcagguggcaggaagcacccaagcaucuguuucucucuuggcucaggauuugucaagucuaaugaaauagguaucuggucuuuaaggccuuggcagagaaggucccugcccuaaagaagccuccaaagguucgcagcguuccugguggugaguugcuuuggguauuuauucacaggaaaggaagggacguaauuacuggagaggaagaugaugacuuggggaaagcaaauagcaagguggugggugggcucucccuaaauaaaauucaaccugagaauccugguaccccuucuggacucucacccccucuucccagucaugucuugaugucccaguaccucgauucugcucuaucagacccugcugugacgacucaucaauagggugacaucucugguagguggaaugcaggauucuagggauuaguuaaaagggucauguucugggguaaauugacuuuucuugguuguagcgcaagugagauuggcaggaggaagggagaagcauggcugguuuggggacuuuguacaaauugaaaggcuggggcuccguuaucuaguaacacaggccucacgccaaggcucagaucuuggagaagagggaguagggagagggagugcuaaccauugcacagaagggcuuuugggcacgucuuauggagggacuggagccgugccacucaaccucagcaucaccacgcauuuuaauccucaaaaaguaguugacuacuguagggggaggggcagacaggauaugguggcuacugaaagccuggaggggguucagauuggagaagccuggaccccuuccucaaucaagauuguaacuggauaaagugagggcaggugggggagugggcuggcugcugaccagcgcaugcgucuaugcgucuccuucagugggcugccccagccuggccuggagagccaacacauugucaccucuucaaggggagacagccugggaagcuggcuucucuccuguggcugguguagcaguuccuggaauccuuuccguaggccauuuaguccaucccccuguguccaagcagaaauaagcaucuaucucucuaguucuuaaggacaucugaaaugggggugccauuccauccuccucuggcuaccuguugggggaggcucuguccauuuggucagagggugcccuuuuccagcugucauuuuagcuuauucucucuuuggccuugggggacacagaagcaugguggcccacagccuucccucaacagcucuucucaagaccuuucaccuuuugggacuuuuucuaagaagugcugugggcuguccuuaaccuugagucacccuuucugggagggggauggggcuguugacaacgguuugauaaaccuugggguaaauuuauuuugaccucucuuacucuuuucuuugaaaguguucaaguacugccccggggccaagcaaccaugauacuggcauacaaaauguagauucuuguaucucucuucauuuaaggaacucaaaaugcuuuugcaaacucucuccuuuucccagccuccccaaggcaagucuccugagggcacaccuuccccagcuuugcaagcuuuuuggcugcuucugaagagcaggcuuaacauuuugaugugccuccugguuucuggugccacuuaaccccaugggaccuauuccuuaggcagcagcagaguccagugucgaagauacuaaucagggucuuguggucaccuguaggcuccagagagacagcggaaacuuggaggggagccagggcagagccauggagauuaaagggcuggaaaguaagacuggagcugagugccagaagcagccagcccgacucagcugcucuguggcugagucauaaauaggcuuucaauuguggaaggcuuugcguuuuagauaaaacaagaaggaacaaguagacuggcuacucuggagcuauuucaucaagagaaaaugaacugagguugcagaagggaucuaggcaggauacccgggaggacuuccuggugaagauuguucugcacgugaacagcaaaagaacucaacagucugcucuggaaccuguuugacaaacaggucaauaucuccauguggccagcagagggcgugggagacugacacccacacagcaugggcacacuucuagggacuggaagcguuuuuuguuuuuuuuuuuugagacagagucuccuucugucgcccaggcuggagugcaguggcgcgaucucggcucacuguaagcuccgccuccuggguuuacgccauucuccugccucauccucccgaguagcugggacuacaggcgcccgccaccaugcccggcuaauuuuuuguauuuuuaguagagaugggguuucaccguguuagccaggauggucucgaucuccugaccucgugauccgcccgccuuggccucccaaagagcugggauuacaggcgugagccaccaagcccggccuggaaguguuuuuaaaaucuggaauuuggaauugagagcgguggcucauaucucuaaucccagcacuuugggaggccaaggugaguggauugccugagcccaggaguucgagaccagccuggacaacauagugaaaccccgucucuacaaaaaaaacacaaaaauuagcugggcauagaggcgugcgccucuagucugagaaacucaggaggcugagaccggaggauugcuugagcccggaaggugggagguuggagguaggagguuggagauuggagguugaggcugaggcugaggugagccaugauugcuccacuuugauagcuccacugcacucuagccugggggacagagugagacccugucucaaagaaaaaauaaaucuggaauuugggugccucccucuccuacuucugcaauaaucauucaaauaaaucccuuccuucuguuugugugucugcaggauauauuuaaagagucagggagacaaacaagcgaggcccggagagaacccaugugugggagagugaaggcaggugagggagaggggaacagggcuuguuugugcauggcauucugcuguuucuguaaccuccaacuggaaaaugauccaggaaggaagagagacauauuccagacuuccccgcccaugagaugcuguucugagagguuuuugcagaggaugggaaauguggaaugcucagcauccauuucuccugcugggaucuauggaggccagaccuuaccuucauaacccuauucaaugacuaagggaggggaugaugauaauauuaucuggauacaguauuuaccuuuggggugggaucuaaaucucuggcuucuauauaauaccuccaguccuucccacuggcucuccaaugccucuggccccugccacauuuggguggccaacucaguccucuuucauucauaaggaguuccccauacaccccagugcagcagcauccacagaggcacacacaguacaucagccucuccccaugguaacaugaacacguguuugaggauugcaccauccucuauguccuggcaaacacagagagugucaugaugcaagcccagcugcuacagacccagaggcaucuuagggugagaaauacuccaugcugcacaauugcacaacgcauguacccugcccaagcucaaccacuuucuccaaaccugcccuuuugccacggcuguucucuuccaguagagucugaaggguucugacuccaccuugcuugcuggucacagcaauggauggauccaggagaccugccugccuaaaaucuaaaccccccgcccccggaccucuuagccacaccccggugcuauuaacagccuguuccugggcugguguuaguuuaucacucuaucucacuugaccuaauaaucaauuguaagagaaaacuaggugacccagauauugugccuuagcuuacaaaaaucgaagaaacagaggcauccuugaaauucacaguccaggaagagugucgggcuuugccaggccacccagaccuggggagauucucccaucuccuuuucuagacagaagauaagaugaggacgccuagaaucucucuacaaagaaugaaaaagggagcugaauuuguucuggguuucauucuaguccccccuguggaauuuaaacagccaacuucuuacgggcagagcuuugucauuucucuuugucucaccagcauauaguauucaauaaauaaccuuuaaauggagagauguguaaaucugcccaagaggcaaagagaaguaggucuggaaguauuucuguaauauaagcuggggcuuagagcccagugcaugccuugggagguuaucucauccaugcuccugcccuggagcaagauaacccugccgcagggcacagggaagcagacagaugagcgucaugggugugagaaacagcaggggugcuccuggauucacugggcuucucuuuggccuaaggcuacuauauauuaauguacuacuuaggccaggcaugguggcucacgccuguaaucccagcacuuugggaggccaaggagguuggaucacaaggucaggaguucgagaccagccuggccaacaugguaaaacccugucucuacuaaaaauaaaaaaucagccaggcaugguggugugugccuguaaucccagcugcucgggaagcugaggcaggagaaucacuugaaccugggaggcggagguugcagugagccaagaucgugccacuacauuccccccugggcaauagugugacaaaaaaaaaaaaaaaaguauauauuuaauaugguagccacuagccaauguggcuauuuaaauaaauauuaaauaaaaugaaaaauucagcuccucagucacucuagccauauuucaaggacuucguggccacauauggacauugcagaccugcaacgcuuccaucauugcagaaaguccuggucagugcuggccugacggcacugacuugugccuggguauggaugaaaauacugaggcccagucuagaauguucugcagucccccuccucccuugccaacccuaggucccuagccaacuugcagccaccagccccucccuacaacacaaggcugguggaagcaugagggauuggcuguucacuguuugaaaaaauguaagacaugucucagucucuugaagucuguuucccagcuguggaugucaaauggcuuuucugcgcuugugugugugcauuugcagaaggagaaaggccacagugguuguggcagggggaaggugcuguggacacuuccagggaaguggcaacaucauuucuuuuccuacccaucccaucucugaccagcagcugccuggcgccagucucucucagaagacauuuuuuuuuguuuuuguuuuuuguuuguuuguuuuuguuuuuacuugaucgucagaaauaggcaugcauguuccggguucuuuuuaaccugaauuaugggcugaggaggaaaugagcacuaaccuuuuaagaaaaaaaaaaaacccaaagcugucauccuaaaaagcagcuguaagaauggaggaaagccaggaggaagaccccggaggggaguugagcagacuuagagaacuacugacuggaugaugagggcuauagguguacccagcugagccccccuaccccauuuuaggccgggagaaauagcaugguuagguacucuaaaccaacagcaaagcuggccaagcugggaauauaucucuauccuuaccagagaaauacagacaccauguaguauaguggauaaccauucagaaucaggaaccagaccaccuggguucaaaucccagcuccacuacugaauagguacagcaaacugugccacccuaaaccuucagcuguccuuucugggaggaagaugaagcuguugacaauagcucaguaaaccuugaugcagcuuuggcaacacagcaagaccccaucucuacauaaaaugaaauauuagccgggcguggcagugugcaccuauaguccuagcaauggggagucugagaagggaggauggcuugaacccaggaguuggaggcugcagugagccaugauugugccacugcacuccagccugggugacagagugagaccuuguuucuaaaaauaaauaaauaaacaaaccuugguacagauuuacuuugaccuuucuuuuuuuuuuuuuuuuuuugagacggagucucacucugucgccaggcuggagugcaguggcaugaucuuggcucacugcaacccucuccucccagguucaaaugauucuccugccucagccucuugaguagcugggacuaaaggcaugcagcaccacgcccaggauggucuugaucucuugagcucgugauccacccaccucagccucccaaagaccuuacuuucuucuuccucuuuccaauucaguuuucucaccuguguuauggggaggauggcaauggccccuucuccauuauauucugaggauuaaucagggugaugcaugcuaauucacucucagaacaggucucugccuuuguagugcuguuuccuaccaccucccuaguucgaaucaucaacuaaaaauuugguugcugugacaccugguugacagacgccuacuuguagaccacaagaucugaggcuccuuggacugcaggaaggucugccagaaaguguuggcucgaccuuugucucugggggucuguuggccaacaccaggugaggacuuggcacaggugcucuccggacccgucuccacuuagagagcucccccugggaguccuuccucugccuaaccccauuccuucaugcugcguuaagggcacuuagccuccuucccugaagauauauagagaaaagggggcccaccgcccuccacaguguagaugccacaggugggaaggugacaccucacagaguaaggggcugaggucccccuuacaucugccccacuguccagggaccagagguaaagagaggcuccuuguuguuuucugaugccaaacuaggauuugggguugugacucugguucacauuucuuggucccugggaagcagcuggcgauaacuguacacauaggaaauacacacugaugcacaagucccuggcugagaaucuccagccaagcuucuuuuggaguuggggaagggggagcaugcuuaguagaagugucugucuguuccucauacauuccccaaaugagaagguaaugguggggggauagguggggagcagccucuggaggaagcacugggcagcuuuucuccuggccacuuucccaucaugacccaucacagccaguucagaacauugccagccacagccacauccccccaaaguucugcaugaccagaagggggcggcagggaggaaguaggguuuacgcuucucuccugaggccccgaagaaggugcccaggcucugcuagggaccaaacaagggagcccugucugucaacgaaagcugagacuccccuuuuuugagucuuugggagcaaaaggaaagaguggggacagcaguugccuucucaggugagagagggguuugcugguagccauuaaccaugugcagauacauacggaacaucugaaauguggcccggggaacugaggaaccacauuuuaaaauuuauuuaauauuuauuuaauuuuaauuaguuuaaauuuaaaaacagauacucaacucaguuauuggaaagauuuuaaaguauguuuggaaugccucagguaugugacucugcuuuuucaacuguaaauuuuaugaaaucuaaauacagaucaaguauuuccaaugaaaauuuagugucugaauugagaugagcuguaaguguaaaaaacaccggauuucaaaggcuaaauaugaaggaaagaauguaaaauaucucauuauaauuguuuuauuuugagcguguggugaaaggauauuuuggauauauucaguuaaaauguauuauuacaauuaauuucccuguuuuuuuuaccuuuuuaaaaaagauguggcuaccagaaaauuaaaaaugacaaauauggcuuguauuauguuucaauuggaagugcuguucuaaaugaucuggaagaagagucauccuggcugaggugacagaggggugucgcagucccaguucgggauaacuggaacccacauuaaacaacucagagaaucagcagaggucaucugaggccuggcucugagugcagauucagugggaccuuauuuuaggccagggaaaggggccugaugguuuagguugagggaucaaacaugagauaacugaguucguuuaaaauguuccuauaguucaccuggcaggucugacuuaccggaaaaaggggccuaucuuaucugccuccuuccuaagcaucccagaaggaggagcugccacggccuccaggauguauuagaaugggucucagcacuuccugcagcacaaccagaaguccccagcugcccucuggaagcacaucucuccucuccugcugaaagaucugagacacaucugccuaugaaagaaagccagggggcccucaugcucucuuccuuaucagcuuuggugguauaugguuuuccuucucuccuucggaugcagaacuuccuaguuacugcacucaccccauccaaccacacccucucucgaucucugcuuucuguuggcaccacgugaggacugugcuguuggaagcgggccacuucugcaccauguucuucaagacuacaggccgcugcacagcucagaggcagccaggccugccugccucuccacaucaggagagcuuccugucauguagaaaaugagguuuggcgcauggaccugaaagcuggggugaacaccccuccuucacacccucuugguccucuuucucugaccaaaccacuagccuaagccaggcuuguaugcaagacuguguagaaaaagggacagaagugagugugaaaauaagagaguguggcccucuccacuuuggggccgcuucacuccuuuuccuacugccccuaaaacagagugccuucagauuauggguucuuaugucauggagugauagcaucuggcaguguuugccaaaggccuuacugcagguuagcccagguccaggcaugagccccagugacuagcgagaaagccaggaauggcugaaugcagugcuggagccccugcgggaaagagcugagucccagccccuugucugucucuaacccugcugccacaucuugggcaagugacuucccacucagggccucaguauccucauucuaaaacuaggaccuugacugugaugauggcuauggguuccuuccagcuuuaacauuauuuggccaauacccagacaauuccuggagagacacuaggacugagcuaagcugaguggccaggcacuaacuaacuaaccugguuaggugcucuaaaccaacagcauaguggccaaggugggaauauaaccucuccuccucacagagauuuucagucacuccucuggauuuauauuuuuuaaaaagagagagagagagagaaaugacaucauaacagaauuuauggaaagaaaugaaacuggaaauaaaagggggggauuucacugguauugggggaggggaguagaagccuacacugccauccuuguuuauuuuauuauuuauuuuugcaaguauguaaucaauguguaaucagucuuacuguuuugaauaacauguccugauugcaauuuaaggauagucucugggaauugcagcuuuuggaccaacuguagagaaaaagcaaauguaaaacuaaacaaaccccuccaaaucgccugcuugacucaacgcagccauucucccacccucuucccuucugcucuggccccugguugguaccugcucuuuaugaucuucuuccaguuucuggauguagugggucuggaguguggugaucucuucuccagaguuuuauuuuccacacacuaaauaucuuaaaaguuucauaggcauugcucagguacaaaguagaaacuuuagacaaguauuaccuucccuucccgcuggcuucuucgcuccauuaagggggccagggcuucugcagggaauuccugcucccaugcccuuugcuguaacccucacgaugaccucuggcuccuagggucaggcugguccacccucugcagcugcaggcccaccugccugcucaaauccagcccaagccccgggacuaacucacagcugcucugacuuaaaacucaagcccucaggggaugccuuagaguugggguggggggucgggggguggauggagaaggucggagggaagaguaggagggaggggugagaaaggggaaaaagagaaauggaaagaauaugagcucucacuagggcuaacucugcuuguucuuccagucugagcugacacagcagaaaggugggggagggggggcggggugggcgggggcgggggcggugggcggagguggcgagaaaaguccaguuaaagccccaucucguuuucccaacucccguuuugguuggcucagggcacgccauccucucaaagacuuguuucagagggagggggugcgggugggaaaggaauuuggcuccuucaguuuuccaugaucuugcucaacccagacauaaauuuggccaauaaaccuaacucuggaacucgacuucaacauggcauuuuagaccaggcuuggaguugaagccagggugauggaggccaaaccccucaaagaagcaaaggcugaauucacuuuuauuuagguaaugcuuuugcuuucuuuuccagaagccuauuuuuugucccacggugucucauuucuuaaugacagaaccgaaagccagaacccacggcucccuacaucuuaaacugaaugucucaccagcacagaggagaccuacccgaaccccgguaucuaugcuggggaccagcccaucaaaccucauuccccaccaaaaaugcccgaaagcaaacccaguacuuccuugacucccuccacucaccgcuauuuacugagcuuugcccaucaaauaacucccgucuuucaucucccuccagccucacacacauucuuuuuuccguaucuaucucugcuccugaacuggccagaaugaaaugcagagccaggcucgcucucagcacccugcucucgggcccacucccucuccaguugcucagcaacagccuagcaaaacacccucuccuccgcccucuccuuucccucccagaggcuuuggcugccugccaccucacucucuucugcuccccauuucugauuccagaaaugcaccuuuuuuggguucuacauguuugguuacauauaaauauauauaauauaguauauaccauauauacaauauauaauuauauagauauaauaugucguguguguguguguguguguguguguguguguguguguguguaugcugcaacugcgggagggagggggcaaauccauaucugcaagcucagauuuuggcgggggugggggagaggagggagguaggagguguguugggaagcaggaauuuuggcuaaaggaccaaaagggcacucucccucucucuguccauuucucucuccuuaagaacggucucuacaccaucuccaacuuuuuggggacccgcccagugguuguccggcuaaaacgcccuuuccaggagcgcccacucccaucccaucuguucgggaagaagaugucggcaccagcagcgguggagcgccgccaacccgcaacagcagccggccgggcaccugccuucggcgggguggagucggagaggagugcuggggagggggcggguagaagaggcggcuucggguuggcccaaaggcacucagaagguggggguugagcaaggggcggcagggaauucuacaggggaucuugcuugggacugaagugucgugugugugugugugugugugugugugugugugugugugugaugcgcccuccgugcucgccuagcaauugcgcgcgcgugcgcucugcguguacacccuucacacuagccacaucacacuacacgcuugguaaauaauaaguggagccaggaugcggcugagugacaccuuacguucuuucggugugacuggauuguuacccagggcgguggcucccaagccgggaaaucaauuaauguuuuccuucuccgcuaggcuuuuccaaauccacaucccccaagaugaaggcgggcaggaccgccuuugaaaaguggaucuuaauaaaaauaaucucacaagccggucucugggguucccagagccugcacauccuccccuuuuccucuuuuugcaggcugcaaccugcaaaaagaucgacuuuuugcagguuuggagaucgacuaccucuugcaaagcuagaggggcuggccccugcgccacucaaacccugcaggguuugcggggacugaggcugaacacaggaagcucuccggccuccuggcaagcgcggacgcacuccucuccugcacuauagugacugaaauuugcacuucagaaaacucauguuagggugcucgugaguaacggaaagggacagggagggagaaggggauugcccccguaacuaaacugucuccguaacuaaacuacgccaaauaaacauuguuuagccaaguuuuaaccccuuuuggagagaaucaauagccaguuugacgucuuagaacccagacuuuuauguaguuuauuuaacuuuuuuuuuuuuuaacuaaagaucagguaacucuuuccaaaaagaaacucagucuaaggggguagaacuguucugauugaacaaguagcugugucaaucauuucaacccuagacuccuggcgccgagaauuugggggcggcgcaacccgggggcggggcaagcggaggcgaggcucccagugcguggcuuuucugucuccgcccccugaauuuugcauucugcguuuccagggccccucaugcacuuaauccacacccacuugugaucugguuuaagagauuggggagggcgggguggggggauugcggagggaggaauugcggggcggggguggagguggugguggugccaggaaucugcauaggcgaggaaguugaaagcucugaaucucacauccccuuuugccucccagcccuauguccaccuuucauccuagguaaaaucugaauuggagagggggaaaaggaauuagauucagaaacgaacaccaggcacagaauaccaaacccuuccuuucuacucuuccccacccccaccccgcacccccgcacuccuaaaguauuuuuuucccuuccugggauaaaauaaaagucauuuugcaguuaaauauguuuuaccaucuaccacaggcaaucaucuucaauaaaaagcaaugguuaugcacaugggaggggcuucagggcucccacccgaaaggcauuagcuaccaaggaugugggguguuugugguguguguguagggguggagggauagaaacgucuggaggcacggggguggaggggccaagagggacaaagguggaauuagcucagaagauagguaaugccucucucuccaggccgcaauuaaaauaauauuuuaacaaaagagauuuuuuuuccaaguucagaaaaaaaccuaugcggggcgcgagggggguggaggagggaguugauaauguaacauacacucuuucagacuguagauaggguaccaggggauuuggaccuugugaccgaauaagagcucagaaucaguauucggacagaguagggggagggggcgggcaacguguggguaggaggaaggagaaagagcgaaagcugggauagacucggcuagacaguucccccggguagcaggauccuccagggcuccaauuccggggugcaaggacccuccccgacuacucccgagcugcaccccagcucgaagccacuugcugcgcaaagcgcgcgggcccagccggucucgugucccccgcccgugcgccgcguaacugacuggcacacugagcgcgcucaccgaucuugacuugcucgcgguagcucuuuucguugaggcaaaccccgcggccgugcagcagggcgugcagcggcuucuccucguccugccgggggaggcagcgcagccccugggcgcagcgcucgguguagacgccgcacgacugccccucggccagggcgcaggucaugcagcagccgcagcccggcuccuugaccagcucgcagcccagggggcugggggggcacauggagagggcuuucucgucgcagggcucgcagugcacgaaggagcccaggcucugggccggccccgcauaggcggccagcagcaggaggaccgcggugagcaacaccaucuucucuuagucgcccccuuuaccucgggguggggcaggagagcgagagugcagggauaaaggggccaagagggcccccggagauuuuuuuguuuuuguuuuuguuuuaaaauuucuggcagguagagcaggugcccucccccagacacuugcaaaaauguagagagagguggagggcuggggugccugcgagcaggucccaguugcaagaauuaaagccuugcaacagguugggggaagcagggcagcgccaggugcacgcagugagcggaggccggagaaacccucaagccugagcgggucagaauuauaggggaaaaaaagccacaaaauuguucacccccaagcaaccaccgaaauaaugagaucggaugcaguggagauggcguugggggugggagagaaaaauggauuuaucuuuaaaauuuuugcuuaaaaucuaaaauacaccccgcuuucuaacccucagcugccagcggugcgcggcgccgcagaacagguaagaggcguuggcugcagccgagagggugggagaaaauguugaaaucaagaaauuaaaaaacaaaaacaaaaacaaaaaaaccccaaacccuaacaccucuuuucucccacuuugccaccuccucuucgaaauucgcagguucuacgcgaaguccggagaagggugaaaacggaggagggguaaugaaaaggagcaaaaaagggaaaaagcccacacugcuuugcagcucuuuccuagcucuuuuccccugcagaaguuuccaaagagacuacggggcuccgggagagcaggcgcuuuuaaau

SEQ ID NO: 12744 - RNA, 23478 nt, Homo sapiens
auuuaaaagcgccugcucucccggagccccguagucucuuuggaaacuucugcaggggaaaagagcuaggaaagagcugcaaagcagugugggcuuuuucccuuuuuugcuccuuuucauuaccccuccuccguuuucacccuucuccggacuucgcguagaaccugcgaauuucgaagaggagguggcaaagugggagaaaagagguguuaggguuugggguuuuuuuguuuuuguuuuuguuuuuuaauuucuugauuucaacauuuucucccacccucucggcugcagccaacgccucuuaccuguucugcggcgccgcgcaccgcuggcagcugaggguuagaaagcgggguguauuuuagauuuuaagcaaaaauuuuaaagauaaauccauuuuucucucccacccccaacgccaucuccacugcauccgaucucauuauuucggugguugcuugggggugaacaauuuuguggcuuuuuuuccccuauaauucugacccgcucaggcuugaggguuucuccggccuccgcucacugcgugcaccuggcgcugcccugcuucccccaaccuguugcaaggcuuuaauucuugcaacugggaccugcucgcaggcaccccagcccuccaccucucucuacauuuuugcaagugucugggggagggcaccugcucuaccugccagaaauuuuaaaacaaaaacaaaaacaaaaaaaucuccgggggcccucuuggccccuuuaucccugcacucucgcucuccugccccaccccgagguaaagggggcgacuaagagaagaugguguugcucaccgcgguccuccugcugcuggccgccuaugcggggccggcccagagccugggcuccuucgugcacugcgagcccugcgacgagaaagcccucuccaugugcccccccagcccccugggcugcgagcuggucaaggagccgggcugcggcugcugcaugaccugcgcccuggccgaggggcagucgugcggcgucuacaccgagcgcugcgcccaggggcugcgcugccucccccggcaggacgaggagaagccgcugcacgcccugcugcacggccgcgggguuugccucaacgaaaagagcuaccgcgagcaagucaagaucggugagcgcgcucagugugccagucaguuacgcggcgcacgggcgggggacacgagaccggcugggcccgcgcgcuuugcgcagcaaguggcuucgagcuggggugcagcucgggaguagucggggaggguccuugcaccccggaauuggagcccuggaggauccugcuacccgggggaacugucuagccgagucuaucccagcuuucgcucuuucuccuuccuccuacccacacguugcccgcccccucccccuacucuguccgaauacugauucugagcucuuauucggucacaagguccaaauccccugguacccuaucuacagucugaaagaguguauguuacauuaucaacucccuccuccaccccccucgcgccccgcauagguuuuuuucugaacuuggaaaaaaaaucucuuuuguuaaaauauuauuuuaauugcggccuggagagagaggcauuaccuaucuucugagcuaauuccaccuuugucccucuuggccccuccacccccgugccuccagacguuucuaucccuccaccccuacacacacaccacaaacaccccacauccuugguagcuaaugccuuucgggugggagcccugaagccccucccaugugcauaaccauugcuuuuuauugaagaugauugccugugguagaugguaaaacauauuuaacugcaaaaugacuuuuauuuuaucccaggaagggaaaaaaauacuuuaggagugcgggggugcgggguggggguggggaagaguagaaaggaaggguuugguauucugugccugguguucguuucugaaucuaauuccuuuucccccucuccaauucagauuuuaccuaggaugaaagguggacauagggcugggaggcaaaaggggaugugagauucagagcuuucaacuuccucgccuaugcagauuccuggcaccaccaccaccuccacccccgccccgcaauuccucccuccgcaauccccccaccccgcccuccccaaucucuuaaaccagaucacaaguggguguggauuaagugcaugaggggcccuggaaacgcagaaugcaaaauucagggggcggagacagaaaagccacgcacugggagccucgccuccgcuugccccgcccccggguugcgccgcccccaaauucucggcgccaggagucuaggguugaaaugauugacacagcuacuuguucaaucagaacaguucuacccccuuagacugaguuucuuuuuggaaagaguuaccugaucuuuaguuaaaaaaaaaaaaaguuaaauaaacuacauaaaagucuggguucuaagacgucaaacuggcuauugauucucuccaaaagggguuaaaacuuggcuaaacaauguuuauuuggcguaguuuaguuacggagacaguuuaguuacgggggcaauccccuucucccucccugucccuuuccguuacucacgagcacccuaacaugaguuuucugaagugcaaauuucagucacuauagugcaggagaggagugcguccgcgcuugccaggaggccggagagcuuccuguguucagccucaguccccgcaaacccugcaggguuugaguggcgcaggggccagccccucuagcuuugcaagagguagucgaucuccaaaccugcaaaaagucgaucuuuuugcagguugcagccugcaaaaagaggaaaaggggaggaugugcaggcucugggaaccccagagaccggcuugugagauuauuuuuauuaagauccacuuuucaaaggcgguccugcccgccuucaucuugggggauguggauuuggaaaagccuagcggagaaggaaaacauuaauugauuucccggcuugggagccaccgcccuggguaacaauccagucacaccgaaagaacguaaggugucacucagccgcauccuggcuccacuuauuauuuaccaagcguguagugugauguggcuagugugaaggguguacacgcagagcgcacgcgcgcgcaauugcuaggcgagcacggagggcgcaucacacacacacacacacacacacacacacacacacacacacgacacuucagucccaagcaagauccccuguagaauucccugccgccccuugcucaacccccaccuucugagugccuuugggccaacccgaagccgccucuucuacccgcccccuccccagcacuccucuccgacuccaccccgccgaaggcaggugcccggccggcugcuguugcggguuggcggcgcuccaccgcugcuggugccgacaucuucuucccgaacagaugggaugggagugggcgcuccuggaaagggcguuuuagccggacaaccacugggcggguccccaaaaaguuggagaugguguagagaccguucuuaaggagagagaaauggacagagagagggagagugcccuuuugguccuuuagccaaaauuccugcuucccaacacaccuccuaccucccuccucucccccacccccgccaaaaucugagcuugcagauauggauuugcccccucccucccgcaguugcagcauacacacacacacacacacacacacacacacacacacacacacgacauauuauaucuauauaauuauauauuguauauaugguauauacuauauuauauauauuuauauguaaccaaacauguagaacccaaaaaaggugcauuucuggaaucagaaauggggagcagaagagagugagguggcaggcagccaaagccucugggagggaaaggagagggcggaggagaggguguuuugcuaggcuguugcugagcaacuggagagggagugggcccgagagcagggugcugagagcgagccuggcucugcauuucauucuggccaguucaggagcagagauagauacggaaaaaagaaugugugugaggcuggagggagaugaaagacgggaguuauuugaugggcaaagcucaguaaauagcggugaguggagggagucaaggaaguacuggguuugcuuucgggcauuuuugguggggaaugagguuugaugggcugguccccagcauagauaccgggguucggguaggucuccucugugcuggugagacauucaguuuaagauguagggagccguggguucuggcuuucgguucugucauuaagaaaugagacaccgugggacaaaaaauaggcuucuggaaaagaaagcaaaagcauuaccuaaauaaaagugaauucagccuuugcuucuuugagggguuuggccuccaucacccuggcuucaacuccaagccuggucuaaaaugccauguugaagucgaguuccagaguuagguuuauuggccaaauuuaugucuggguugagcaagaucauggaaaacugaaggagccaaauuccuuucccacccgcacccccucccucugaaacaagucuuugagaggauggcgugcccugagccaaccaaaacgggaguugggaaaacgagauggggcuuuaacuggacuuuucucgccaccuccgcccaccgcccccgcccccgcccaccccgcccccccucccccaccuuucugcugugucagcucagacuggaagaacaagcagaguuagcccuagugagagcucauauucuuuccauuucucuuuuuccccuuucucaccccucccuccuacucuucccuccgaccuucuccauccaccccccgaccccccaccccaacucuaaggcauccccugagggcuugaguuuuaagucagagcagcugugaguuagucccggggcuugggcuggauuugagcaggcaggugggccugcagcugcagaggguggaccagccugacccuaggagccagaggucaucgugaggguuacagcaaagggcaugggagcaggaauucccugcagaagcccuggcccccuuaauggagcgaagaagccagcgggaagggaagguaauacuugucuaaaguuucuacuuuguaccugagcaaugccuaugaaacuuuuaagauauuuaguguguggaaaauaaaacucuggagaagagaucaccacacuccagacccacuacauccagaaacuggaagaagaucauaaagagcagguaccaaccaggggccagagcagaagggaagagggugggagaauggcugcguugagucaagcaggcgauuuggagggguuuguuuaguuuuacauuugcuuuuucucuacaguugguccaaaagcugcaauucccagagacuauccuuaaauugcaaucaggacauguuauucaaaacaguaagacugauuacacauugauuacauacuugcaaaaauaaauaauaaaauaaacaaggauggcaguguaggcuucuacuccccucccccaauaccagugaaaucccccccuuuuauuuccaguuucauuucuuuccauaaauucuguuaugaugucauuucucucucucucucucuuuuuaaaaaauauaaauccagaggagugacugaaaaucucugugaggaggagagguuauauucccaccuuggccacuaugcuguugguuuagagcaccuaaccagguuaguuaguuagugccuggccacucagcuuagcucaguccuagugucucuccaggaauugucuggguauuggccaaauaauguuaaagcuggaaggaacccauagccaucaucacagucaagguccuaguuuuagaaugaggauacugaggcccugagugggaagucacuugcccaagauguggcagcaggguuagagacagacaaggggcugggacucagcucuuucccgcaggggcuccagcacugcauucagccauuccuggcuuucucgcuagucacuggggcucaugccuggaccugggcuaaccugcaguaaggccuuuggcaaacacugccagaugcuaucacuccaugacauaagaacccauaaucugaaggcacucuguuuuaggggcaguaggaaaaggagugaagcggccccaaaguggagagggccacacucucuuauuuucacacucacuucugucccuuuuucuacacagucuugcauacaagccuggcuuaggcuagugguuuggucagagaaagaggaccaagagggugugaaggagggguguucaccccagcuuucagguccaugcgccaaaccucauuuucuacaugacaggaagcucuccugauguggagaggcaggcaggccuggcugccucugagcugugcagcggccuguagucuugaagaacauggugcagaaguggcccgcuuccaacagcacaguccucacguggugccaacagaaagcagagaucgagagagggugugguuggauggggugagugcaguaacuaggaaguucugcauccgaaggagagaaggaaaaccauauaccaccaaagcugauaaggaagagagcaugagggcccccuggcuuucuuucauaggcagaugugucucagaucuuucagcaggagaggagagaugugcuuccagagggcagcuggggacuucugguugugcugcaggaagugcugagacccauucuaauacauccuggaggccguggcagcuccuccuucugggaugcuuaggaaggaggcagauaagauaggccccuuuuuccgguaagucagaccugccaggugaacuauaggaacauuuuaaacgaacucaguuaucucauguuugaucccucaaccuaaaccaucaggccccuuucccuggccuaaaauaaggucccacugaaucugcacucagagccaggccucagaugaccucugcugauucucugaguuguuuaauguggguuccaguuaucccgaacugggacugcgacaccccucugucaccucagccaggaugacucuucuuccagaucauuuagaacagcacuuccaauugaaacauaauacaagccauauuugucauuuuuaauuuucugguagccacaucuuuuuuaaaaagguaaaaaaaacagggaaauuaauuguaauaauacauuuuaacugaauauauccaaaauauccuuucaccacacgcucaaaauaaaacaauuauaaugagauauuuuacauucuuuccuucauauuuagccuuugaaauccgguguuuuuuacacuuacagcucaucucaauucagacacuaaauuuucauuggaaauacuugaucuguauuuagauuucauaaaauuuacaguugaaaaagcagagucacauaccugaggcauuccaaacauacuuuaaaaucuuuccaauaacugaguugaguaucuguuuuuaaauuuaaacuaauuaaaauuaaauaaauauuaaauaaauuuuaaaaugugguuccucaguuccccgggccacauuucagauguuccguauguaucugcacaugguuaauggcuaccagcaaaccccucucucaccugagaaggcaacugcuguccccacucuuuccuuuugcucccaaagacucaaaaaaggggagucucagcuuucguugacagacagggcucccuuguuuggucccuagcagagccugggcaccuucuucggggccucaggagagaagcguaaacccuacuuccucccugccgcccccuucuggucaugcagaacuuuggggggauguggcuguggcuggcaauguucugaacuggcugugaugggucaugaugggaaaguggccaggagaaaagcugcccagugcuuccuccagaggcugcuccccaccuauccccccaccauuaccuucucauuuggggaauguaugaggaacagacagacacuucuacuaagcaugcucccccuuccccaacuccaaaagaagcuuggcuggagauucucagccagggacuugugcaucaguguguauuuccuauguguacaguuaucgccagcugcuucccagggaccaagaaaugugaaccagagucacaaccccaaauccuaguuuggcaucagaaaacaacaaggagccucucuuuaccucuggucccuggacaguggggcagauguaagggggaccucagccccuuacucugugaggugucaccuucccaccuguggcaucuacacuguggagggcggugggcccccuuuucucuauauaucuucagggaaggaggcuaagugcccuuaacgcagcaugaaggaaugggguuaggcagaggaaggacucccagggggagcucucuaaguggagacggguccggagagcaccugugccaaguccucaccugguguuggccaacagacccccagagacaaaggucgagccaacacuuucuggcagaccuuccugcaguccaaggagccucagaucuuguggucuacaaguaggcgucugucaaccaggugucacagcaaccaaauuuuuaguugaugauucgaacuagggaggugguaggaaacagcacuacaaaggcagagaccuguucugagagugaauuagcaugcaucacccugauuaauccucagaauauaauggagaaggggccauugccauccuccccauaacacaggugagaaaacugaauuggaaagaggaagaagaaaguaaggucuuugggaggcugagguggguggaucacgagcucaagagaucaagaccauccugggcguggugcugcaugccuuuagucccagcuacucaagaggcugaggcaggagaaucauuugaaccugggaggagaggguugcagugagccaagaucaugccacugcacuccagccuggcgacagagugagacuccgucucaaaaaaaaaaaaaaaaaaagaaaggucaaaguaaaucuguaccaagguuuguuuauuuauuuauuuuuagaaacaaggucucacucugucacccaggcuggagugcaguggcacaaucauggcucacugcagccuccaacuccuggguucaagccauccucccuucucagacuccccauugcuaggacuauaggugcacacugccacgcccggcuaauauuucauuuuauguagagauggggucuugcuguguugccaaagcugcaucaagguuuacugagcuauugucaacagcuucaucuuccucccagaaaggacagcugaagguuuaggguggcacaguuugcuguaccuauucaguaguggagcugggauuugaacccagguggucugguuccugauucugaaugguuauccacuauacuacauggugucuguauuucucugguaaggauagagauauauucccagcuuggccagcuuugcuguugguuuagaguaccuaaccaugcuauuucucccggccuaaaaugggguaggggggcucagcuggguacaccuauagcccucaucauccagucaguaguucucuaagucugcucaacuccccuccggggucuuccuccuggcuuuccuccauucuuacagcugcuuuuuaggaugacagcuuuggguuuuuuuuuuuucuuaaaagguuagugcucauuuccuccucagcccauaauucagguuaaaaagaacccggaacaugcaugccuauuucugacgaucaaguaaaaacaaaaacaaacaaacaaaaaacaaaaacaaaaaaaaaugucuucugagagagacuggcgccaggcagcugcuggucagagaugggauggguaggaaaagaaaugauguugccacuucccuggaaguguccacagcaccuucccccugccacaaccacuguggccuuucuccuucugcaaaugcacacacacaagcgcagaaaagccauuugacauccacagcugggaaacagacuucaagagacugagacaugucuuacauuuuuucaaacagugaacagccaaucccucaugcuuccaccagccuuguguuguagggaggggcugguggcugcaaguuggcuagggaccuaggguuggcaagggaggagggggacugcagaacauucuagacugggccucaguauuuucauccauacccaggcacaagucagugccgucaggccagcacugaccaggacuuucugcaaugauggaagcguugcaggucugcaauguccauauguggccacgaaguccuugaaauauggcuagagugacugaggagcugaauuuuucauuuuauuuaauauuuauuuaaauagccacauuggcuaguggcuaccauauuaaauauauacuuuuuuuuuuuuuuuugucacacuauugcccaggggggaauguaguggcacgaucuuggcucacugcaaccuccgccucccagguucaagugauucuccugccucagcuucccgagcagcugggauuacaggcacacaccaccaugccuggcugauuuuuuauuuuuaguagagacaggguuuuaccauguuggccaggcuggucucgaacuccugaccuugugauccaaccuccuuggccucccaaagugcugggauuacaggcgugagccaccaugccuggccuaaguaguacauuaauauauaguagccuuaggccaaagagaagcccagugaauccaggagcaccccugcuguuucucacacccaugacgcucaucugucugcuucccugugcccugcggcaggguuaucuugcuccagggcaggagcauggaugagauaaccucccaaggcaugcacugggcucuaagccccagcuuauauuacagaaauacuuccagaccuacuucucuuugccucuugggcagauuuacacaucucuccauuuaaagguuauuuauugaauacuauaugcuggugagacaaagagaaaugacaaagcucugcccguaagaaguuggcuguuuaaauuccacaggggggacuagaaugaaacccagaacaaauucagcucccuuuuucauucuuuguagagagauucuaggcguccucaucuuaucuucugucuagaaaaggagaugggagaaucuccccaggucuggguggccuggcaaagcccgacacucuuccuggacugugaauuucaaggaugccucuguuucuucgauuuuuguaagcuaaggcacaauaucugggucaccuaguuuucucuuacaauugauuauuaggucaagugagauagagugauaaacuaacaccagcccaggaacaggcuguuaauagcaccgggguguggcuaagagguccgggggcgggggguuuagauuuuaggcaggcaggucuccuggauccauccauugcugugaccagcaagcaagguggagucagaacccuucagacucuacuggaagagaacagccguggcaaaagggcagguuuggagaaagugguugagcuugggcaggguacaugcguugugcaauugugcagcauggaguauuucucacccuaagaugccucugggucuguagcagcugggcuugcaucaugacacucucuguguuugccaggacauagaggauggugcaauccucaaacacguguucauguuaccauggggagaggcugauguacugugugugccucuguggaugcugcugcacugggguguauggggaacuccuuaugaaugaaagaggacugaguuggccacccaaauguggcaggggccagaggcauuggagagccagugggaaggacuggagguauuauauagaagccagagauuuagaucccaccccaaagguaaauacuguauccagauaauauuaucaucauccccucccuuagucauugaauaggguuaugaagguaaggucuggccuccauagaucccagcaggagaaauggaugcugagcauuccacauuucccauccucugcaaaaaccucucagaacagcaucucaugggcggggaagucuggaauaugucucucuuccuuccuggaucauuuuccaguuggagguuacagaaacagcagaaugccaugcacaaacaagcccuguuccccucucccucaccugccuucacucucccacacauggguucucuccgggccucgcuuguuugucucccugacucuuuaaauauauccugcagacacacaaacagaaggaagggauuuauuugaaugauuauugcagaaguaggagagggaggcacccaaauuccagauuuauuuuuucuuugagacagggucucacucugucccccaggcuagagugcaguggagcuaucaaaguggagcaaucauggcucaccucagccucagccucaaccuccaaucuccaaccuccuaccuccaaccucccaccuuccgggcucaagcaauccuccggucucagccuccugaguuucucagacuagaggcgcacgccucuaugcccagcuaauuuuuguguuuuuuuuguagagacgggguuucacuauguuguccaggcuggucucgaacuccugggcucaggcaauccacucaccuuggccucccaaagugcugggauuagagauaugagccaccgcucucaauuccaaauuccagauuuuaaaaacacuuccaggccgggcuugguggcucacgccuguaaucccagcucuuugggaggccaaggcgggcggaucacgaggucaggagaucgagaccauccuggcuaacacggugaaaccccaucucuacuaaaaauacaaaaaauuagccgggcaugguggcgggcgccuguagucccagcuacucgggaggaugaggcaggagaauggcguaaacccaggaggcggagcuuacagugagccgagaucgcgccacugcacuccagccugggcgacagaaggagacucugucucaaaaaaaaaaaacaaaaaacgcuuccagucccuagaagugugcccaugcugugugggugucagucucccacgcccucugcuggccacauggagauauugaccuguuugucaaacagguuccagagcagacuguugaguucuuuugcuguucacgugcagaacaaucuucaccaggaaguccucccggguauccugccuagaucccuucugcaaccucaguucauuuucucuugaugaaauagcuccagaguagccagucuacuuguuccuucuuguuuuaucuaaaacgcaaagccuuccacaauugaaagccuauuuaugacucagccacagagcagcugagucgggcuggcugcuucuggcacucagcuccagucuuacuuuccagcccuuuaaucuccauggcucugcccuggcuccccuccaaguuuccgcugucucucuggagccuacaggugaccacaagacccugauuaguaucuucgacacuggacucugcugcugccuaaggaauaggucccaugggguuaaguggcaccagaaaccaggaggcacaucaaaauguuaagccugcucuucagaagcagccaaaaagcuugcaaagcuggggaaggugugcccucaggagacuugccuuggggaggcugggaaaaggagagaguuugcaaaagcauuuugaguuccuuaaaugaagagagauacaagaaucuacauuuuguaugccaguaucaugguugcuuggccccggggcaguacuugaacacuuucaaagaaaagaguaagagaggucaaaauaaauuuaccccaagguuuaucaaaccguugucaacagccccaucccccucccagaaagggugacucaagguuaaggacagcccacagcacuucuuagaaaaagucccaaaaggugaaaggucuugagaagagcuguugagggaaggcugugggccaccaugcuucugugucccccaaggccaaagagagaauaagcuaaaaugacagcuggaaaagggcacccucugaccaaauggacagagccucccccaacagguagccagaggaggauggaauggcacccccauuucagauguccuuaagaacuagagagauagaugcuuauuucugcuuggacacagggggauggacuaaauggccuacggaaaggauuccaggaacugcuacaccagccacaggagagaagccagcuucccaggcugucuccccuugaagaggugacaauguguuggcucuccaggccaggcuggggcagcccacugaaggagacgcauagacgcaugcgcuggucagcagccagcccacucccccaccugcccucacuuuauccaguuacaaucuugauugaggaagggguccaggcuucuccaaucugaacccccuccaggcuuucaguagccaccauauccugucugccccucccccuacaguagucaacuacuuuuugaggauuaaaaugcguggugaugcugagguugaguggcacggcuccagucccuccauaagacgugcccaaaagcccuucugugcaaugguuagcacucccucucccuacucccucuucuccaagaucugagccuuggcgugaggccuguguuacuagauaacggagccccagccuuucaauuuguacaaaguccccaaaccagccaugcuucucccuuccuccugccaaucucacuugcgcuacaaccaagaaaagucaauuuaccccagaacaugacccuuuuaacuaaucccuagaauccugcauuccaccuaccagagaugucacccuauugaugagucgucacagcagggucugauagagcagaaucgagguacugggacaucaagacaugacugggaagagggggugagaguccagaagggguaccaggauucucagguugaauuuuauuuagggagagcccacccaccaccuugcuauuugcuuuccccaagucaucaucuuccucuccaguaauuacgucccuuccuuuccugugaauaaauacccaaagcaacucaccaccaggaacgcugcgaaccuuuggaggcuucuuuagggcagggaccuucucugccaaggccuuaaagaccagauaccuauuucauuagacuugacaaauccugagccaagagagaaacagaugcuugggugcuuccugccaccugccauccugcccagguuaggccagguguccaaaugccuuuccuaacucacaccuggaacuugcccagggcugcaagcucagaagucagguucuauaccugcccagaggcauaaaacagcgucuucucaaaaaagcuucucuuuccuugcaccccacccccacuuccuggaauucuacccacuucuucuguuccccaucccagaugucuggcggucacuguuccuggacaucccagugaucauggaguagauggagaacagaauuuucuuucaccucauuucaguuauuuaaggucacucaaagcucuauuuucucuuuccaguauuugaaaaaagagggaggcaaugaagacagggccccccaccuccacucaccccugcaucuggucccacugugaggcauccuggccacacgcugcccgccuggaaacaacaaucuaaaguucccccauucugguuccucugaggcugggggaggucaaggaucugagaggagaaggggacccagggauggaugccuaugagaucagaauuuaggggaaaacugcgcaccaagaaaaggccggacggguggaauuaaggaucaacaaauacaucaacaaagucugacuucucuaaaggucaaaagccagcuaaguauagacugucagcaagccacuccuauauauaacugucccggucucagccagcugucggccucucucaguccagagcugaguaacgucccagccucccaggcccccgagcaccgcgccaguucugagccagagcaggagcaaggccuccgacuuccacuuggccccacgccgguccccuccgggccuacauuucuggcucuccccuccccuccuccugccgcuuaugaagguccucaccacccugcugcuccagaccccaggacccccuccuccuagguuccccagguccaaagagaccucaacauccagcagcucugaaagugcaaagaucucacuaacaggacagccuuugcccuucucguccacgcccugacugugucaucugccuccaugggcccagauucccggguuccuacuucucagccccaccuccagccaugucccaucuacuuggccaucccccagcaagcaaaccgcucgcugccaccuucauccuugcagaggccauuuuccuugcccuuccuccuuacugcccccagaaggccugcuccguccucacccaucagucugucagucucucgauucuccuccucugugaagccucccugccugcacucucugcuugacuccaagcaugccagaaacuuccugccacuuaaaugagcauucccucugcuuccugguucuuaucccccugcuuucagggugugcuccaggagggcagagacacaucugcuucagccuuuauuacuccccucaccccaaacugcccagcccugggcucuggccgugugcaccuuggcccacgggggcugacccuccggcuccuucuccugcagagagagacucccgugagcacgaggagcccaccaccucugagauggccgaggagaccuacucccccaagaucuuccggcccaaacacacccgcaucuccgagcugaaggcugaagcagugaagaaggaccgcagaaagaagcugacccaguccaaguuugucgggggagccgagaacacugcccacccccggaucaucucugcaccugagaugagacaggagucugagcaggugcaucucggggauucccucauucccucccagcuuuugaccuuuuccugcaucuaaauggacauucauggcggcaggaggugcuagacuagacccagcagaggaccuacagcccaccauguggcucagcuuaggacgugggaguagaguuuccagagcauacacuugucagggccaagggcuugugcaaguaagugggaauagaggcggugcucauuugaggagagugugugccagcccagcggccacguaccagguaccugggcccugcagcuguguccaguccaaggcagagacugaauauucuccuagagcaucuagaaaugggcaccucuggacauuguuacucagcagaagagaaaagcugcaggggaggggguggacuggaacacaaaagagaaaguaugacuccguaccuggccaaaggcaggcuuuguaugaucccagcgcacgugacaggugacagggaggaaagaucuuugguagcagaugauuagaaccaaagguggugacuuuccuccagagacccuucagcccccacccccugggccauucgucagcgcagcugggugguuuucccuuggucucgccacgccucucacccuccuguccacacagggccccugccgcagacacauggaggcuucccugcaggagcucaaagccagcccacgcauggugccccgugcuguguaccugcccaauugugaccgcaaaggauucuacaagagaaagcagguacguccccugcccugagcuccaggcucagacugcuccaaaaauggcaccugccaggaaacuccaccuugggcaagugccuaagguuuccaccguuaaccacuuaguguuuccugggccucagauacccauucauauaccacgaucaugacuuuccacauucccuacuaugcuguaauccauuuccucauucucuccuaugcgguaauccacuaugcuuuccacaggucgccuuagcuacaugaauuccuugcaaaagguaacucuguaacacuaucgcacagcacguaucauuggugcaccgcacacucaggaauuuaaaccauauuuucucugugaaccaccugaaaucaguucaugucccuucacagccaggcucuccuuugggcaaugguucuuagauuuccaagggcauccuaucccuggagggcauggcugauggcugggccccaccccugcaguuucugauugguagaccugggguggacuccgggguggacacgugacccugaugcugcuuuaagggcaccaauaaucuaaauguaagagccaggccacacuggggcaaaucuuggcucugccacuuacuagcuguguccuguuacucaccauuuaaugucucugugccuccagacccuuguguaaaauggugaaugaggagugagugauuggucuuuguaaagcacuuagaacaguaccuacugccuaccaaacguugaguggugucuacuacaugauaacaccacaaaucaugccuccuucuguuauuauuauuaccaucaucauuauuauuggaucauaacucucuugagaaucccugcagaguuucacguugggggaacucaaauggguaauauuuaaaacgggacuauaagccaggcacaguggcucacgccuguaaucccagcuacuccagaggcugaggcaggaagaucacuugggcucaggaguuuuagaccaaccugggcaacauaacgggaccccaugucugaaaaaaaaaaaaggaaagaaagggauugaaggagcuugccaaggguaggcugccuaaauucacauuuucccugggucuuuccgugaaauggggacaccagaaacccaagggucgggucuagugcccucaacucucuggggaugagagucuugccuugggguagacaagaggcagggcagggaggagcagagcccuggggugcggccguccucaccgccuguugcucuacucaccccagugcaaaccuucccguggccgcaaacguggcaucugcuggugcguggacaaguacgggaugaagcugccaggcauggaguacguugacggggacuuucagugccacaccuucgacagcagcaacguugagugaugcguccccccccaaccuuucccucacccccucccacccccagccccgacuccagccagcgccucccuccaccccaggacgccacucauuucaucucauuuaagggaaaaauauauaucuaucuauuugaggaaacugaggaccucggaaucucuagcaagggcucaacuucgaaaauggcaacaacagagaugcaaaaagcuaaaaagacacccccccccuuuaaaugguuuucuuuuugaggcaaguuggaugaacagagaagggaagagaggaagaacgagaggaagagaagggaaggaaguguuuguguagaagagagagaaagacgaauagaguuaggaaaaggaagacaagcaggugggcaggaaggacaugcaccgagaccaggcaggggcccaacuuucacguccagcccuggccuggggucgggagaggugggcgcuagaagaugcagcccaggauguggcaaucaaugacacuauugggguuucccaggauggauuggucagggggagaaaggaaaaggcaaaacacuccaggaccucucccggaucugucuccuccucuagccagcaguauggacagcuggaccccugaacuuccucuccucuuaccugggcagaguguugucucuccccaaauuuauaaaaacuaaaaugcauuccauuccucugaaagcaaaacaaauucauaauugagugauauuaaauagagagguuuucggaagcagaucugugaauaugaaauacaugugcauauuucauuccccaggcagacauuuuuuagaaaucaauacaugccccaauauuggaaagacuuguucuuccacggugacuacaguacaugcugaagcgugccguuucagcccucauuuaauucaauuuguaaguagcgcagcagccucugugggggaggauaggcugaaaaaaaaaagugggcucguauuuaucuacaggacuccauauagucauauauaggcauauaaaucuauucuuuuucuuuguuuuuuucuuucuuccuuucuuucaaagguuugcauuaacuuuucaaaguaguuccuauaggggcauugaggagcuuccucauucugggaaaacugagaaaacccauauucuccuaauacaacccguaauagcauuuuugccugccucgaggcagaguuucccgugagcaauaaacucagcuuuuuuguggggcacaguacuggauuugacagugauuccccacguguguucaucugcacccaccgagccaggcagaggccagcccuccguggugcacacagcacgcgccucaguccaucccauuuuagucuuuaaacccucaggaagucacagucuccggacaccacaccacaugagcccaacagguccacgauggauccaccagucccaccccagccuuuuccuuucaucugaacagaaugugcauuuuuggaagccucccucacucuccaugcuggcagagcaggagggagacugaaguaagagauggcagagggagaugguggcaaaaagguuuagaugcaggagaacaguaagauggaugguuccggccagagucgauguggggaggaacagagggcugaagggagagggggcugacuguuccauucuagcuuuggcacaaagcagcagaaagggggaaaagccaauagaaauuuccuuagcuuccccaccauauguauuuucuaggauuugagaggaaagagaggaaaaugggggaauggguugcaaaauagaaaugagcuuaauccaggccgcagagccagggaaggugaguaacuuuaggagggugcuagacuuuagaagccagauaggaagaaucagucuaaacuggccaugcuuuggaagggacaagacuaugugcuccgcugcccaccuucagccugcaaugagggacugaggcccacgagucuuuccagcucuuccuccauucuggccagucccugcauccucccugggguggaggauggaaggaaagcugggacaagcagggaacgcaugauucagggaugcugucacucggcagccagauuccgaaacucccauucuccaaugacuuccucaaccaauggguggccuugugacuguucuuuaaggcugaagauauccaggaaagggggcuuggacacuggccaaggagaccccuucgugcuguggacacagcucucuucacucuuugcucauggcaugacacagcggagaccgccuccaacaacgaauuuggggcuacgaagaggaauagcgaaaaagcaaaucuguuucaacugaugggaacccuauagcuauagaacuugggggcuaucuccuaugccccuggacaggacaguuggcuggggacaggagaagugcucaaucuucaugagacaaaggggcccgauagggccagcagccacaaggccuugaccugccgagucagcaugccccaucucucugcacagcuguccccuaaacccaacucacguuucuguaugucuuaggccaguaucccaaaccucuuccacgucacuguucuuuccacccauucucccuuugcaucuugagcaguuauccaacuaggaucugccaaguggauacuggggugccacuccccugagaaaagacugagccaggaacuacaagcuccccccacauuccucccagccuggaccuaauucuugagaggggcucucucuucacggacugugucuggacuuugagcaggcuucugccccuugcguuggcucuuugcugccagccaucaggugggggauuagagccugguguaagugcgccagacucuuccgguuuccaaaguucgugccugcgaacccaaaccugugagucucuucugcaugcaggaguuucuccugggcagcuggucacuccccagagaagcugggccuucauggacacauggaacuaagccucccaaaugggaguucuggcugagcccaggguggggagauccugggaagggaggcacuggaggaagacggcaccucuucccccauggcagggugugagggaggcagguuuggaauggugcgaguauggcaaucuaagcaggggucuggucucuuugacuccaggcuggccuuuggccgacugucugcucacccagagaccuuggacuccggacuauccauggcuccgaaucuaagugcugcccacucccaugcucacacccacagaaggucuucccauccccuuuagauucgugccucacuccaccagugaggaagaugccucugucuuucccacgacugccaggagauagggaagcccagccaggacugacccuccuuccuccagccugcccugacccaccuggcaaagcagggcacauggggaggaagagacuggaaccuuucuuugacagccaggccuagacagacaggccuggggacacuggccccaugaggggaggaaggcaggcgcacgagguccagggaggcccuuuucugaucaugccccuucucucccaccccaucuccccaccaccaccucuguggccuccaugguacccccacagggcuggccuccccuagagggugggccucaaccaccugcucccgccacgcaccgguuagugagacagggcugccacggcaaccgccaagccccccucaaggugggacaguaccccggacccauccacucacuccugagagggcuccggcccagaaugggaaccucagagaagagcucuaaggagaagaaaccccauagcgucagagaggauaugucuggcuuccaagagaaaggaggcuccguuuugcaaaguggaggagggacgagggacagggguuucaccagccagcaaccugggccuuguacugucuguguuuuuaaaaccacuaaagugcaagaauuacauugcacuguuucuccacuuuuuauuuucucuuaggcuuuuguuucuauuucaaacauacuuucuugguuuucuaauggaguauauaguuuagucauuucacagacucuggccuccucuccugaaauccuuuuggauggggaaagggaagguggggaggguccgaggggaaggggaccccagcuucccugugcccgcucaccccacuccaccaguccccggucgccagccggagucuccucucuaccgccacugucacaccguagcccacauggauagcacaguugucagacaagauuccuucagauuccgaguugccuaccgguuguuuucguuguuguuguuguuguuuuucuuuuucuuuuuuuuuuugaagacagcaauaaccacaguacauauuacuguaguucucuauaguuuuacauacauucauaccauaacucuguucucuccucuuuuuuguuuucaacuuuaaaaacaaaaauaaacgaugauaaucuuuacuggugaaaaggauggaaaaauaaaucaacaaaugcaaccaguuugugagaaaaaaaaaaaaaagccgaaaaaaaaaaaaaaaacaccugaaugcggaagagcucggcucccguuuagcauuuuguacuuaaggaaauaaaaaaccaacaaaggaucucacauuuucuuaaaaagugaagauugcuguauacuauuuauucaacuuauaauuuauguuacuccuugaucuuugucuuuugucaugacaaagcauuuauuuaauaaaguuaugcauucaguuagcc

SEQ ID NO: 12745 - RNA, 593 nt, Homo sapiens
uggggagagaaauaguauccagccuucaggaccauccagaaaaaugucucucaaaccaaagaggccaguuccucuguaaacauuuuagccaaugguuucaggcaugagagguggacacagagcaccagaggaccuguugugaggacaaugucuucucucuucccugccuugaaauggccccacuuaugcaaagucacugugauuguguugaacugucuguccucauaauauaccaaagcagcuagacugaacaaauauuuacugaccaccuagugugggccaugcuaguaccugcggaaaaugcaguagaaauaaaagguacagucccuaacgagaaggaggcuaucgccaaagucagaucauuucagagaucaccuagcccaaucugcuuauuuuuagaauaagggagcuaacgaccagagaaguccagucaggaccagaaugaagacacaccaccuccuguugaaaccagucuaacacacauggcuggcaaugcaggcauaaaacaugauuucacacaauuaggguugguugucuagacuuuaaagccaauauuauacagacaauaaacuuugaagaaguuucaaaggaca

SEQ ID NO: 12746 - RNA, 1083 nt, Homo sapiens
cggaugcucugguaggagucagcagaggcccuuccuuuaguucaaguccaggucgacacugcuuuggcugcuugggugguaggcaaugcuggggccgggacugucccgggaggcucuuccccacagccccugcaggcaccuuugggcggcugcccuccagggggcuguguagcgcugaucgcccagccccauggcuacgggcacugccgcugcacuggcacuuccuagggagaggagggacaacagugucccaggccccaguggcgggcgcugcucauaggccaggacugagaggagcaguguggccacguagggcccccagcacagcccgaagagcagcauggcuccagccugugcccuugccugccuccagguaagggcccgggccagggcggagggcucaucgcggcacacugcccgcuccagccggcagauguccugcagcuggcggugggcaguggccagcacgcggacagagaggaaggcagcagcacccacggcgggcagcaggagcccauagacuucgagguacagguagggggcugggaagauagccugggagcugcaguuggcaccagggguccagugguuccaccccagagcgggcagacuggcaaagagcaggggaccagcccaggugaggagcagggccagccgaaugcucccagggggcuggaguggccucaggacugccauguagcgcuccccgugcaccagcaagagguuggcaagcagggagaggaaggagaaguugggagccaaguagacgaggaggcaggaccaguaaccccggcgacucugguuccacagcccuggcaaugugggcaaugccagacccgugagcagcccagccagcaguaggcucaggaagaagcagccagcaggugggcugcgcaggcggcggucccaggcgaugcccagggcuaggagcagguucgcggugaugaugaggcuugccagggccagggagagccccaaagcccccuugggaauggggcugggcaccucgccagugcuguugggcgucaucuugguccuggggacaggggaguccuggagcggcagccggcaugccugcaggau

SEQ ID NO: 12747 - RNA, 6402 nt, Homo sapiens
cugucucugggaaguauauuuuauuuacauuuuuaaaaucuuuaacuaguaucucuuccuccuuuccacccccagagacuugggaagggaaagaacgggaaccucaaacaccuacuccccacauacaaauacacaccccauggcucacaccagcaaaugaaagugaaagagaaacagguccaccccucccucugaagggcccaccaggucuggacaagggugggagggcccugggcugggucucuaaagagaagaaaaggagaggggagcaagucaguugaagaggcuggaaagucauccagggccccacccuccucuucccucugugcccuacugccucugcuggcagacaggggcaggggucccuucguccccucaacaccagacacacaggcaggggcugcagccauuaacggucaggccuuuggacacaaaauacuuucgcuuuguggucuccugacguggucaccaccagggaggcaucucuguaaacagaaagcaugugauugcagagacugggggacccaagcccaccaccuaggggcccuagggugggcuccuccagcacacccucaguucuagggcccuagugccuagcacugggccgacaucucugcagccagcauggaggggauuagaggaagcccccagcacgggagaagcagagcugacuccgauggggaaaaucagucucagccucucccucaugacugagacguggggccccggagggucacugucagccacuggaaugggggcugggcugugaacccucaggcuucucugcauuccugccuuaggaaucccuucccacaccccaaggauccuguguccccuacauacuacugccaccuuccaaauacacaaagaucccagcccuuggccaauucacuuacuugcugagggcaaaguccaggaucucagccguguggccccgguagucaguaagcaggcggccgguccgggcgucccagaggcgcacgaugccauccaggcugcagguauauaccacggcagugccugccucccacagcagcugcacgaugcccgacugccccgaggaaugacagaggcagggcggagguuggcaggagagcugagagccaucugcucccaauucucaaagagggacagccacacacaagggccaggcaggagccagaucugggguagaugcuccuggaggccugggcuuccccaccacuauggacacagcccacagggaccccagcuccagcugcccauaccuggugcugacacugaugccuaagagucugcguagccaggucauagauggccaaggucccauccagguagccaacagcugccaggggcauccuggccagaggagcguaccaugaagacucaugagggccuggacucacacgcccugccguccucccgggcccccagcccaggccccucccacaaaccccuuuccccauccucacucacacacugcagaagcccaaggacuccaccgaguuggacucacucuccuccccuucucccaggcugggcugggaggccacagucucaggucuaaaaacacccaccaccugaaagccagagaggaucagaggaggacacggaauccgggugcuugauggagagaaagacgguggggagaggagacagugaagacccaggaaggaaggagaggagucgggaaagcggaggccccagccgggcuccagguccacucaccuugccggugguggcacugaccagcuuggccuggcaguccacagagccaguuaggaucaagcugccauccugguuggcagcaacacaggugagugggcccuggugacccucagucccuagcauagagcagggaggcagcucaggcuucguccuaccuccccucugaguccugccccagguucucagccccucccuacaaaggcccaggcuaacacuucccccaccucugauaccuuucaguacauggauagggcuucccugcuucaggucccaaauccugauggucccaucuucauagccuaccacagcucucuucccugaagagaggcacagaugaagagagggcagagggcacgcucacauacacuaagcaagggaauggggagagggagaggaaagaagaguggaagggcccagacacugccccaggaaucacaggugaguucagagcaggaaggaggcgcugugaacuuuggggcccaggaggucagcacugcaaacagcaggccucagauuuugccggcugugacccagaaggcugcucugggagguguauaucccgggauucggccucugcacccaggaaaggucacucaagggaggugcucucaccaucagggaggacucggccacagguggcugggcaguugggacccuggaaggucuugcagucaccauucgggacuuuccacauccagguguugccgucagcugugcccgccaacaggacaggugcccgaggaugccacuccauccacuggacagggaggaaggggcagcagggaggcccgucaccccaucccaccuagaagccugccccaugagcuccacccaagguuuccugccucugggguuccgcggggacuuuccagguagcagguagauauucuuccugugccuuggggcgcauuggcucagagcuggcuuggcgcaauaaaggcagaacuggccucccaagcuugcacccccaacaacccaaggccccacagagcugacucccgcucugaugaucuuaccuccaggucucccgcuucaaaggaccagaccuccuccuuaguguccaccugccacacuuucaagaggccacucauguccccuguggccacuagaguggagucauggcugaaaccagcacaagucacagagucuuuauggccuucaaagaaaagugggcagaaaacagaggaaaaaaauaggguaccuggugcugggggcaugugauucugguaucuggcccacugaaaggaccagcuaggaaaaaaagaggggcgggacugagcagaacaggugcuggaacucaccaccacucuaggaaccaauacucccaugucugcugggagacacugcuggcccucacucaaccagaccaagucccagccuccuaugccuucccccuucuguccacucuacaccucugcccgccugcuccuauaccaauguggccuucucuggccuuuccuggauucccuuggccaauuagugccuccugccucugugcccaaaacacacuaguauucgccccgugucccuggggcccagcacagagcuggcacaaaagagaugucacuaaguggcuguuggaugcacaaccucugcaggucagccuccuaagaucucccaaaagaauaugaccucucccaggccucuaccccagcccccucaccugcacacucaaagagcagcuccccaucgcugagccgccauacgaaggcuuugucaucuucacccccggucacugccaagguauuggucuugggguccaggcucacacaaaacacagaugcugucccaagagauauuccauggguaaggggacagagcucccaccuagggcucuguccuucacaaucuucaggaaacccacccccuuucacccaaagcgugucuuuccuccuggaaaacacagguacauccaaguucuucuaaguuucaagaauuggguuguuagauccuucccauauuugccaagcucccuauuugccagaguagauccccucacugugugacucccgucaccacccaacaccaaugccauggacaagagguggggacaggugcagggcuuacaguugucagcaugggaugccaccgggguuggguacagagcgaggagagcaucacguuaaggguuuuuuguuuuuuguuuuuuguuuuuugagacagagucuugcucugucgcccaggcuggagugcaguggcacaaucucagcucacugcaaccuccaccucccagguucaagcaauucuccugccucagcccccugaguagcugggauuacaggcgcccgccaccacaaccagcuaauuuuuguauuuuuaguagagaugggguuucaucauguuggucaggcuggucucgaacuccuaaccuucugauccacccgccucggccucccaaagugcugggauuacaggcaugagccaccgugccuggcaacaguuucuuacuaagaacuagcacuugagaaaguuauauaaaauaugcucaaaaagauauaauuaucucucauuuuauuuuauuuuuuugagauggaaucuugcucugucgcccaggccgaagcgcaguggcacaaucucagcucaaugcaaccucugccucccagguucaagugauucuccuuccucagccuccggaguagcugggauuacaggcacaugccaccacacccagcuaauuuuuuuuuuauuuuuaguagagaugagguuucaccaugucggccaggcuggucuugaacucccgaccucaggugauccacccgccuuggccuuccaaagugcugugauuacaggcaugagccaccgcaccuggccaauuaucucuaauuuuauacucacuacuuuuauuaacuuuuaucaaagauaacuuuuuuuuuuuuuuuuuuuuuggagacagacucucauucuguugcccaggcuggagugcaauggcgcagucuugguccacugcaaccuccgccucccggguucaagcaauucuccugccucaaccucccgaggagcugggacuacaggcgcccgcuaccacgcccagcuaauuuuuguauuuuuaguagagacgggguuucaccauauuggccaggcuggucuggaacucccgaccuugugauccgccugccugggccuccuaaagugcugggauuacaggcgugagccaccaugcccagccaaauuuuuguauuuuuaguagagacuggguuuugccauguuggccaggcuggucucgaacuccugaccucaagugauccaccugccucagccuccuaaagugcugggauuucaggagugagccaccacgcccggccaaagauaacuuuuuaaaagaaaacuaagagguuaaucaagguuaacuggcaaaguagagggugucucgacugaugccagaagccaagcaaucauccauucugccacacuuucccaccugugggcuccuccagcgcaaggccagcaucuugcccaucucugugucccccauaacguucuguccauggcugauguuuaaugcuuacacgcccaccuaaacugauuugagguggaucgccucaaagaccuaccugagugcaaugcaaaggugaccucgcuaucgucggggcccuccaugcugccgaccaccccuuccugggguucuagaacccagcccucuucguugcccucuuccuccucuucuuccucaaaguccacaucuuccaucuccugggccaggucaucugcuuuggggagaggguuagaagauggggcucgggaggcgguaagagguacggagagaagcaugaggaggccugaggcuggggcgggucauguggcgagaagggaagguggagucagacacaccgggguccgcgggggcgcgcgggacacaggacgggaggccacggcuggccagagaccgugcgguaagggagggccaaggggaugaugggaagggggugugugaggggaagggccagaggaggcgucagggaacccccaccccagccaggccugagaacuaagugugagggugggagugggggaggaggggaagagggauaucgguaggaaugaccagucggguguggaggggagcggggaaaagcaggagucagaggccaggggugagcgucuccugucccauggccugaggagcggcaguucucaccuggguccggcggaccgggaucaaguucuaccaccucgauaaucucuucaucaccauggaagcuuagggucuccagugggggggugucagcagcagccccgcuuuccgauucggacuccaugcggcgcaagcggcggauccacuucucugggcccaaacgccucccagagucagcucugcgcgacgacgcggaacucgagccccuccucccggcaggaaguaggcguaggcgacuccccagcaggaagagcgacggccguucggccaauagcuacgaagguuggcuggccgccucaccaaucacagagcggcauuggaagauggggccggggcguggcggagagaacccaaacuccgccccaccugacuccgcccccaacuggagggaaacaagcgagcgcgcgcgccuccggggucuccugggaagaguaguucuccuggguccgcucugcgggcuucugggagauguaguuucuggucuguaggcaggacggaaggagcgggggaggccccuuacgcaaacuacaauucccggcggggagcgcggugaagcgggggug

SEQ ID NO: 12748 - RNA, 754 nt, Homo sapiens
guaugugagcgugcccucugcccucucuucaucugugccucucuucagggaagagagcugugguaggcuaugaagaugggaccaucaggauuugggaccugaagcagggaagcccuauccauguacugaaagguaucagaggugggggaaguguuagccugggccuuuguagggaggggcugagaaccuggggcaggacucagaggggagguaggacgaagccugagcugccucccugcucuaugcuagggacugagggucaccagggcccacucaccuguguugcugccaaccaggauggcagcuugauccuaacuggcucuguggacugccaggccaagcuggucagugccaccaccggcaaggugaguggaccuggagcccggcuggggccuccgcuuucccgacuccucuccuuccuuccugggucuucacugucuccucuccccaccgucuuucucuccaucaagcacccggauuccguguccuccucugauccucucuggcuuucaggugguggguguuuuuagaccugagacuguggccucccagcccagccugggagaaggggaggagagugaguccaacucgguggaguccuugggcuucugcagugugugagugaggauggggaaagggguuugugggaggggccugggcugggggcccgggaggacggcagggcgugugaguccaggcccucaugagucuucaugguacgcuccucuggccaggaugccccuggcagcuguug

SEQ ID NO: 12749 - RNA, 18947 nt, Homo sapiens
ugaguaauuauaaacagagauucuagguuugcauguuugcaguuuuaaacucgaaaagugcauuuaucucaaaaacacagaauuaucaaggauuuuaauuacugauuuauuuguaauguaaaaaugggaaacaaacggccuccaguaggaaauuaauuuaauccgcauagccaugcaauggaauacuucacggcauuaagauugugcuuuugaagacuauuuagugagaagaaaaauguucaucauaaaacaguaaaaagaagggcaguaaacaaaacaccauacaauauaccccacuguagaaaaacaaaauacauacagaaauguaauagccaaagaaggacccaaagcgaacgcuucccccugggaacuaggagggguggagagaaauuacuuucuucccugcauuucugugucuuuucuagcuuccuaucaguaucauguauugccuuuaaauccgaaaauaccccuguguuauuagugaggcgucgucggggcucugagaggcgcgcgcgcccgggacagaccccugcgcccccuggcggcgcccugaggccccgccccacgaggccggcgcgacggggcggggcgcggagccccagccgagccuagcccugcccggccccggaggacuugcaacacuccgaggccaggaacgcuccgucuggaacggcgcaggcaagccagggggccggggccggcgccguuggggacugugggcgguggggacugguccagggcuggggcggccaugcgccggggcgccuaaacuuuucggagcgcgcucccggcuugcccgcuccugggcccaaggagcccguuccagauggggaucuccccuccuggcccuuggcguuucgcucucccugggcgcgcgggugggcggccgggucuguggcaccugguuagccuugggagcccagcagcguguugugggcacuggugagcggagccagggucuggggguguccucguguucccucuuucgggcacgaguggccucucugucgcagggccuauccaccaugccagcccgaguggccagcugugugggaugagggcuuucauggcccucagcuggugagaagagggaagagggaggggagacagccagggccuggcacggaccccagguugcccccacacgcgcugaggccagucucgguguagacaggugaauauuuaagggguggggaaggggggguccuagcuugcagcuggggcagaagccaaugagcagcucaaguguuuggcauggggaaguggccaccucuaucaccaugacuuugcccucugccagucccacuuccagccacuguuucccggcuggguucacagaacuacaggggaguaacauccuccucgugacuucuuuggguuagagugaaaacaaaacagagaaacgggaaaagggaaagcaaguggagagacuggggcaggagccagggaccagugggaggaagcagagggaggcugcugggaggccaggcccuggccuuguggggucggcaccaauucuuguccuauggggucuccaucuccucucccuccucuguggccucuacgugguacccaggaguuugggguucuaccugagcacccuggacaugggauaaguaggccugggaacgcaggucagagccagaugucauggaagggcccucagguguccaguucucugggcucugaaauauucaucucauuagugagcuuugguuuccaagcuggcgacuuugggcuggccagugguggcaggggagccaggugccuccuggggcugcuuuauuggcgcaaagggggagccauacuuccuucucaccugccuccucucucugucucuccagucaugaggauccagagaaccaguuuauagcuuaaauggaagaggcaggaccacagugucaggggcccugucuuucugugcuaugaccucaaggccucacuuguaaaaaugagcccuucagagagguaaugauggguuauccuguaaguguugggagagccucaugucaugagcugggguaauagccaccugggcucagccuccuccccugggaaugggugccucagccagacgcugucuaccucagagcaccuccaaccgcaggccucacccugggccuuucagaaaaagcagaagccacagagaagggaaacacacauacuuguguguuuucagagggcugaacugggacgaccagagaguggaagcucauacaauucucugggaagaaguucugcuaacaacaugucugaucaugacaugggccuucuggaccuauucuguuggggacacaguggaagggaugaccuugacagaaucuuccaacccuaagauucugggauucuaggccaaaaccugggucuuguuuugaaguagaaaugauauccagaagucgacaggcuacaguggcagguaccuccauuggugggaagggagauauuaaugagcucccacuuuugucuguaaugauuugugcuuugccccguugcacagaggugagguuaggggugcccguuuccugguucugugguagcuggauaugucccccggcccuuggcaguaaaucccacggugggauagcagcuguguggaaugggggaaggggaggacccucgccagagauccuggcacugggcugacccccugagagugagagggcaugucuaguacuucaugugacugcucugaggggcagcuggguguacgcacagagguuauaagagacgaggaguuaggauaugaaugauucucaggguugggugucuguaauacaaagguggccugggucagcaucccacaggguguuaauagguuugccucgauaaaaguggcucaggcuuaagggaguuugaaggaacacuggguuaaacaaagcugaacaggguugcuuacugcaggacuucucaggggcagaauaugccauugugaauuuccaagaaggggguguggauuguuucucaagagucaucuguuuccagcacucauucauuaacgucuccuggggcguguucuuuagaacagucugggaaaugccuggcuaggugauucuguuucuccacuguggcucccauaaacaagucccuacuccuuucccccacgugggcugauuuagggauaaaaggaggccaggggaggucauuugccuggauuccugcagcuaguucaugaacccaggucaguggacuuccugccuccuacucuuucuuuccuagaguguuauauacuguuuagcucgggcguaacugaucacccaggaagagcuggccguaggguccagacagcauuauggggacaguuugggaggguguggacagccccauacugagaacaugccauguacuucugccucugaagauguccuuggaaacaguugcacaucaguagugacccccugguguagguucuuggggagccaugccauucugcccugaagccuccuguuaggcuguucauucagaaucagaaacuggcagaguggacuuugaucuuucaguuuuuuuuuuuuuuuuuuuuucugucgcccaggcuggagugcaguggcauggucucggcucacugcaaccuacaucuccuggguucaagugauucuccugccucagccucccgagaagcugggauuauaggcaugugccaccaugcccggcuaauuuuuguauuuuuaguagagacgagguuucaccauguuggccaggcuggucucgaacaccugaccucaagugauccgccuggcucggccucccaaagugcugggauuacaggcaugagccaccgcgccuggccauucuuucauuugaggggaauugucuuacugauguuaaaacugggucuagagauguggcucucacaguggagugagucccaaagccaggacaagaacuucagguccccaccuccuagcccaggacccaggcuucagaucaacuuuccgcaggggaaagaaauaaugguagcaacaacagcuugcucagcuccuuucuaucuaucguuuugaucuuuacugccuuggccccacccuggugcugccuauucacgcaggugcgugcuacagaugccucaggggcuucuacuccugccugauauaaaagcaaagaggcugaauuuuaaaucaggugugagaucuaugcuuaaacucaucucugcuguuugccugcugugggacccuagaucucuuuuuuucugaauuucaguuaucucaucuauagagugggaugaggguaagaauaccucacagcacuguugcaaggaucagaugugccuuaguuacuauagguugagugucucuuauccaaaaugggaccauuuugacaauuuccuucccucccuuuucuuuuacccaccccaacucccuuccacccccaagaaaacacuuuacucuccuacucgagcauauagucacgauagccaugggggcagacaucuacaguggcagaagcacauggauuuuggauuuuuucggauuuggggcuauguauauuauacuuacugguugagcgucccuaaucugaaaauccgaaaucagaaaugcuccagugagcauuccuuugagugucaucuuggugcucaaaauguuuuagauuguggagcauuuuggauuuuggaaaugagggauauucaaccuguacuuccuuaguuauauaguaaguacuggaagugguucaacuacucuaagugguucccuuccuucccuaguuauuuuauuuauuuauuuuuugagacagagucucccucuguugcccaggcuggagugcaguggcgccauuuugacucacugcaagcuccgccucccggguucaugccauucuucugccucagccucccgaguagcugggacuacaggcguccgccaccacauccagcuaauuuuuuguauuuuuuaguagagaugggguuucaccauguuagccaggauggucucgaucuccugaccucgugauccgcccgccuuggccucccaaagugcugggauuacaggcgugagccgccaugccuggccccuucccuaguucuuuuuugggguuaguuaucagucuccuuugucugucucuuuccccuccuaaucuugaaguucaaugaaaagacaggagaugaaacaaagaaggaagugaacagggacugugcucagaaguauuauagcaucagccugcuaauggcuuccucuucccuuaucuguacucccaggccauccugacuugggugggguaacccgagauuaccauucugaucacaggauucugcuccagacaaggguggcggagcugcggugccuggguccucucgugauccccaggacagccucucccuccugggagcuuggagccaccccucggucuccauggguccagagagaggccacccuggcuagagagggggcugggagggguggccucgaguugggggccagaagucgagggcuggcugucuuuuuuuuugagaugggguuucacucuuguugcccaggcuggagugcaauggcauguucuuggcucacugcaaccucugccucucggguucgagcgaucccccugccucagccucccgaguagcugggacuucaggugugggauaucacgcccagcuaauuuuuuguauuuuuuaguagacaugggguuugaccauguuggccacgauggucuugaucuccugaccucgugauccaccugccucggccucccaaagugcugggauuacaggcaugagccacugcacccggcccggucuuaacuguuucugagcugagaggucacuagagaacugagagaaugguagcuuguucuggccccuccuugggagagggugugugcuggugucuaucacucagagagugggcggggcugggaagggaaguuccaaacccaugacgaagaagagggcuguucugggguggagcaggaacuuucuuggcucugggguuuccuugucugucaaaugaccaggugagauccaaagucuaagccagcucugauauuuuaguguuuagaucccuguggcuucauccucuuagucccaaaguccaggcugauggaaggauauuuaguugauucugggcccccuuggugcagaaucaggccuggugacuugcccagacacuccuggguguaucuuuuuacucauuugcucucguggcuaugaggucagcugugcccugggguaggaggauaaaguguuuucuugugggggcagauaaaggaaaagggaggggaacaaaucgucagaucugggcugugcuccugcgccugcugggugggguuuccugagaugugcauucugagcuauuuuuuuccacucugggcauccgucucuggcagggaggagggcaggcugccuggaccagucagcugcuccuuuccaucccucccuccaguacacauacucuccucuugcuguaaccccaguagcucaggccuccucugcagauuccggagccuuaacccuucaaauacccccaggagagccccagccggggccucaguaggcagacagcaggauuaccacacugagagggcuccaggggaggaggugcuuccgccucugcaucugaaaaccuugacacccagcaaguccugcugucugagcucacccacuugugccgcugcugugguagaaagcaggggcucugguuccuuccuaaugggggacuggggcccugagagaggagcaaacuuagaucuauaaugggcaaggauagggcacagucugaaugccuugauaacaggcauugugaggcaaggaagaauguucuaaucgagcugucugcagacaaggggcuugcuccauguugcuggaguuccuucaagcagaaggugggccagacacaguggcucaugccuguaaucccagcacuuugggaggccucgguggguggaucacuugaggccaggaguuugccagccuggccaacauggugaaaccccguuucuaccaaaacaaaaagaaaaacaaaaacaagcagaaggugaaugccuacuguauuuugggaaaauucaggcuuccaguggggaccuuaaagucccugcagacugugagccccucuaguagcugcuggcagaacccagaucugauuucuaguccucacucugugucagucucgugaucucucuccccuucucccuccuucccuuacccuccauucuucucuagccuccacccuuagacauagcuacgaaaguaaacacugacccuuucccccuuugcugcuaccuaggcagaugccagccccaaaccucaucccuaguggaggccuugcugauguggaaguggccagggcccucauggaggcugggcagaagcccaagagcaggcucuaaagcugccaaacccggcagcccugguccccggaggcucuugccagucugacaguguucuuggcacugcucagaggugaguguggcugaguuuagcaacuccccuggcuagcguuaaugcugggguuuccucuccugugcccaggucucucuauguagacagcuaggaucucguccuguccccaggaccagcucgguaaccaaggacagguuccugugcuguggcugucuaguugguaaagugagggguuggcuguccuugggugaguuucuuuccagcucugaccuuuauguaucuccaagccugggccacccucuucuccuggggccguuggccaggcugugagcccuguggugguguggagggccugaguaguuuggcuuccacuugugucagccuccuguugaggcuaaaacccaugagaggguuuuagauggaagcuauggcagaagugaugagaagguuggauagacaggguguuuucagguuagggauuaagagcaggggcuugggagucagucuuggggcucauuuugacuucaucacacucuagcuagguuaucuuggccaagugauuuaauucuucugugccucaaucucuucauuuguaaaugggaauaauaauaacaguauuaacuugcuggacuguuguaaggauuuaaugaaaauaaccaaccuuuauccccauugaucaggggucggguuucauucuaagcacuuuauguguauuuucuuuuuuauuuucuucgagacaaagucucacucugucacccaggcuggagugcaguggcacgauuguggcucacuggaaucuccgccucccagguugaaucgauucuccugccucagccucccgaguaacugggauucuaggcgccugcugccaugcccagcuaauuuuuauauuuuuaguagagacgggguuucaccauuuggccaggcuggucucgaacuccugaucucaggugauccaccugccucggccucucaaaguguugagauuacaggcgugagccacugugcccagccuucuauguguauuuucucacuuaauuuuuauagcaaccccguggaggguacuauuacuagugugagacccauuuuccaggugaagaaacugaggcauagugaguugaaauggucaugguaguuucugguguggaugggcugguggcugagguacccgaaggacuggccuggaaacugcugugugcagugcaggcaggccuacuagcacaugcuucugaaaccaaaagccugaaagggaggggcaagagaggcaggagugaagcucugagucagcacccgcugagcugcaccagaaccuuggaguccccguggcccauccgaggcugacccuucucucugaggcaccuuucacccgguggcugccacagucccuuggucuggaaaguuagcuguuugcccugcuuggcucagaggagggagcaggggcagcucucuggccgagcaaaggucaggcccugcagagccgaguucccagaaucauagucuguuguuagagggggcagugggcuuagaggucgugucgcccccaccuuauuucacagaggugcacccugaggaggugcugggacacgucauggugacaucacgguugggguuucugcccacagagccuuuccggccagugcuuuuuuuuuuuuuucuuuugagauggagucucacucuguugcccaggcuggaguacgguggcgcgaucucagcucaccacaaccucugccucccagguucaagugauucuccugccucggccuccugaguaacugggacuacagguacaugccaccaugccuggcuaauuuuugcauuuuuaguagagcagguuuucacuauguuggccaggcuggucucgaacuccugaccucaugaucugcccacuucagucuucuaaagugcugggauuacaggcgugaguuaccgcacccugccagcuuuguauuucugaccugacauucuugcccugguucuaucccagccccucuagggagaugaagaacagcuuuccucaaaauaacccacuuagagaccuggacuuuuauucaauucccccuccucaacccucccugccaccuuccccucucugaauuaucccaguugucauaaaagagaagagauaagacaguccuuuauuugauccccgaacuaugcaaugugcccuaaaaagagacgcuggucucucuugcuuccagcagagccucugagagccucuggugucugcugaccugcaucuggggguguccuccuuggggauccuaaagcccccuguagaugcucuagaagaggugguggcccugucgagcccagacugccagggcuuguccuuacuggggaugcaggggcccucuaggggcuuccuuagcuccuccuaagccugcaucucugcuaccucagaggggaccaccaggcccagaggacaguaacuggcagaggaggcauaagagcaccgcauaacaugaaggaccuggacccaggaucuggaaggccuccguccugguuaugccacugaccugcgaguucugggguucuggggaaucacuucccuguucagggccugcauucucucaucugaagugagcauuuggggcuuauggcccugaggucccuuccaacuccaguuugggguucccucccccugguuucuuggcccuccccuggcuauggggcucuuccugcugcagggaaggcauucccuugaccuuguggccugacuccucagcucuuuguccucccugcuagcacugcaccuggaagacagguagaacucacagagagccugggauucagaacaucugucucccccuccaggguggggguaagggggagggcgaggggccgugcacucacucucucuucccuagcaaggccagagagcagcuguggucgcaggcugccgcaugccuuucugacacgccaccgcuguuauuugaaggaaccagaaaguccugucucaagcuggcccuuuggcacagccucccugcccccagccccuguaccacccacuccugcuucucaggcuuccugacucagccugccacuggcccccgggucccuggaucccuuccuccucggggccuggcagcucuggcacuggggcuagcuuguuuuccuccacuucuucccccggcucuccacuuugagccuuggcuccaacccagcucuggcuuccaggccuggcauccccgucagcuguggcaggggcagagcugacccuuucagagggucccagcuggcccugugagucgccaggaggcugugccuggcccaucuggcuucuucgcugguucugccaucaagccaccaaaacuggaagguuuucuuaaaccacaacagggaguucccaggcucccugguucccucucuccucagcgaauccuuccuccugcuuuccuauggcuggggagcugcacagugagaggccuguggacaagaagcaggcgcaaaggcaggagggacaggagcccaguugguggggagguggccuguggacagcaaaucacacgcugcccucuaaggagaaaauaggugguguuccucuccacggaggcagccuggacaaggcuggaagugggcccaugaggcugagugagcugggccugggcauucacgauugcuuuucuccucucccauuucaggucccagcagcugggguucccccucagcccgugagcagccauguccaaccccagcgccccaccaccauaugaagaccgcaacccccuguacccaggcccuccgcccccugggggcuaugggcagccaucuguccugccaggaggguauccugccuacccuggcuacccgcagccuggcuacggucacccugcuggcuacccacagcccaugccccccacccacccgaugcccaugaacuacggugaguccuggaagggcagauggaaggugggugggagggacagcacuuggagcagaugaggccaccgccuccugccccuuuucucuucuaguuucccuuaaaucccuuucucaucuucucuguugagaucucucccucuguuucugucuuuguuacccuccacuuuuugccucagcaacuggcccccagccacuugcugcccccuuuguucaaggagauccaugaggcaugucccagaacguacacaccacaggagaauggggcugggccaaguaaugacuccugagggguuaccucagggcaccagcucuguuucccaacaagcggccaacaagcugcugccaccucccagaccugucgacuuccuuaggaacuccuuugggaaccugaaccacuuuccucauccuuuaaagugaaaucugacuuuugcaaaagacauuuggagccaaguuugguaaacaucauggcagggacaugcuuguguuuggucagaaaugaggugaggccggccgcgguggcucacgccuguaaucccagcacucugggaggcugaggcgagcagaucaccugaggucaggaauucgagaccagccuggccaacauggcaaaaccccaucuccacuaaaaauacaaaaacuuagccgggugugguggcgugcaccuguaaucccagcuacucaggaggcugaggcaggagaaucgcuugcaaucccaggagguggagguugcagugagccaggaucgcacuacugcacuucagccugagcaacagagcaagacucugucucaaaaaaaaaaccaaaaaaaaaacaaaaaacaaaacaaaacaaaaaaagaggccggguacgguggcucaugccuguaaucucaacacuuugggaggcugagaugggcggaucacgaguuugagaccagccuggccaacauggugaaacccugucucuaccaaaaauacaaaaaaugagccgggcgugguggcaugcgucuguaaucccagcuacucaggaggcuaaggcaggagaauugcuugaacccgggagguggagguugcggugagccgagaucacgccuuugcacuccagcuugggcaacaagaccgaaacuccaucucaaaaaaaaaaaaaaaaaaaaaaaggaaaugaggugaaguuagagugcagugagucuuccuggguggcucaagcguggauuuuaaaaguaguucccaaagaggcauucaggcauucaggcauucagggaauguuugcagcccugcagcaucucugaaccccagaggggugucagccagcucucaccuggacaugugcgcuggugcggaucugcgcauggguccugcacagucacgcacacccuuugcacaccugccucugugaggcugaugcagaucccugucuucaccucuaucccugcugcugcacaaacugcgcucugccgcccuccuuuucuccuacccucuguccccauccccuguucugcccuggcuggcugccccaguggaugcccauaccugcuccugccuggcuuccccacuacaucgugaccccccagugaacccccaguggcgugggcugggcacacaggagcccuccacagaugcacgugaggaacguuucccaccuaagcccccucgugacaggccggcucugggucacucugagggugucuagaagaccccagcuugggagaagaguuccuguuauaacacuugucuuuuggcuggagaucccugagacuuugagauugucagggaggcuuugggauugacgccacaugucucagguccccagcugagucaagugucaucugucccuaggcccaggccauggcuaugauggggaggagagagcagugagugauagcuucgggccuggagagugggaugaccggaaagugcgacacacuuuuauccgaaagguaagauacgcgcugggagguggguguaccuggggccccucaggcugugggaaugggaaguggguaggccacaguagccccagggcaucaauuccaugaaauacacuggcugccugucuucucuagccuugucugcuucucagaggggcaccuggcuucucuaaccccaggguucccucucuuuuugcaccucucuucuugaccauguuuugggaggacacauucagucugggagaaucuccuagguggguucugccacagcgcccgccuuccccagacaucuuucucccuuuagacuauaggcagcuuggagccagaaaugauccuacucgcuuguaacccacccucuccaucucacagcugcauagagcgugcagacugagcugcugggagugcagaggccauacugguagaguaugguggccaggcagggcaagucaguagucaccgaggcugguguuggacaggaggggagauggcagggagcaugggagcggggcugaggaagaagugcacauugccucugagccaggcaucucacuggggucgccucugggccaggcugcagcuagggaggguucuugagugggaggaaaguacugggggcuggcagcuuccuggggcaggccaggggugccggauggugacccaugcccggccgucuguguccagguuuacuccaucaucuccgugcagcugcucaucacuguggccaucauugcuaucuucaccuuuguguaagucucuaggcuuugccacccacuccuacugcccuggggguucagggucaccugcuggggguguggguggcggugggcccugcucucagggugaccaugggcaauuagagaaggugaagccagggcugccuggcuggccuggguggggcagacaagccucagggugacuacuccuguccuccugugccccacagggaaccugucagcgccuuugugaggagaaauguggcugucuacuacguguccuagugagugugugcuccucugugguugggcagggaggcagggguggcagcuucuguuucuaggugaccagcuuugcucagggcaggaucaaaaugcuuuuugagagggcccccaaguuggugccaguuucccgugccagagggugugggugugcgugcccagaugaguagcagaccccuagaacucgagagcaagagugggaccugcuggugguggcgugcacgcugcgcugcagcccccauguccucucagcccgucagcugcagccuccccagaccuccuuccuggccggagccuggugcuucagagcaucucagugacccuggcuggggguaaucucguucuugcuuccuguugaguugcuuccccucagacuuccaaacggcuauuugggccccaaaucacuggccuggugugugcugccaagcggggcagauuugggccugaacugcuuccccaucucuuugucccuagugcugucuucguugucaccuaccugauccuugccugcugccagggacccaggugagucccagagacuuaacacagugagaggggugacagggauugggaugggggccgaguauuuuggaaagaaggauuccuuuauagcagcugaauggaaacuuacaagaaaugaggaggaggaugacgaugacagcuacuguucagguguauacaaaggaccauguguguuuaggagcuaacuagcugucacucuuauaguaacccugcaagacagguagcauuuuagccaguuaacaaauaggaagaacccgaggcucaaagaggcugaguaacuuucuccccaucacacaggcagucaguuuaagaguugcaaaccaauccagguguuucuggcgccacaacacaggucugucucauuggcccauguugucccugcguaccacaccugaacaggugccaaaggccaugccaaccucccuccuuggagucaaggcuuaauccuccaggcacaggagccaagcgcuuccuucugcuguaggagccucugacgccugaggggccccaagucauuuaaucaaggcuucucuuucccuucagacgccguuucccauggaacaucauucugcugacccuuuuuguaagucuagaaggguggcaggaggguguggagaugcugugagggagacugcucccagggaagggauggggacccauuucagaaggauguccuggcugucuccuccaccuuaucugggccgccuguucugaucuccucuguggcugccucuuuccaacuugguggcguuccccagcucuggcagaggccaccauggccacucccccagcacccugccuuccuuccuuuuuaaguguuucauucuugucucucuccuucccuuagacuuuugccaugggcuucaugacgggcaccauuuccagguacauucagggauaaagcaccacucuugggaaauguguauuguggggagugggguguuccugggccggcagccagcugcguggguggauucugggcagguccccucuggaaguggugauuuugaagucauucauacguggcuuaaugccucuugucuguaacuccugcuucuccccaguauguaccaaaccaaagccgucaucauugcaaugaucaucacugcggugguauccauuucagucaccaucuucugcuuucagaccaaggugagggcauggagggcccuucccuggccccccgacuccccuuucuuaucaggcccggaccccggcacacuagggauguucccuagagaccugauccccuucuccucauccgcaccuacaaaacuguguccuguuucuguccuuagaauguuguggacauucccauacccccuaggaggcagcacugggacucccuggcagggccagucugacugggcugguugucacagccaucugacaggugccucuuucuugcuuccuggcagguggacuucaccucgugcacaggccucuucuguguccugggaauugugcuccuggugacugggauugucacuagcauugugcucuacuuccaauacgugagugucccaggagagcuggggucagggaacccagugcucagggcagacuuccuauauagcauggucucgcaggccccaaagguccccggggcaggcucugaccuccagaaccucucgacuggcuagcaaaggcaccaacguggaggcagcauccuucugggugaggguagacucucuguguggagaugggcggccuuggagccagagcaccugaagcccuggacugcaucacugcacuccuaggggaagggguggguucaaucuggcuggcagcugagaaucagguucucggaggcagacugggagaggaacccagaggacugagaugaugggccuagguggaagggaccuugcgggggucucuggauccaauuauuuccuuuauucuguucagcugggggagaacagugccgaaggggaaggauggggacacgagggcugccugcccaugggccagcucuguccuucuguggacggccaccugugggcaugucaugugggcuguccugugggugcucccggauuuugauacucaccagagggguuggggggccucccuucuuccuuagucuaccccucccaggcugggcuguaggaacuggucuauugaaugcugggucugccccuuucagagcuguaacucaacugcuuuuuuucuagaaguauaguagacacuuguguaccuugacuggcuuuggagauugguuuuauacagccauugcaggauggccucugcuuucucugcuggauauaucaccagucuuaauuuccuccaagaucuggaaaggcaguagccuuucauggagagcuagcuucccagcucuacccacucucaugccacuaucccgggggaagcuggggccugugggccugugguuugcugagguuucuaaugccauucucuguccccuucuucuccagguuuacuggcuccacaugcucuaugcugcucugggggccauuuguuucacccugguaagucccagccccacucuaggaaggggagcugaggggaugaggggaggaaucuagggaagggggcaugaauuuagacugccugggaggcagggaauggggccauagcaggccauuccucucacuacuguccagagauuccauugauuuuugugggcacucuugccaucucuuguucaagcugccugcuauuagaacacuagucagccauauugagaacggugugucugccuccuuuccuagacugugagcagcuacaguauagagcccauauguuaugcugugcguuaauguggcccuaagcacuguguggcgcauaggcccccaagacaaaucugcugaccaaaaaugagcucuggacacugaugccugaguucucacuucuggcuucccuauccuugcaguuccuggcuuacgacacacagcugguccuggggaaccggaagcacaccaucagccccgaggacuacaucacuggcgcccugcagauuuacacagacaucaucuacaucuucaccuuugugcugcagcugaugggggaucgcaauuaaggagcaagcccccauuuucacccgauccugggcucucccuuccaagcuagagggcugggcccuaugacuguggucugggcuuuaggccccuuuccuuccccuugaguaacaugcccaguuuccuuucuguccuggagacagguggccucucuggcuauggauguguggguacuugguggggacggaggagcuagggacuaacuguugcucuuggugggcuuggcagggacuaggcugaagaugugucuucuccccgccaccuacuguaugacaccacauucuuccuaacagcugggguugugaggaauaugaaaagagccuauucgauagcuagaagggaauaugaaagguagaagugacuucaaggucacgagguuccccucccaccucugucacaggcuucuugacuacguaguuggagcuauuucuucccccagcaaagccagagagcuuuguccccggccuccuggacacauaggccauuauccuguauuccuuuggcuuggcaucuuuuagcucaggaagguagaagagaucugugcccaugggucuccuugcuucaaucccuucuuguuucagugacauauguauuguuuaucuggguuagggaugggggacagauaacagaacgagcaaaguaaccuauacaggccagcauggaacagcaucuccccugggcuugcuccuggcuugugacgcuauaagacagagcaggccacauguggccaucugcuccccauucuugaaagcugcuggggccuccuugcaggcuucuggaucucuggucagagugaacucuugcuuccuguauucaggcagcucagagcagaaaguaaggggcagagucauacguguggccaggaaguagccagggugaagagagacucggugcgggcagggagaaugccugggggucccucaccuggcuagggagauaccgaagccuacugugguacugaagacuucuggguucuuuccuucugcuaacccagggaggguccuaagaggaaggugacuucucucuguuugucuuaaguugcacugggggauuucugacuugaggcccaucucuccagccagccacugccuucuuuguaauauuaagugccuugagcuggaauggggaagggggacaagggucagucugucgggugggggcagaaaucaaaucagcccaaggauauaguuaggauuaauuacuuaauagagaaauccuaacuauaucacacaaagggauacaacuauaaauguaauaaaguuuaugucuagaaguuaaaa

SEQ ID NO: 12750 - RNA, 8141 nt, Homo sapiens
cauuuccgguuccggcugcgggccggugaagauauggcggcgucugcgucugcagcugcaggggaggaggacugguaacuuugggggcaugggcuuuggcugacagccuggaucuaguccagaggccuagcagcugucgcagacgguccguacggcgggcgugugggguggagcgagggaugagggauggcagagaugcugacaucucugggaaagcuggacuggggaacgggaggguggaggggcgcugaucugagugagaggagaacgggucggcgcccgccaggccaguucaggccucgccgcauccgguucgaucccuuuuccuccagcuucacgccaucccuuucucuccuccucaaaugaauuuucucaggggcuuugggggaugccugcccaucagaccuccccaucucccuuucuccucucagaaccagugcccuccaguuccggcccccuuuccccuuggaucagccuuuuuccgccgacgcuuuccucagccuucucucucucacacagcacuagugaggacuauuguaugaauaaagcuuuacacuucauauaaagucccucuaguccuucucucaagcauucuuaaccaaagacuagaacauggaaggacucugggauuuggaaguaggaucaauguggguuaacuccacauuuuauuagcugugugaugcugaacaggccaucuagcuucugugagucaguguccucagcuguaaaaaaaaaaaguggguguggcauuuaccucagaauaguugagaggaucacgacggauuuguaauauacuuaagucuguuuuuuguuuuguuuuguuuuguuuuuugagacagagucucacucucgcccacgcuggagugcgguggugcgauuacggcucacugcagccucgaccuccccaggcucaggugauccuucugccucagccuuccgaguagcugagacuacaggugugugccaccaugccuggcuaauuuuuguauuuuuuguagagacggaguuuugccauguuggccagacuggucuugaaccccuggguucaagugauccucccaccucagccucccaaggugcuggaauuacaggcgugagccaccacacccggccuccuuuucauuaauaacugaggugcaggcaccugggaagacuagaugagucccaaagaaguaaagugauuugccaaaagauagaaaauuaugaauagaaauccauaucugucugacuccacaccuuagauucuuuguacuaggacauucuucaguccccacucccccaauuuuuuuuuuuuuuuuuuuuuuuuuugagacggagucuugcucugucgcccaggcuggagugcaguggcgcaaucucgguucacugcaagcuccgccucccggguucaugccauucuccugccucagccucccgaguagcugggacuacaggcgcccgccaccacacccagcuaauuuuuugugauuuuuaguagagacgggguuucacccuguuagccaggauggucucuaucuccugacuucaugauccacccgccucagccucccaaagugcugggauuacaggccugagccaccgcgcccggccccccucccccauuuuguugucaccaccuuaccaccaucccauccaggacccauauaacuagggugggcgaaguauugaagggccacuugacugaggcuacaccucaauguuacauugguucagggagcccagcuaguacuggccguuauuaagaguaucuagacuacugguuuucaaaguguucagggaaacuucuuuuuuuuuuuuuuuuuuaagagacagagucuuacuuugucacccaggcuggaguacaguggcaagaucauggcucacuacagccucgaccuccugggcucccgugauucuucugccucagucucccaaguagcugggaccaccguguccaguuaauuuuuuauuuuuuguagagauagugucucgcuuuguugcccaggcuggucucgaacuccuggccucaagugauccucccaccucagccucccaaagcgcugggauaacuuacaguuuaccuguucaggggaacuuuuaagauucaggggagacaccuugagccauggagacagcaacaaugagugcagcagccuguaguacugugagacucccacucccaugucagccagaacuacacuguuaucugugaggugugaagcuuuauauuuuauauuuugaaguuucugccuaagacuuaacaacacugacauaggucgugcuggggcagccuuacucuuagaaugaagagggagcagugugagaaagcaaagugugcauuuuuccauguaucacuugguagagcuguagacacaaacugaucacucagcuucaauuucauuacaacugcuguuucuaugcuuaaguaugugugucccuugauuuacaucagaaccauggauccuaaccucaacaggcugaucuagaucaaccagacagccaggucauaaauacauccagaguacucuauuaccuccuuccuucccucuuuccuucuaagggagaagguuauauacagacaggaaaaaaagaggacguagacuagcuacgauagcccagauacuauuagguacuuuauguaaacaaaucaccuuuuauccucacaauaacccuagagaguagguguuauuaucuauaugugacagacaggauaacuuaagcuuacagagaggucacgucccagauugcauagcuuguaagugauugguaccuguuaacuaacuccgaggcugcuggcucuuccauuacaacacagccuuuauaccacccuaaauauguuguguugagguugcuaucuccuuuaagaaggcuuagggugacugguguuaaaacuguauguagacaguagccaaggcacugggauccacacuggacagugacguagggaaagguuggaguaauauugguaacguuaaugcuaaugaaugagugccauaucucuagaccagagauucagccacuaaggggaaugaaacuuaaacagggagucaggaaaccuggcucugggccuaguucuaccuauguuaagccuugguuagucauuuuacuucucuagaauccacuucuucaucuguuggcagaaaugaugccuaaaauucugauuuccaugccuucuauuuggccaguugacaacuuaagguaacauauuccuuguuuuuaaggaguuuagcaggagaaugcauucugguagauugccauuuuucuacaaagccugccuuuauuggccuuagcaggcuuccacagggagagcuguaaugguaaguuagucuacuccugucucucuaggguccuucccucugaaguugaaguauuggaguccaucuaucuagaugaacuacaggugauuaaaggaaauggcagguauguauucaaccaguggugggcaggagucccccuaguaaugaggagagguucuaugcugaauuugggucuuaagacauugugagccuugauucagagauaauauuucucuuguguagacaaaagcuauuccuuuaauccuaccccaaaagaaagaguccaauguguacuuccuuugcccacuucacugucucagccccauccuccccagcccccaagccccuacccagucacaucugcguguccacuugauccaccugcagaacuucaccaugggagaucuacaucacuuugcauccugccacugcagaggaccaggauucacaguaugucugcuucacucuggugcuucaggucccagcagaggugaagccccuacuguguggcagcaaagggaggaaggggagagucccugggguggaccgcuucagcaguaacuuguuauuugcccccacuaguauccccaugaggugccacagaucucuauccgaaauccccgaggacuuucagaugaacagauccacacguaaguugaaccugucagaacagggaaaacucagcuacagcuuugcccggugacagaaaugggcaggucuaauauuugguuugcccucuuccuccaggaucuuacaggugcugggccacguggccaaggcugggcugggcacugccaugcuguaugaacucauugagguaagaggugcgcuagucugagauauguucuuuccuucaagcuagagcaguuucuagcuguaaaagggaaaccaugggccuagaaucuuaaacggaucuggagucauuagguaaggccuaaauuaauccagagaaaugagacucuucuauuugaaaaacuucccaaaagacaguucaguagcuucuccaaguugccuaugccagcaucuugacagaaaaugacuuuuccucuucaccuugaauuuuucuugcaucaguuucaguauaugucuuguucucuuggcacuggcaacugaaaguggcaaaagauacgcaucuugcuugggggcgucuuagccauaaaugaacauuugaaggcuagacugccauuggaccugacuagaaaaagucaugguuggccaggcacgguggcgggcauuuguaaucccaguuacuugggaggcugaggaaggagaaucgcuugaacccgggaggcggagauugcagggagccaagaucaugcacugcacuccagccugggcaacagagugagacuccaucucaaaaaaaaaaaaaagaaaaagucaugguuccuuuacugaaagagcuuauacacugcuugaugaaacaacccacaugaagcaacaccugaagcuccaauauacacagaaaacuuuuauuguuugagauuaaaaauauaaaauuaaguacaguuuuauuuuccccuaguuuguuuauuuauuaauuuuaauuuuuuuuuuuuuuuugagacagucuuagucugucacccaggcuggagugcaguggugugaucucagcucacugcaaccuccgccucccagguucaagugauucuccugccucagccucccagauagcuaggaucacaggcaugugccaccacacccagcuaauuuuauauuuuuaguagagaugggguuucuccauguuggccaggcuggucuugaacuccugaccucagguuauccaccugccucagccucccaaagugcugggauuauaggcaugagccaccacgcccagccucucuuaguuuaaauuuuuaagaaaaauguucagaauagaaugaagguggguggcugagagucaaagagaguggguuugauaggccaccguagcaguccuaggucaggccuccacaaugcagccuuggacuuuguggaauuccagaguacacuauuagcuauucaaauaacaauucaaaugcauaguucacagcccaacucaaugccuugugaauucucuguccauuuggguuguccaugccuugucaugcuuucugaaagcugacuuagaacaaacacauugccccaugggggagugauauugaagggggcuaaucaagaaaggccucccagaagauaaauuuuaauugaacauuuuuuuucucaagguguauuauuuucaucuccaagauauauuaaaagugacuuaaugaaaggaaaaacaauuagguugaauuuugaaaccaggaagaucaaauuuugggggaggggcagagauguggagaaggauugauucccagcagagggagcgucaccaagccagaaaugcauaaacacaagguaacaaacuggccugcuaggagccaagucuagccagucacuccuaggaguaguagacaggccuugcucaccguucuucccccuacccccguuuaaucagugucuucucuccucagaaagggaaggaaauucucacagauaacaacaucccucauggccagugugucaucugccucuaugguuuccagguggguuucucucuugggaccuggcauucuguuugggaccagcagaugagggcugugagagagcucugacuuagugcccuacaucugccuucccucuaggagaaggaggccuuuaccaaaacacccuguuaccacuacuuccacugccacugccuugcucgguacauccagcacauggagcaagagcugaaggcacaaggacaggagcaggaacaggaacggcagcaugcuacaaccaaacagguagaccucacugcaccugcacacucaucugacacccuuaggcacagccuuucacaaacuuuuccaucucuccacuccaguggcucuucacuuuuucagggucauagauacccuugagauuaaugaacucuuaccucuguccagaauaaagggcauccuuuuuuuuuuuuuuugagauggagucucacucugccacccaggcuggagugcaguagcacaaucuuggcucacugcaaccuccgccuccuggguucaagcaauccuucugccucagccucccgaguagcugggauuauaggugcgagccaccacgcccagcugauuuuuguauuuucaguagagacgggguuucaccauguuggccaggcuggucucaaacucaugaccucaagugaucccgcccgccucggccucccaaagugcugggauuacaggcgcgagccaccgugccuggccagggcauccuuauauacacuuacauauugcaugcaguuucgggggguucccagaucucuaguuagacaacccgugcucugucccaacucacugcugaaccggugucccugugcccuuuagucccagcccucugcagauuagguuggcugaugggucagcaccagggggcauccugggcugugacacaggcauaugauuuuucucuuuuuuagaaggcagucggugugcaguguccagugugcagagagccccucguguaugaucuugccucacugaaagcagccccugaaccccaacagcccaugguaaggagacuuuuuuccaaucugagccaggaguaaugguauuuucuaaagaguaaggaauggcaucuugucugugucaaaugggaucucugaaauugggcuugaacugccuaggaccucucugcaaagccacaucccccacuggcgggagccuaagacucugggagcccagaccugaggggcaaaaccagugcagaucuccugaggcagccugggaggaguagagguuugagucagccuucugcuguucauuauuuccucucugccauucuuccuuccaggagcuguaccagcccagugcagagagcuugcgccagcaagaagaacgcaagcggcucuaccagaggcagcaggagcgggggggaaucauugaccuugaggcugagcgaaaccgauacuucaucagccuucagcaggugagggaagggcuucccaguuguccuguaaugccaccaaccuuucuacaaaccccaaucagccauggccccagagugagcuuuguucuaaccaggaagaugauaggcugaucguggucagcccagauaguaggagaggggccuguaguuccccaccuugaggaacugcaucucccucacugcaucuugucacuuauuucuagccuccugccccugcggaaccugagucagcuguagaugucuccaaaggaucccaaccacccagcacccuugcagcagaacuauccaccucaccagccguccaauccacuuugccaccuccucugccuguggcgacccagcacauaugugagaagauuccagggaccaggucaaaucagcaaagguugggcgaaacccagaaagcuaugcuagauccccccaagcccagucgaggucccuggcgacagcccgaacggaggcacccaaagggaggggagugccacgccccuaaagguacccgugacacccaggaacugccaccuccugaggggccccucaaggagcccauggaccuaaagccagaaccccauagccaaggaguugaagguccuccacaagagaaggggccuggcagcuggcaggggcccccaccccgcaggacucgggacuguguucgcugggagcgcucuaaaggccggacacccgguucuuccuacccucgccugccucggggccagggagcauaccggccugguacucggagggagucccugggccuggaaucuaaggaugguuccuagcaggacuugguggggggaacagggaauuggggaugggagggaggcaauaaagauauuuggccuucuuuggcuuucuuugcuuagcagcgccuag

SEQ ID NO: 12751 - RNA, 7757 nt, Homo sapiens
gccuaaccugccaccgggcuggagagcuccuccaggcuacagucggcuucccagucccagccauaguagagccuccuucggauccgggcacucagcuucugguguccugggaggaacugaaacagggcaggggcagcggagggugaagggcacggaaagguaugaugcagauccuggcucugggcuggaaggcggggcaggggacaggccggccucgcugcuagggggcccgugccuuacccagacccgcguucuguaaaucgcuugccaauggcagccugguccauagagggaggaaugcccccacccccaucgaggguuccccgggagaaguucuccgagaagggcccucguguggccaccccuacgcccauuccuauacuccgcggcucucccucccggcccaagcagccgcggccucaaggaagcacugcucgagcagcugccgcccagucccggcacagcagucaggcgagcucgcagcgccgcucaggccgggaggggcgcgccgggaggccggggagggggcgggacccccacucaccgugaaguccuggaagccggcgagggagaaggugccuucuucguccagcaggagcccggucagguccaucgcgccgccagucgccgcccugcgaaggugaacggaaggaaacgaguuguagggggcucgcggagcuguccuugcccgccuguccaccugccagccugccuccccggggcgggccgccguccucgcccucgcccucgcagcucccuccccccggcggcggaaggcggggcccgggcugaacugggcgccucuuccuguuccgccccgggcuuggcgcggcgcgcgggggcccuaggcccgggaagggaggugucaagcguccgugcgacgcucaccucgcggagcagaaaggagaugcggcugcgaggcgcguacuccgccugugccgcguccgcccggcguuuacaagccgcgggggugccgccugcaagucagcgccuggcacuuccugccgcccaucuggcccagccucccgccccgacccgcgggcaggaaccggacucgaacuccuggucucacggaacguggccaagccccaggcgccucugagaaauggggacaauucguaggggggaccacgccgcacugaggaugaacaagccaggcguagcaauggagaaguuaaugugaauaagacgaaacgcacaacaggaaguuguucccaguugcuuuuuaggagagauauuauacauacucagcaaugcauaugaaaagcgucugaaaggacacacaggaaauuuagcagugggugaacuaugaaaaggaagagaaacucaggguguuuuuuuuuuuuacuguaauuugaacuuuuaaaccuaaggcuacugaggaaauucugugaucuuaagcgaauguaaggccucaaaacgugucaacacguccacccaaaaguaaacugcaucuacccaagguuuuguguugaaacccaccucccgccuccgaucucaugcuugaguaggccgaggugggaagaagcuccgauauguggaagugggaaaguuuaaggagauaggaaagaaacaacuuuucugaguagauguuguuuucgagucugucgagucaagcgcugguguguguuuguuuacccacugaggggagggaacugggaggaccagugcguugaggguugguugaguaaugggacggccaccgcccuucccgagcgagcagaagcagacccuaccggggauacugggaaucuggaagcccacuuccugccccacacggggauaccggggcagcaccacacucccuagccgcccugccuacugugggauaagaaaacgggcucgacugccuggaccuagacccggacucggaacccgggguacuucgucaaccagaaaacgaaccuguguaggcgcagugucagcggcagccgccggggcgcaugcgcggcccgcccuauccggggggggggggguuaggccgcgucacgugacgggcucagcgcuccgcagucacgugacgcucguccgcaaccucugcuguccuccgcggcgcccccuuccgccugacgcgcccccggcggcggccgcgcagcccuggcuccucgcgggcucgggcggcggcugcggcggggcuauggcgagcggcgguggcggggguaacacuggcgcggguggggggccggggaugggccugagccugggccugggucugggucugagccuaggcaugagugaggccaccagugaggcagaggaggaggcggccacggccgaggcggugggacgccuggccacgacgcuguggcugcggcuccgcggcugggaggcggugcuggcggcggcgcagcgguugcuggugugggagaagccgcugcacagccuggucacggcggccgcgcucaacggccucuucugguaacggccgcggaggagggggcggggccgggaugagcgggggagggaggggucgagagcaccauuccccuuucuggguuaucacuuggccugggggcaugacccauccccaguuuuugcaggcugacauccgcuugaauugcccauuuuuuucuaucucugagucgugagucgcgaguuaggccuggaggugccauuaccccaucaguaggcgccuuuccaccuucugagauggaugcaugagccugucucacccacucacugcugaggugccugucucucccuaagguugcugucuuccucgucccuccggcccuucuuccuacucagcgucucacuuuuggccuauuuucugcuggaucucuggcagccucgcuuucucccugacguuucaggugaguguuucuucauucaguaagcacccauuggguacuugcuuggugccugauuccgcugggugggguuaaguggcgaggggaacguacagcaggccaccugccucccaggcauggcccacuuccuuuuuguacggaauucccuaaaaugagaauugccccuuucccaaacuaauacuacuguaggugcagugguuaagauggugaagucugcagccauauuaccuggguuccauucucuguucugccauuuaccauugcugugaccuuguaaaaguagcucaauuucuguuugucucaauuuccuuaucuguaaaacacagaugauagaacuuacuucauagagaggugaggagaggauuaaugaguuaauacacaugcuauacuuaugauaguguuucacauauaagccuuauaaauagaacgucaguguuguuuuucuuguuauccauauaauuuacuuaguaggugacaggcuguaugugaguugcuugggagauaagcaugaguaaaaucuaguucuuauguuggagaaggguaaugucuaaaggagacagacgcaaacaaaaacauguaacagcucccccauuggcaucugaagaaggugcucuggggcugcagaggagggacaacuauuucugccuuggggagugucucccagggccccuaccacucaauaauuugccccccuccucucucucuagcaucauccccagaggagccacacucugacaggugaguacaggccaccucuugaagacaaaugcccacauccuguccugcuugcuggugccagugucaccauggagcagggcagugccccagcauugugaaugaacugguaacaagccauggguuuuucaugguccuaggcuccuguguagguguuugcgugccugcuccuuuuggggcagaggguuggguccuccuggcuuugcuucuaagaccaggacagccuccuuuugagagguggggucauuugcuuuuuuagacuaaagauaucuuuggcauucucagagggauuuaagugucuaggaagcugguaucugaggccuccaggggucaugucaugucuccccagugagggugcggggucaggcgcccggccgcaccugcugagugugcccgaguugugcagauaccuggcugagagcuggcucaccuuccagauucaccugcaggagcugcugcaguacaagaggcagaauccagcucagguaaccuccccuacaucauacaacaguucacuacacugaaggggaauagagguggcgggggaugggaguggagugauauaaacuccccgcuuggagacccugaaagaagaggccugggcgccuucuugaggcaacauucacagcuaaucccuggugcaggaggcagucucaccucaggaaauaagcuuuugauagccugacacuuucuccugccaaggcagaccagugugaauuacagguggugggcauuauguauugccagcuuccugaauugguggucuugagcauccucuuaaccaaacuggaccaccccauuccuugaguacauacccauccuucuaccagcugagcaguaguuucuuacccagccgagcggggcgcauaucucagcgugauguucuuagacuuuugcucuucucugcaguucugcguucgagucugcucuggcugugcuguguuggcuguguugggacacuauguuccagggauuaugauuuccuacauugucugugaguagggucugucccugcccuauuuaaagcccucuccuuucuucuuuccuuggacugacccagagggaagacuaugcucucucugcucaguuucugauuuguggagaucuccagggaugcuuuaguauuaguaacuguggaagacuuaccuggggaggagggcaguggauguggcaagaagagguuggcacagccuugggaaaggaccuugccuaccuucagcacuucaguuuagggaccaguugaaugggggcucuuaggaaauuggcguagggagcucuuaguucacguucuuaacccauaguguugaguauccugcuguggccccuggugguuuaucaugagcugauccagaggauguacacucgccuggagccccugcucaugcagcuggacuacagcaugaaggcagaagccaaugcccugcaucacaaacacgacaagaggaguaaggggcugcccuaagccaggagggugaaagagcgggagggccuuggcuugggguucaugagaugcccuggaauugagaucuucuccaguucuuuagcuguguuugucuccccucccaucauucaugcuuggucauugcucuacuacucuugcuuuucuagagcgucaggggaagaaugcacccccaggaggugaugagccacuggcagagacagagagugaaagcgaggcagagcuggcuggcuucuccccaguggugagguccagggaaagcgggggugucaaauagaaagccagaggaaaaaucuuucugcuuuggagcugccaccuccaaaggagguggaagccagagguuuugggagaggggaugcuccugauaaauugguucucuuauccccucacaugucguguucauccugguucuccugccagguggaugugaagaaaacagcauuggccuuggccauuacagacucagagcugucagaugaggaggcuucuaucuuggagagugguggcuucuccguaucccgggccacaacuccgcagcugacugaugucuccgaggguauggggagcccuuugcugcccugcuccccgccacaaucuuuguguucccuaccauggguacuuacugugcucucuggcccacucacucucuaauucucucagcuccuaaaagaccuuaacaccuaaggcuuggcccagcuuuccaugucuugaguucucauccuugaacucauugucuguuguggcuaaucagaccagcagcaggcccauucuuaauucuuuguucucugcacagauuuggaccagcagagccugccaagugaaccagaggagacccuaagccgggaccuaggggagggagaggagggagagcuggccccucccgaagaccuacuaggccguccucaagcucugucaaggcaagcccuggacucggaggaagaggaagaggauguggcagcuaaggaaaccuuguugcggcucucauccccccuccacuuugugaacacgcacuucaauggggcagggucccccccagauggagugaaaugcuccccuggaggaccaguggagacacugagccccgagacagugagugguggccucacugcucugcccggcacccugucaccuccacuuugccuuguuggaagugacccagcccccuccccuuccauucucccaccuguuccccaggacucaccccagccccugccugccccugaggaagaagaggcacucaccacugaggacuuugaguugcuggaucagggggagcuggagcagcugaaugcagagcugggcuuggagccagagacaccgccaaaacccccugaugcuccaccccuggggcccgacauccauucucugguacagucagaccaagaagcucaggccguggcagagccaugagccagccguugaggaaggagcugcaggcacaguagggcuuccuggcuaggaguguugcuguuuccuccuuugccuaccacucugggguggggcaguguguggggaagcuggcugucggaugguagcuauuccacccucugccugccugccugccugcuguccugggcauggugcaguaccugugccuaggauugguuuuaaauuuguaaauaauuuuccauuuggguuaguggaugugaacagggcuagggaaguccuucccacagccugcgcuugccucccugccucaucucuauucucauuccacuaugccccaagcccugguggucuggcccuuucuuuuuccuccuauccucagggaccugugcugcucugcccucaugucccacuugguuguuuaguugaggcacuuuauaauuuuucucuugucuuguguuccuuucugcuuuauuucccugcuguguccuguccuuagcagcucaaccccauccuuugccagcuccuccuaucccgugggcacuggccaagcuuuagggaggcuccuggucugggaaguaaagaguaaaccuggggcagugggucaggccaguaguuacacucuuaggucacuguagucuguguaaccuucacugcauccuugccccauucagcccggccuuucaugaugcaggagagcagggaucccgcaguacauggcgccagcacuggaguuggugagcaugugcucucucuugagauuaggagcuuccuuacugcuccucugggugauccaaguguagugggacccccuacuagggucaggaaguggacacuaacaucugugcagguguugacuugaaaaauaaaguguugauuggcuagaacugcugccucccugacugugagcugccuuccacacccugcacugcacuguguucucuccucacccuuaaccugcuucacuccagucuguucuggcuguuuauuaccuuguugcaaaacagggccgaagcaaggauuaccuugacaacccuagcuucuccuuagccaucuuccuugacagugugaucuguuuagugagauuuagcaugugugaauaaaguauaugcaggaggaaauugcuuugucuucccaaucgguagaaauucgggaccauaaaaauuguguuuuaccauguggccuacaaccuuaacacugcuuucuuaagaagucuucacccaucuacaugcuaacaacucacucagccuggauuuaucuuuacuggggaagccaaacaagcaauagaggaccuuuaccuguguuagaaaugaguuggagccaaggaacacugaagaaauaguaucuuaacaguuacugaguccauu

SEQ ID NO: 12752 - RNA, 2868 nt, Homo sapiens
uacguuuuaucaacugccaagauccuuuauuuuuuccaggccccuuccugcccacuccacaucggggcagcuccagcauaagggagaugacaugaugaaggggcuaagaguagggccuggccagcauccacugagggcccaaccagggaacaguugcuagccgcucucuuccaugcagcuggagcacuagcaaggccuuccagaggcucccagggcgaccuccacaucacucccgcuugucucugcccuccagggugcuccgggccuccucucccuguguacccuagaggugugagggccacaguccuccucaggugaaccucccuccccaagcccagggcccuagcacaggcugcaguuggacggcuucgagcugcggcucugggccuagagcaaagagaggggaaggaggggaagacacagugcaacgucaaggaaaugagggacagcccucauuucagagcucagcaugggcuggagucauacugaaaaccagacgauaaccaccauuccaaaacucugcaccacuaggaagaacccccaucccugacuucuuccucccuuccacugcagcauauaucuucagcccagccucauaccugcugccgcugguauucugccucacuggcugacagugcuugugcuaaagcuaggucuucuuccuccugacaacugggagggagaaacaguuuaaguuggaugaugguaagaucugaaauuugaacaucugaucuguguguguugggccucauggugcugagcacugcugaggauuaucucaaucuucauagcaacacuacaagguggguauuaguauuguccccguuuuauagaggaaaugaaggcuccauggguuaaauaacuugucaaagaucauauaguucaucuuaauuuugagaccaaguugccagcgauuaucuugcauugugucagaguggucccaccuaccugccuccagaccaagcccuugcccacagcuugcgcucucuuucacaagaggguaagguaccuuggaaccugggguuugguuucugccagggacauuuccagggcccgcugcagagcuucauccucacucuacaaagggagaaagaagaccagcguccuuggacuucacucucuguguguuuguuucuguccauccaaccucugcccaacucaccaggccauucugcaaagcaaucacuggaggggcuguccaggacggagaucggguuguggcucuacgacagacauugaagagguggaggucagaggugugaaggggaaaaagggggagcagggaaacgggcaggccuaccugcugggagagguacaggaaggcaugguuugacuugggcuggggacagugcuuguagaagccacagcuugugcucuggagauggcagcaagucuguagggaagagagauuuuuggcaugucuccaagaacuagccuuacccaggaagucaggaggggaguucuggaaaaacaugcacuugaaaaggaagcuaaaagacuccccuagccgacaggguaggguugaagcuccccaauuuauaacaacagagcuugagucaguuccaaaagaaugcuucccaaaagcaaguggaggacuuggcugccauuacccugcccggcugguugggugccccuccccagagcaaucaugguccaguggaugccggugcuugaugcagaaguuucggcuacagcguucacaggucaguuucaucauuucucgcugccggcagccagcgcguucacacuuauuggugaagaucugaggugaagugagaagguugucucugcugagacucugauuagcuguuuggguuuccaggcauccguagucccagcuggguuguggcugaccccuacaauguuuaccuuacguuuuugcugugcuggaucagagcgacagucucugucaaugugcucucccacagcacggucagggggcuccccucuggccacaggcacaggcacauuacagagagggcacacagguaccuggauauccuguagucaaggagcaagggucagucuguggcccacuccaguccaacaaaucucugguccugaaagaacuuggauaugacccaccacaaacacgcaaaaaaacaguguuucccagcacugacagccucagaaggacaaaagggagaagaaacgugagacacagauuugggggauucugcacgcauucuccaucugccugcuuucacccugaggaucgcccccucaccuuuugguaagcagauccacagugaugcugggcguaggccacauggucugcgcagaagaugccugagcaggcaucacacuuaagcggcagaaaaucugcaaagaguuggucggauugcagguccagcgggaccucgauguccuucucucucacucaagucuuccacucgggaaggaaaacgccacccuauuuucgacacaccgccccuucccaagcccauuaccuccuuggccacgcccccucugccgcugaccacccccccccagcuucaagccccgccccccggcauugccagccugggagcccacccuucccucccaaccugcgguucaaagucccuguccgcugggccccgccccccgcgcgcuccgccccucacccaagcgcugacagcucggcuccgaacagugagcgccgagguccggaaacuccaucgccaagccgggcagggucugcuaggagaagcgacgagugcugagcgucuuuagggcucgugcucgaaguccgcaccgcgaccccgcacucuggcgggcucccugccccgccccuuccucucccccgcccagcccggguuaccggagcccccgcgccagccggcccccggcgcccgcuccucccucggcgcgcgcggcgcgcugacg

SEQ ID NO: 12753 - RNA, 10987 nt, Homo sapiens
ucuggucaaacucccuuuuuauuaaggguuaucaagcuguacacggucccuacccugcuccgcuccgaguucgggcagcgcaauucaccacucucccaaagccggaccacagcugggugaggggugggacagagaguaggagcagucccagcaugcagugcagcagcccaaagccucgggcgaggcaucgcccuucaucccccuucagggcacagcgagaugcgggccagagcucuuuugcugggacgcacacagccaaggucacccuccagcccggucugucccaugugcaggugaugggggguacgauaagcagcaaugagggcccaggaagaccucagucuccugggggcccauccuaaaagauggcaagggcagcaaaguauuuccauccugcuccuacaauuuagaaaccuucuuuuuuagugucaaaauauagcguugaggggagcuggacgcuagggucuucacccuaacgcaaagcaaaagccgaacggaacgggagcaagcgaacagaacaggagcaagcagcacacacaggccagugaugugcaagaagcggagagaggugagccggcugcagcacugggcgagaacugcgggugagguaagggccacagccugaccugcucaucuauugagggggcuagggaagguugcagggguugaggguccaggcccaaccuccccacuccacaguuggcacagguucucccugcuuggcagcuucuaucgugggcagcccucuggggacuugcagggguagguguaaagguggcaguacuggggcugggcugggggccaguuucuagcaccacacucugagccaaggggguccuggggaugaggcuagagucccgugugcccucgguuccuaggccccaaauuccucuccuggggcuguggcaagcccaguguuggcaccucccuuggccaggcacagacacacaaacaccacacacguggggccagggaacacucagaggagccgucccauggcaggcagacgggauggcagggcagcgguggccuccauccugggccacaggaacccugcucagccuugucuauaccuguggggagaaaggguugguaauggagauagucuucagcuucugguugauaccugcuagccccauagaaaccuagagguaaagggacaggaaagguugauuccuggggagguaagguaaggaaaaaccaagcccugcagagcaguugagaaaagaagggguaguguguuuuggaagggaggguacaguaucucuguguggggguggggcauaucuuccuuccccugaaaagcuguuaccucacccuggaaguuacuauuucuggcaguuuuuccuaggccccggggcccuuaccuugugcaccugaggggguagcucauccuccgagcccucuucgggcacgggcucagggugccuugaugccgacugcccaucuucugcccacccuccaagaggcagccgagagaaaugagagggaacccugggcacugugccaggaucuggagagacaaguaagaguaagcauacucauagaaggaacacaagaaugaggaacagggcuggggggcugcuuggggggugagucuuugggccuguucucucagaccucuuuccuccccuugagaggcccuggaagaaccacccuucccugcagccucuguuuccuccuauacccccacuggauaccugugaugccaccguagcgccucuggaagcccccaugcagggcaguggucucaggagcuccaggccggggugcugcacagggauagcuagcagagcgagggauagacuggggggcccgggcgcccucucccccuucaucaggggcgcuuucuccacucucaucacucucccggcggugccauacaugccgcucagguucagccugggccugcugcuuguggagcuggagaaauggggggcucguuagugggggacagacggauguccaucugaaacagcugcccuccaaccugguaucagucaguucccgcuuuaccccuucccugagaauccuugccucagagcaccuauuauguuaauaguguguaauauaccucugaucuuuacagguuacauucacagcagauccccggaagaagccuguguuguaauggcccucauuuuaccuauucauuugauucaggaacaaacugacugacggucuaagugccaggcacucuuuuagguguggggagauagcagugaacaaaacagacagaaaugccagcccuugugaggcuuauauacugguagaggagauauggaauaagcaaauaaauaaggaaaaaacaugauaugucacauggugcuaaaugcuauggagaaaacuaagacaggaagauucaggagggugggcaagggagccuuuuacugagagugaucagagaaagucucagggaaacggcagcugcagagacccaagaagaaggaggaggccaucuggauaucccagggaacuggauucuaggcaggggaaacugcgagugugugaaggcccuggaugagagcaggcuuagcuaaaaaggauauuaagaagguagauaugggaguggagguggcagaacaaguaaauggcagagaaggguuuggaaccccggucuugcuucuccgcaucuaaacccucuacucucuuuuuuagcugugcacucaccuggugcauauagagggcaugcaggcucaucucuguggaugcauauucugacagcaccaggcucugcagcuguccuucccacacgcugcucccggagcuggcuguccuggcauccacccugucucucccaacagagacagacagcagcugugaacuucucugagacccacacaagcugcugagggcugccgugcccucccaucuuggccccgauuuacucacccagagccugucauggugcugugagcccggccugugggcgccugcccggguugcagcggggagaaggagcgcagggcagaggcgacuucagcccugugccuggagcccugcaggucucugggcaguggagggccccggcaggaugagccagcuaccacauuugcgauaaggcucaggggcuaugaacgaaacggguagguagaauucuugaggcaagagaaaggucucugggguccccuaguauucuguaucucaggccccaguggcacauacugaagagacagcaggaagccuuccaccccaugcccggucccucaacucccagcuccugaaguccacucugcccaucaucucccagucaccaggaacacaccucagacucagauuguaaggacuggauagacguaaagagggcauuuucagggagcagacccccuugggcgaggcuagcagcugcuccaucccgcugaaccugcuccuugaggaagccuaggaaggcugugcucucacgugguggcugccagccaggguuggugauggcaaagugcaugagugacaacucugucuuuccauccucagcuugcugguacacugaggccucugucugcccagcagauagccacugcacaaggaagagcagaguaagcagggcuguucucuuccaggagccuuccugcaccuuuccuguuaguggggaggccuuacccuuggagaacggagaccacaguauacugucaaucuuucccagggcacuggugcccccccagacccaggaggggcugcacugcaugcugagccaguuacuuguguugugccuuuuuuuuuuuuuuuuuugagauggagucucgcucugucgcccaggcuggauugcaguggcgugaucucggcucacugcaagcuccgccucccagguucacgccauucuccugccucagccucccgaguagcugggacuacaggcgcccgcuaccacgccuggcuaauuuuuuuguauuuuuaguagagaagggguuucaccguguuagccaggauggucucgaucuccugaccucgugauccacccgccuuggccucccaaagugcugggauuacagacgugagccaccgcgccuggccguguugugccuuucuuaagggagcuuggccaagggugcgaauuagggcugaaauccagcccaggcucccaagcagugugccccugguauaggacugccuuugugugacucaggagaggugucuuuuugcgguuuucccaaagacacuguauguuccagcaucaucccaggccaccuggcucccuccucucccaguaccuggggaugaccaugcuggcgaacauccaucugagcaaaggagcagguaucucccacaccaacgaccuccacggugaaguuucggaagaagucuauaaucuccagggcccgugggcgcaggcagaagaugaggaugaggggugugacaauggggcucagcaacucuuccaaaaugaacaccuaaaagggcgggaccaaggucacaagcgagcaggagggagcccagcccucaccaccgagcuaccagccagucucuagcaggcccuaacuccaacuccacucacugccuuguacuggaagagcugggcaaacucgucccgggucugcgagcggugggcauuacccugccaguggucaggcauguaguggaugugagcgaggaucacgcggagcagcugcucagggcagaacaccaugugcugguccgggauaaaggaccuagugggaucaggaucauggugagauguaugccuuucccaggaaugcuagccggcuugcucccgccuguggcccuggcccaccugcacacggucacggugacccccaggagugugacgguggucagcacauguuccacagccaacacaucuucgucauaaauggugagggcaauaagcacagccaggauggagccagcgaagaaggcuccauucuuggccagcagugucaaaagaggugacaagaagcaauucauguacuuggaggcgggcuuguagccacgguugaggcgggacugcagcucgugcuccagcucguugaaguggcggagguagcagcggccauagagugaccagcagcgugcucccagggcccccggcucccgcuucagcaccucagcauagcugaagaaggcauagaggauuugccauaugaggaugagggggcacagcaggaaguuagcgaugccaauccacaggaugcgguugcugaggcgcugggccagcucuagccguugccccccacguuuguacucggccuugaggcuccauucauugagaaacagagagccagguccccagaagaggaucagcucaaaguuguacuugagaccacgggugaagaagacagcuuccccgaggccaggcaggcggaagcgcagaggcaggagggauuuguuaaccagugccaccauguaguucuggaaacggaggaugcggugguagauguccaguucugucagcucacguuuguggaugcagaucuggugcuccuucugcgucugcacgauccgggccugcacuucuugccacgugcaauacggaagggcagacugcggggugggguggggaagagacaagguacggaaggugggguuguugccucgaccccuuugcccuauauuagaagugagauucagggguugugagcuuaagagacaguuccugauuugucaaugacagauaaggauaacugaugcccaggaauacacccacaccucccaauacgucuuagacuaugggcuaacugcccaacuucccagucuuaccauagggaugcgcagagcgugcagguagaaggaguggaucucccaguagcagcaaauguuauagaugaacuugauaagccgguggauccagaagacaccagcaaugaccaggauggugauaagggagccauuuuccugaauccugguggggaaaaagaaggggaggagagguggcccucgaggaaggagucuuggcagagacgcugcuauccugaaguauuuuugcuagaccaagccugagucaguucuggaguaugaguugcugccucagacuccacucuauuacccaccugcuagcagaacucaaggcuaugguguccucuugacuugcagcccuuaccuggcacuacagacuugagcaggcaaaaaggcgucuggcagagugaccuugacggguucaguagggugaagacugugguucaccaucuuguuggcaaauaggaugucauaguccacgcagcugaccaggaagguagugaaggcaaccacaaagaggaacugccuggggaguugggaagaaggggugcagucugagagccagagaggcuccagugaaacccagugggaagaggagagucuggagguggcagaacaagacugggaacuggaagggccuggagaacucccagugggcccucucugcuccucagccccacaggacugucucaggcccacucuuugcucuuagccucagcugccacagcugcagccuacuuuccucaccucaugguaaccucagccaccacuacuggacucucgaagguuucauccugugggucucugaucuccagucucugauuuccuuuugagguuguaguuaaaagcccuugggggaguuuucugauugagggagggcuuccuaaccccuuccccuucggcaaugcuauauggcuucucucucccaggaggcucucugccuaggagcaggccauggaacaggcaaggcagaacagaggcuuuucucuguggcuggcaucucugagaccuccugacugaacaauguacguuccauuggagcguugagaugaucaaggucaaggccugcauucuuuuuuuuuuugagagagucucacucugucagccaggcuggagugcagcggcacaaucucggcucacugcaaccuccaccucccagguugaagcgauucuugugccucagccucccaaguagcugggauuacaggcgugugccaccacacccagcuaauuuuuguauuuuuagagccuccuaaagugcugggauuacaggugugagcugccgugcccaaccaaggcuuggguucuuuucauggaagagauaaggcuuggaaagcuuuucuuguaagaaagcuuggccgggcgugguggcucaugccuauaaucccggcacuucgggagguugaggcgggcagauaacccgaggucaggaguucgagaccagccuggccaacuuggugaaaucccaucucuacuaaaaauacaaaaaaaauuagccgggcaugguggcacaugccuguagucccagcuacuaaggaggcugaggcaggagaaucacuugaaccugggaggcagagguugcaccgagccaagaccacugcacuccugccugggcgacagagugagacucacuccaucucaaaaaaaaagaaaggugaagcuguaaguuuuggugccacacccagucccugaacuacaaagguuuacggaguuuuagccuaggacugaguuguacuggcagguugggccaagugugagugcaaggagaggaaagacuaagauguauucuuucaccacaucaucugucccuucuuauacuuacaugagcucaaagaucuccccgaugagcauacaugugaagccauucuucuggugcagauuauaaacguguaauuguuaagaaaaaguagucaguaaagaaagcagguaagagcacagacuuuggugucaacacacucaagcuuaaguccuggcucugugacuuucuagcugugugacuuuaccaaguuacuuaaccugucuaaacuuuugucuguccauggugguacauuaggaauaaauaacacuugucucauaggaguauuaggucuaagauaaugcauguaaagcauuuaacacagagcugacacagaaugagucaaaagacguuacuuauuacgauuauuuacaucccaucaaaaaggaggcucggcugggugugguggcucacgccuguaauccuaacacuuugggagggcaaggcagguggaucacuugaggucaggaguucgagaccagccuugccacauggugaaacccugucucuaugaaaaauacaaaaaauagcugggcaucguggcaggugccuguaaucccagcuacgugggagacugaggcaggagaaucucuugaacccaggagguggagguugcaguguguugagaucgccccuggacucuagcagcaacagagacagacuccaucucaaacaaaaaaaaaaggaggcucacccuuagaaaggcuucuacaaauuaacaccacaaaguggacacaggcacacagaucuugguaaaugugggcuaucauuacuuaacgaugauuucaccagccucuuucagccucaggaugagcuccauucccguuuccagguauuagagucaaaccuacccccaccucccaccagagccccggcuuagagagacauuaaaggucccagagcuccaacucagaaacacaaaggauauucgagagaagaagaggucaagguuuucaauauggugccaaggugcugugggauaggaacagagaugucagagcccugggagaacacaagccccuugcucucuccauguucuuccaucaacucucccuauggcugucauauccaagaacucacacuugcuccccucggcgacgugcaccaacagguccuccuccccugggggugaaucacuauaggaggccucuaggcgcugguauucagugucaaacugcgccaucaccaccgcccccuguccaccuugaccaccugccaauaaggaggaagaagagacccugauucaguuccagcugcugcccaugggcugcccugccuacugccaaaaggagaaaguacccuugggcuuuguccacuaccagccuccuuggcucagaggcagaggaguagugacacaagaaaggcaguaagcucagggcugggggagccuuaacucuggccagucugggugucuacugcugcuuuccuggcccaaagccagaaucugucccuuuguugggggcuguuucaucuucuauuuaacggacagaagagucccucccccgcccauccugggaacccuggucucccaagagacuaacaguuuggaagcacuucacaaacaaauguuugagaaaagcacauggcccuaccagcuccauggacaguaugugcuccucuccagcccucgaugcucugcagcugcuggaggagaagaugucaggccccagagagugggcaguggggauaaaaaggaacccaacccucccagccauccacaccccaccaagaggaggccaagcauggggcaggaaggcugcaguggggaagaagcacccuuccagcccaggacuacgagcacuuccucuggcugugcuaaaccgggccacucuuccaacuccagggucucaagaaguaacuuagggaccccauggagaaugaguggguacagaccugaggccaggggcgccucuggacuauuucuccauugcccuaccuuagccucagaaaugacauacuucucaggguccacaaaaccucaagagucuuuccugaagaggaccuuucuggucaaccccuucucuuacuucccuagcaccaaagauccagccggugagcaaaccuucuggaugggaaaccuugacugggucaguguagacccccgauccuaggugaauuuguggguucccuagguccuguaagccaggcauggucgaggugguacucaccuguccgugcagccccugggggccguggaucuuggcccagccuggccccggugggauucccugggcuagugagagcccugccccucagggaagucaccacucacagggucaguguggaccagggcccguggagccccggccggcugggccugggcucagggguuccugcggauguugcagggaucgagucagccuuacagcugauagcccggguggguuggcuugccuccccacacccagccgcggcgaccguggaccggaguccaccucgccccagggucgcccggccccaggccaagggcuggcagcucccaacagcggacaaccucgcgcgcggccccggcgcccgcgcgcgcccccgucugcgcgcgccagcaaucaaaacauuccggcugcgcgcccccgccccgccggcggcgccccuuccuccguuacccgccgcgagcucacuuagggcuccgcaggcaccccugggcaaggccagacacggggccugggauuccaauaaccggucucacgucuuaccucaggaacagcgacccgggugauuccagaggcuccgccggcuccgcucggcucggcucggcucggcgcgacccgcggcgcuaggccgggugucugccacucacugucacccgcagccaggcuggccaauaagcacggggggcggagacacaacggccaauucucggcuucagggacgggacuaaagucucgaggcgggucuuggacagucagcggcccaauagugugcucuacguggggcggggcucaggugcggacgccgccgguuguccucuucgcugcuccguagugacggggauuguuguguugcagaaauccggcaaucgaccugaggacuugcgagccgcucagcucccgggacguuuggugcgucuucuaagggcgugggcgaguuuacgcgggccaguuguugcuggucgcauggguaacgaagaaaguucggcuaggcaagcucagugauuuuuaacucuguuggacucgauuugggagccgaaugccuauuucauucuuuugugggcugagacuggggguuugagaaaguggacgggggccaagguauucaucucacaguugguagcaggaugagagacgagaagucuugcggugcaggagaaaccaagucaggcaggcaggagacgcagcaguaggaucucguuugcaggagcccuguuucuuacacgcuuucuacuccaggagcugcugcuaaauaauuucugcucagccaugucgccggcuccagaugcagccccggcuccugcgucgaucucccuguuugaccucagcgcggaugcuccggucuuucagggccugagccuggugagccacgcgccug

SEQ ID NO: 12754 - RNA, 10987 nt, Homo sapiens
caggcgcguggcucaccaggcucaggcccugaaagaccggagcauccgcgcugaggucaaacagggagaucgacgcaggagccggggcugcaucuggagccggcgacauggcugagcagaaauuauuuagcagcagcuccuggaguagaaagcguguaagaaacagggcuccugcaaacgagauccuacugcugcgucuccugccugccugacuugguuucuccugcaccgcaagacuucucgucucucauccugcuaccaacugugagaugaauaccuuggcccccguccacuuucucaaacccccagucucagcccacaaaagaaugaaauaggcauucggcucccaaaucgaguccaacagaguuaaaaaucacugagcuugccuagccgaacuuucuucguuacccaugcgaccagcaacaacuggcccgcguaaacucgcccacgcccuuagaagacgcaccaaacgucccgggagcugagcggcucgcaaguccucaggucgauugccggauuucugcaacacaacaauccccgucacuacggagcagcgaagaggacaaccggcggcguccgcaccugagccccgccccacguagagcacacuauugggccgcugacuguccaagacccgccucgagacuuuagucccgucccugaagccgagaauuggccguugugucuccgccccccgugcuuauuggccagccuggcugcgggugacagugaguggcagacacccggccuagcgccgcgggucgcgccgagccgagccgagccgagcggagccggcggagccucuggaaucacccgggucgcuguuccugagguaagacgugagaccgguuauuggaaucccaggccccgugucuggccuugcccaggggugccugcggagcccuaagugagcucgcggcggguaacggaggaaggggcgccgccggcggggcgggggcgcgcagccggaauguuuugauugcuggcgcgcgcagacgggggcgcgcgcgggcgccggggccgcgcgcgagguuguccgcuguugggagcugccagcccuuggccuggggccgggcgacccuggggcgagguggacuccgguccacggucgccgcggcuggguguggggaggcaagccaacccacccgggcuaucagcuguaaggcugacucgaucccugcaacauccgcaggaaccccugagcccaggcccagccggccggggcuccacgggcccugguccacacugacccugugaguggugacuucccugaggggcagggcucucacuagcccagggaaucccaccggggccaggcugggccaagauccacggcccccaggggcugcacggacaggugaguaccaccucgaccaugccuggcuuacaggaccuagggaacccacaaauucaccuaggaucgggggucuacacugacccagucaagguuucccauccagaagguuugcucaccggcuggaucuuuggugcuagggaaguaagagaagggguugaccagaaagguccucuucaggaaagacucuugagguuuuguggacccugagaaguaugucauuucugaggcuaagguagggcaauggagaaauaguccagaggcgccccuggccucaggucuguacccacucauucuccauggggucccuaaguuacuucuugagacccuggaguuggaagaguggcccgguuuagcacagccagaggaagugcucguaguccugggcuggaagggugcuucuuccccacugcagccuuccugccccaugcuuggccuccucuuggugggguguggauggcugggaggguuggguuccuuuuuauccccacugcccacucucuggggccugacaucuucuccuccagcagcugcagagcaucgagggcuggagaggagcacauacuguccauggagcugguagggccaugugcuuuucucaaacauuuguuugugaagugcuuccaaacuguuagucucuugggagaccaggguucccaggaugggcgggggagggacucuucuguccguuaaauagaagaugaaacagcccccaacaaagggacagauucuggcuuugggccaggaaagcagcaguagacacccagacuggccagaguuaaggcucccccagcccugagcuuacugccuuucuugugucacuacuccucugccucugagccaaggaggcugguaguggacaaagcccaaggguacuuucuccuuuuggcaguaggcagggcagcccaugggcagcagcuggaacugaaucagggucucuucuuccuccuuauuggcagguggucaagguggacagggggcgguggugauggcgcaguuugacacugaauaccagcgccuagaggccuccuauagugauucacccccaggggaggaggaccuguuggugcacgucgccgaggggagcaagugugaguucuuggauaugacagccauagggagaguugauggaagaacauggagagagcaaggggcuuguguucucccagggcucugacaucucuguuccuaucccacagcaccuuggcaccauauugaaaaccuugaccucuucuucucucgaauauccuuuguguuucugaguuggagcucugggaccuuuaaugucucucuaagccggggcucuggugggagguggggguagguuugacucuaauaccuggaaacgggaauggagcucauccugaggcugaaagaggcuggugaaaucaucguuaaguaaugauagcccacauuuaccaagaucugugugccuguguccacuuugugguguuaauuuguagaagccuuucuaagggugagccuccuuuuuuuuuuguuugagauggagucugucucuguugcugcuagaguccaggggcgaucucaacacacugcaaccuccaccuccuggguucaagagauucuccugccucagucucccacguagcugggauuacaggcaccugccacgaugcccagcuauuuuuuguauuuuucauagagacaggguuucaccauguggcaaggcuggucucgaacuccugaccucaagugauccaccugccuugcccucccaaaguguuaggauuacaggcgugagccaccacacccagccgagccuccuuuuugaugggauguaaauaaucguaauaaguaacgucuuuugacucauucugugucagcucuguguuaaaugcuuuacaugcauuaucuuagaccuaauacuccuaugagacaaguguuauuuauuccuaauguaccaccauggacagacaaaaguuuagacagguuaaguaacuugguaaagucacacagcuagaaagucacagagccaggacuuaagcuugaguguguugacaccaaagucugugcucuuaccugcuuucuuuacugacuacuuuuucuuaacaauuacacguuuauaaucugcaccagaagaauggcuucacauguaugcucaucggggagaucuuugagcucauguaaguauaagaagggacagaugauguggugaaagaauacaucuuagucuuuccucuccuugcacucacacuuggcccaaccugccaguacaacucaguccuaggcuaaaacuccguaaaccuuuguaguucagggacuggguguggcaccaaaacuuacagcuucaccuuucuuuuuuuuugagauggagugagucucacucugucgcccaggcaggagugcaguggucuuggcucggugcaaccucugccucccagguucaagugauucuccugccucagccuccuuaguagcugggacuacaggcaugugccaccaugcccggcuaauuuuuuuuguauuuuuaguagagaugggauuucaccaaguuggccaggcuggucucgaacuccugaccucggguuaucugcccgccucaaccucccgaagugccgggauuauaggcaugagccaccacgcccggccaagcuuucuuacaagaaaagcuuuccaagccuuaucucuuccaugaaaagaacccaagccuugguugggcacggcagcucacaccuguaaucccagcacuuuaggaggcucuaaaaauacaaaaauuagcugggugugguggcacacgccuguaaucccagcuacuugggaggcugaggcacaagaaucgcuucaaccugggagguggagguugcagugagccgagauugugccgcugcacuccagccuggcugacagagugagacucucucaaaaaaaaaaagaaugcaggccuugaccuugaucaucucaacgcuccaauggaacguacauuguucagucaggaggucucagagaugccagccacagagaaaagccucuguucugccuugccuguuccauggccugcuccuaggcagagagccuccugggagagagaagccauauagcauugccgaaggggaagggguuaggaagcccucccucaaucagaaaacucccccaagggcuuuuaacuacaaccucaaaaggaaaucagagacuggagaucagagacccacaggaugaaaccuucgagaguccaguagugguggcugagguuaccaugaggugaggaaaguaggcugcagcuguggcagcugaggcuaagagcaaagagugggccugagacaguccuguggggcugaggagcagagagggcccacugggaguucuccaggcccuuccaguucccagucuuguucugccaccuccagacucuccucuucccacuggguuucacuggagccucucuggcucucagacugcaccccuucuucccaacuccccaggcaguuccucuuugugguugccuucacuaccuuccuggucagcugcguggacuaugacauccuauuugccaacaagauggugaaccacagucuucacccuacugaacccgucaaggucacucugccagacgccuuuuugccugcucaagucuguagugccagguaagggcugcaagucaagaggacaccauagccuugaguucugcuagcagguggguaauagaguggagucugaggcagcaacucauacuccagaacugacucaggcuuggucuagcaaaaauacuucaggauagcagcgucucugccaagacuccuuccucgagggccaccucuccuccccuucuuuuuccccaccaggauucaggaaaauggcucccuuaucaccauccuggucauugcuggugucuucuggauccaccggcuuaucaaguucaucuauaacauuugcugcuacugggagauccacuccuucuaccugcacgcucugcgcaucccuaugguaagacugggaaguugggcaguuagcccauagucuaagacguauugggagguguggguguauuccugggcaucaguuauccuuaucugucauugacaaaucaggaacugucucuuaagcucacaaccccugaaucucacuucuaauauagggcaaaggggucgaggcaacaaccccaccuuccguaccuugucucuuccccaccccaccccgcagucugcccuuccguauugcacguggcaagaagugcaggcccggaucgugcagacgcagaaggagcaccagaucugcauccacaaacgugagcugacagaacuggacaucuaccaccgcauccuccguuuccagaacuacaugguggcacugguuaacaaaucccuccugccucugcgcuuccgccugccuggccucggggaagcugucuucuucacccguggucucaaguacaacuuugagcugauccucuucuggggaccuggcucucuguuucucaaugaauggagccucaaggccgaguacaaacguggggggcaacggcuagagcuggcccagcgccucagcaaccgcauccuguggauuggcaucgcuaacuuccugcugugcccccucauccucauauggcaaauccucuaugccuucuucagcuaugcugaggugcugaagcgggagccgggggcccugggagcacgcugcuggucacucuauggccgcugcuaccuccgccacuucaacgagcuggagcacgagcugcagucccgccucaaccguggcuacaagcccgccuccaaguacaugaauugcuucuugucaccucuuuugacacugcuggccaagaauggagccuucuucgcuggcuccauccuggcugugcuuauugcccucaccauuuaugacgaagauguguuggcuguggaacaugugcugaccaccgucacacuccugggggucaccgugaccgugugcaggugggccagggccacaggcgggagcaagccggcuagcauuccugggaaaggcauacaucucaccaugauccugaucccacuagguccuuuaucccggaccagcacaugguguucugcccugagcagcugcuccgcgugauccucgcucacauccacuacaugccugaccacuggcaggguaaugcccaccgcucgcagacccgggacgaguuugcccagcucuuccaguacaaggcagugaguggaguuggaguuagggccugcuagagacuggcugguagcucgguggugagggcugggcucccuccugcucgcuugugaccuuggucccgcccuuuuagguguucauuuuggaagaguugcugagccccauugucacaccccucauccucaucuucugccugcgcccacgggcccuggagauuauagacuucuuccgaaacuucaccguggaggucguuggugugggagauaccugcuccuuugcucagauggauguucgccagcauggucauccccagguacugggagaggagggagccagguggccugggaugaugcuggaacauacagugucuuugggaaaaccgcaaaaagacaccucuccugagucacacaaaggcaguccuauaccaggggcacacugcuugggagccugggcuggauuucagcccuaauucgcacccuuggccaagcucccuuaagaaaggcacaacacggccaggcgcgguggcucacgucuguaaucccagcacuuugggaggccaaggcggguggaucacgaggucaggagaucgagaccauccuggcuaacacggugaaaccccuucucuacuaaaaauacaaaaaaauuagccaggcgugguagcgggcgccuguagucccagcuacucgggaggcugaggcaggagaauggcgugaaccugggaggcggagcuugcagugagccgagaucacgccacugcaauccagccugggcgacagagcgagacuccaucucaaaaaaaaaaaaaaaaaaggcacaacacaaguaacuggcucagcaugcagugcagccccuccugggucugggggggcaccagugcccugggaaagauugacaguauacuguggucuccguucuccaaggguaaggccuccccacuaacaggaaaggugcaggaaggcuccuggaagagaacagcccugcuuacucugcucuuccuugugcaguggcuaucugcugggcagacagaggccucaguguaccagcaagcugaggauggaaagacagaguugucacucaugcacuuugccaucaccaacccuggcuggcagccaccacgugagagcacagccuuccuaggcuuccucaaggagcagguucagcgggauggagcagcugcuagccucgcccaagggggucugcucccugaaaaugcccucuuuacgucuauccaguccuuacaaucugagucugagguguguuccuggugacugggagaugaugggcagaguggacuucaggagcugggaguugagggaccgggcaugggguggaaggcuuccugcugucucuucaguaugugccacuggggccugagauacagaauacuaggggaccccagagaccuuucucuugccucaagaauucuaccuacccguuucguucauagccccugagccuuaucgcaaaugugguagcuggcucauccugccggggcccuccacugcccagagaccugcagggcuccaggcacagggcugaagucgccucugcccugcgcuccuucuccccgcugcaacccgggcaggcgcccacaggccgggcucacagcaccaugacaggcucugggugaguaaaucggggccaagaugggagggcacggcagcccucagcagcuugugugggucucagagaaguucacagcugcugucugucucuguugggagagacaggguggaugccaggacagccagcuccgggagcagcgugugggaaggacagcugcagagccuggugcugucagaauaugcauccacagagaugagccugcaugcccucuauaugcaccaggugagugcacagcuaaaaaagagaguagaggguuuagaugcggagaagcaagaccgggguuccaaacccuucucugccauuuacuuguucugccaccuccacucccauaucuaccuucuuaauauccuuuuuagcuaagccugcucucauccagggccuucacacacucgcaguuuccccugccuagaauccaguucccugggauauccagauggccuccuccuucuucuugggucucugcagcugccguuucccugagacuuucucugaucacucucaguaaaaggcucccuugcccacccuccugaaucuuccugucuuaguuuucuccauagcauuuagcaccaugugacauaucauguuuuuuccuuauuuauuugcuuauuccauaucuccucuaccaguauauaagccucacaagggcuggcauuucugucuguuuuguucacugcuaucuccccacaccuaaaagagugccuggcacuuagaccgucagucaguuuguuccugaaucaaaugaauagguaaaaugagggccauuacaacacaggcuucuuccggggaucugcugugaauguaaccuguaaagaucagagguauauuacacacuauuaacauaauaggugcucugaggcaaggauucucagggaagggguaaagcgggaacugacugauaccagguuggagggcagcuguuucagauggacauccgucugucccccacuaacgagccccccauuucuccagcuccacaagcagcaggcccaggcugaaccugagcggcauguauggcaccgccgggagagugaugagaguggagaaagcgccccugaugaagggggagagggcgcccgggccccccagucuaucccucgcucugcuagcuaucccugugcagcaccccggccuggagcuccugagaccacugcccugcaugggggcuuccagaggcgcuacgguggcaucacagguauccaguggggguauaggaggaaacagaggcugcagggaagggugguucuuccagggccucucaaggggaggaaagaggucugagagaacaggcccaaagacucaccccccaagcagccccccagcccuguuccucauucuuguguuccuucuaugaguaugcuuacucuuacuugucucuccagauccuggcacagugcccaggguucccucucauuucucucggcugccucuuggagggugggcagaagaugggcagucggcaucaaggcacccugagcccgugcccgaagagggcucggaggaugagcuacccccucaggugcacaagguaagggccccggggccuaggaaaaacugccagaaauaguaacuuccagggugagguaacagcuuuucaggggaaggaagauaugccccacccccacacagagauacuguacccucccuuccaaaacacacuaccccuucuuuucucaacugcucugcagggcuugguuuuuccuuaccuuaccuccccaggaaucaaccuuuccugucccuuuaccucuagguuucuauggggcuagcagguaucaaccagaagcugaagacuaucuccauuaccaacccuuucuccccacagguauagacaaggcugagcaggguuccuguggcccaggauggaggccaccgcugcccugccaucccgucugccugccaugggacggcuccucugaguguucccuggccccacgugugugguguuugugugucugugccuggccaagggaggugccaacacugggcuugccacagccccaggagaggaauuuggggccuaggaaccgagggcacacgggacucuagccucauccccaggacccccuuggcucagaguguggugcuagaaacuggcccccagcccagccccaguacugccaccuuuacaccuaccccugcaaguccccagagggcugcccacgauagaagcugccaagcagggagaaccugugccaacuguggaguggggagguugggccuggacccucaaccccugcaaccuucccuagcccccucaauagaugagcaggucaggcuguggcccuuaccucacccgcaguucucgcccagugcugcagccggcucaccucucuccgcuucuugcacaucacuggccugugugugcugcuugcuccuguucuguucgcuugcucccguuccguucggcuuuugcuuugcguuagggugaagacccuagcguccagcuccccucaacgcuauauuuugacacuaaaaaagaagguuucuaaauuguaggagcaggauggaaauacuuugcugcccuugccaucuuuuaggaugggcccccaggagacugaggucuuccugggcccucauugcugcuuaucguaccccccaucaccugcacaugggacagaccgggcuggagggugaccuuggcugugugcgucccagcaaaagagcucuggcccgcaucucgcugugcccugaagggggaugaagggcgaugccucgcccgaggcuuugggcugcugcacugcaugcugggacugcuccuacucucugucccaccccucacccagcugugguccggcuuugggagaguggugaauugcgcugcccgaacucggagcggagcaggguagggaccguguacagcuugauaacccuuaauaaaaagggaguuugaccaga

SEQ ID NO: 12755 - RNA, 5742 nt, Homo sapiens
ucauucauacauuuaaggaaugucuacugacaagcuguucuaugccaggcacuagggaagugguggggaguggaguugacgugacucuccuuccaguggagagucaagauguccugaaguuugaucugggucccaggaagaacuuucccccaaaguguggacaagggcugggaaagggagggcaucucuugguguccuggugucugggaagacucucuuaacaugcuagucccuucccacccucacucacucaucugcaucccucaaguucacugcgcaaucagcccuaagcucugugucuggcucccagcagaugcggcucugcagaggcuggccgcugugcuggcgggcuaugggguagagcugcgucagcugaccccugagcagcucuccacacuccugacccugcugcagcuacugcccaagggugcaggaagaaauccggguaaguguccaggcagagggagggaccaauaucucccggcuccauggaggccucuugcccugccucgagaccacuuggaguagccuggagaggaagagucaggcuucaggggaaagaguuccuuugagacauagggucauugccagcaaggcagggagcaaggggguaggguggcaagcuuaggaguuagaucaggaaaagacuagaugguggaaguaauggaaaaagcagccaacagagggugugagcagggaaaaggaggcaucgggaaggauggguuggugacaaugagggccuaaaaacgggcauagccaguacuaagaagaagccaguaauugauggguagagaaauaacugaacaaagaauagcuuugagagagauggccaaugguagagggaggaguuaauaaaacaguaaauugggaggaggaagcaaaaaggaaugaggccaggcuuaggaugagaccaguaacagggucuuggucacugacugagaugaagaccacagcaaauguuccaggcucagggucucuggcccuuucucccacuuguguuguguagaccuuggccauggccauuuuuccagacucuuguuuuuccugucucgcaggagggguuguaaauguuggagcugauaucaagaaagugaguccccagcaccuccuugacucauaaucaccccauggcagcacgcccccuugccaaaccuaaauuucaaauucaggaccuagaaucuguauccucccaccccucauuuugggggaaaccaaggcccagagaccgcaaguuauugccuaaggucucccaucaaguugauggcagaacuggagccagaaaacugaauucuuaauucauuccucuuuucacuacaaucauuucagaccaugcucugaggauuccuaggggaggagggaaguuucgagcagagagcccuuccugagcuucuguagcaggaggagcucugcuucuuucuguuucauguguuggauuucuaagacuuuguggcuaaacaaaagucuagaaaccaucgccugccuguuugucuuuuacccucaccccagcuucucuugcugcagggguuuucugucuccagccccauucuguggauuaguacagaccauuuucaaucauucaauccuuuauucauucaugcauccacuuacuugucucagaugcucugguguccucucuguacccagcacugcaguggucccuggggguagaaagugaaaagcagguccugagcuccacuguggagagcuccgaguccaggguaccccuucccccagcacuguccagaggccacaccuccacccucuucugaacagacaauggaggggccgguggagggcagagacacagcagagcuuccagcccgcacaucccccaugccuggacaccccacugccagcccuaccuccagugaaguccagcaggugccaagcccugucuccucugagccucccaaagcugccagacccccugugacaccuguccugcuagagaagaaaagcccacugggccagagccagcccacgguggcaggacagcccucagcccgcccagcagcagaggaauauggcuacaucgucacugaucagaaguaagggcugcauccugggaagcuuucuggucugcuaggauuugggcuggccugccuggccagaagcagagggcagaaauccagacgugcagggacagggaauuggcaggcugcucuguaccccuggaguggccuguuuuaagaaagugacugagaggguugccccacuuuccuuccucugccuucucccaucuccaggccccugagccuggcugcaggagugaagcugcuggagauccuggcugagcaugugcacauguccucaggcagcuucaucaacaucagguggggcuggcaucuugcuagggcaguggccgagaucuagaaagcagcuugagcaaggagguggcuggaggggccugcgggaggaagagcagacaagcucugagcucagggaugcucccagcuguacugaagguacagccacacccagcccguugcuggccccacccagcaucuuccuugccuaagaugccccuguagggcauccccgaucugcuccagccccauccucuaacggggagagggccagagcuggccucuuuuuugaagucugcggucugggguggagaaggcaguaacauagcuccuaucuggcaguguggugggaccagcccucaccuuccgcauccggcacaaugagcagaaccugucuuuggcugaugugacccaacaagcagguaaauaucucugcgaccucaaucccaggcuuggccccagccccacuccuaagaggauauauccaggccuguugcugaugcccccuugaaauguucccagcccacaugggcccugccugcugcuuggcagagcaagacagaggauggagaccacauggggcuggagcaagccugaccuuuguccucccugcagggcuggugaagucugaacuggaagcacagacagggcuccaaaucuugcagacaggagugggacagguaugcgcuaacuggagaaucaguccaaguccccagagggcugauguuguccgcaagagcuggaggcaaaccagaggggagaacuggagccgaaacguguccguaggcacggcuggcuggaggcggccuucgcccaagcagccccuccccgcaguucucuuucucaccagcagauggcguagguguccccucccugcaggaccagcccucuguaguaaaaaggccugagaacuaguugagccgcccuuagucugcuggagcgcagucuccaaauuccaagggaacaccuugcacagaaaggacauuauacucaaaauauguuuuguuuguuugucugagacagaguuucacucuugcuguccaggcuggagugcaguggcucgaucucggcucacugcaaccuccaccugccagguucaagcgauucuccugccucagccucccaaguagcugggauuacaggugccugccaccacacccggcuaaauuuuuuuuuguauuuuuaguagagaugggguuucaccauguuggccaggcuggucucgaacucccgaucucaggugauccgccaaccuuuggccccccaaagugcugagauuacaggugugagccaccacgcccggccuauacucaaaauaccuuugucuucugcauccaacacugaugccucacguucuacaauucaauuccuaggguucucuguccguuuuuaaaugcaaacacuccuggugggggccucuggcacugcacugugguugaguugauccgauggggauugagaaggagaaucugagcccaucuggcuguaccaccauaccccuaaucucccagcuuugccccaggagauguccuaacaggggguguggcaugggaccggggugaggagcagcucugaaaccucccuaugccacugccucccuugauucuagccuuguucccacagagggaggaggcagcugcaguccuuccccaaacugcgcacagcaccucacccaugcgcucagugcugcucacucugguggcccuggcagguguggcugggcugcugguggcucuggcuguggcucugugugugcggcagcaugcgcggcagcaagacaaggagcgccuggcagcccuggggccugagggggcccauggugacacuaccuuugaguaccaggugugcagccccagaagcugauugagcaaaggaaaugcaaggggccugggagucugggucuugcguggacuaagggucggaacugaauggggagugagcccucaucccugggaagguccaguggaggcuggagaagccccagugggagggaguaugguaggggccuuuaugaacgcaugggaauugggagcauacagugccuaagguucuucuuggugcugugcuucuggggcucugggauuccacucugucaugucugagguugacauaagcaccacccaagcaaaacagcccuggaaaggaucagggccaggcagaagaccauaccccagaggagcugaguuccacugaaaaucagucaagggcaagccuaggagcccagaguugaacccagggcccuguugaaaaguuucaggggacucuuggaccucaccugauucuuccuccacaggaccugugccgccagcacauggccacgaaguccuuguucaaccgggcagaggguccaccggagccuucacgggugagcaguguguccucccaguucagcgacgcagcccaggccagccccagcucccacagcagcaccccguccuggugcgaggagccggcccaagccaacauggacaucuccacgggacacaugauucuggucaggacagggccugggcccagagugggugaaggaaugggauggugagagaggccaggcuggcugugugggccagagccagaccguggugcccccacaggcauacauggaggaucaccugcggaaccgggaccgccuugccaaggaguggcaggcccucugugccuaccaagcagagccaaacaccugugccaccgcgcagggggagggcaacaucaaaaagaaccggcauccugacuuccugcccugugagugaacccugcuggcccaccuggcccagcccucucucugcugcgaggucuggagggcuugggguaagggguugggcuucuggcucaggcugaguggcagaggucccgcgaugccaaugaccagagggccaucugggguggggugucgggucugugcagaugaccaugcccgcauaaaacugaagguggagagcagcccuucucggagcgauuacaucaacgccagccccauugugaguggcccugacuccagcccccaccucugccccaucauuauccuggcccuaugcacuccauuuccccguggucaccugccaccccaccaacccccuggagugguggggccugauauccuagcaagggggaacugccagccuucucagacccugacccacuugcucugaccacgccuguccauaguggcauuucccacacuggcucaugguguaucuucccugccuccagauugagcaugacccucggaugccagccuacauagccacgcagggcccgcugucccauaccaucgcagacuucuggcaggugggcucuuaaagggagggcuucgcugggguccuuguggccacgaggucccagggagguuagaguggagcucaacugggucucugucccuagauggugugggagagcggcugcaccgucaucgucaugcugaccccgcugguggagg

SEQ ID NO: 12756 - RNA, 14437 nt, Homo sapiens
cccccgcaggggcggagacgagggcgggccggaggcggaggcgcggccuggagagggauggggcggaagcggggcgggcggugcagccuagcgaggggcggggcggacgaggaagcgugacgagcggcggggcggguggagcagccuggcgaggagcggggcggggugggcggcacggccugacaaggggcggggagcgcaaggaggccugacgaagggcggggcggagcaagggcgggggcagggcgaguagugggguacagcgagggccggagcggaugggggaaaccuggugaggggcgggacaaagcggggagggcggugcagccuggcgagaggcggggcggacgaggaagcuugacgaggggcggggcgggcggugcagcccugcgaggggcagggcgggcggugcuuccuggcgaggggcggggcggggcgggcggugcggccaagcuaggggcggggcaagggcggggcaaggcgggugguggugcccagcgaggggcggagcggacaggguaagcccgccgaggggcggggcugaccgaggugggcggggcggaugccgaggggcggggagaggugggcggggaggccaaacauggggcggggcggcgcggccggggaagcgugaugaaggccuacgagugcggcgcggccugaaggggcacgcgggggaccugcaaagcuagugaggggcggggcaggcggcgcggugggggcgggccgagcccggaggccagaugagcggacacagccccacgcgcggggccaugcagguaaguggcucccgacggccccacuugaauuucgaucccagaccggguccggcgcccuccggggcccaagcuuagcgcggugcugcaguggggccgccugacccaaagcgaaaccgaaagccccgcggagggugaccugacgacuuucccgggacuggaagggggaguccugcgagagacuaggugggugcgagagaggagucagggugcuccuugggguacagggcuuuggcuccgggcuggguacgcgcacgugaugcaggccgccucagaguauggggcccgcuugggaucccggaguuugggagcagaacaggauuuccuagcugggcagggacaugggggcgggacuuagggagucgggcuaaaguucggauuaaggggcgggccuggcucaugauccugggccggcgggcugaagcuuucaacggaguuucagcccuggguuugggucucucgguggggacgggcggaagcagaggucugugccuuagaguggucacuucuggggguggggaugggagaauccucggaaccugggugaaaggucaggggucccagaccuuguaaaagucugagcaucccccuccccuagguggccaugaacgguaaggcccgcaaagaggcggugcagacugcggcuaaggaacuccucaaguucgugaaccggagucccucuccuuuccaugguaagcgguggccagggcaagggaggaggguggaggcugaugcgcccuucaccagcuuccaucgcugugagagggugcuuuucccacagcuguggcugaaugccgcaaccgccuucuccaggcuggcuucagugaacucaaggagacugagaaauggaauauuaagcccgagagcaagguacugggggugggguggggguggaaaggcaggucccuaggcuggucuccaagcccugugugccagcugaguaaugcaacucacaccccugucuuuccuccccuucuccucaguacuucaugaccaggaacuccuccaccaucauagcuuuugcuguagggggccaguacguuccuggcaauggcuucagccucaucggggcccacacggacagccccugccuccggguaaggaacucggacgguguuggggugggaggagaugucagagggaguacagggcaaaagagaacuaggagguacaaacuggggccucuauccccuggaguaagggagaagguaaacuuguuggccccuuccuucacaccuugagccuuucaugugacacuaauauucgcugucuguuacuuaugaguagccaaagucucaucuccacauaucgucaugaagccuucucugacuucuccaucuuuacacucaggugaaacgucggucucgccgcagccaggugggcuuccagcaagucgguguggagaccuaugguggugggaucuggagcaccugguuugaccgugaccugacucuggcuggacgcgucauugucaaggugggaaccgagguuggggauggcggagccuccucagaagacugacugccacacuccucaggguacccguggggaagaggggugggggcagucuggucagaggaccacccugcuuagucugagugaaguaaagacugaccacugggguaggaggcacccugggcugaccuggccuggcuggcugcagugcccuaccucaggucggcuggagcagcagcuggugcacguggagcggcccauucuucgcaucccacaccuggccauccaucugcagcgaaauaucaacgagaacuuugggcccaacacagagaugcaucugugagacuggggcagggcugcgguggcugggagggauggagaaugguaccaggugauuauuaccuaaugguagccauuaggucacauuuuacucuugggacccaguuaauuucuaaggguccucacagccuugugauuuggggagugggcugggaauugaagggcagaggcaguugcccaucaggaggcaccugaacuuauggaugccgcacucagcugugcccuccucgcaauccccccacaacccacgucuccccacagaguccccauucuugccacagccauccaggaggagcuggagaaggggacuccugagccagggccucucaaugcugugguaagagagucuccugaucauggggagggcggcagaguccccugagaaguggggaggagaggaggaauggacucuucccagcaucuuucugcucuucaggaugagcggcaccauucgguccucaugucccugcucugugcccaucuggggcugagccccaaggacauaguggagauggagcucugccuugcagacacccagccuguggugaggacuggcuguaggaaccugugggugaagggccuccaggauccuggccaccccuagcccguccugcugaagcacccaucaccuccaccaagcccucaguaacucucauccccguuuuucccaguagacacaucccccacugcuucuagggcggugguucucaaaaagacaaguucccuaccccagaccugcccacuaggacuaucugggaauuggcccuuuuuacagauucccaaagaguuucuucuacaggugggcccugucugcuuugacccacacugacacugaacugcuuagggaaagaggccuggauguggccaucuguucucugucucccgguugcugauggucagagauugcuaaaucuuuggaugcuguguccugcuugaacacguacuaaguuucuguuuuuuggcugguuuccucuguuuacuucuuuggccuuuuugaugacaauucagcccuuccuuuucuugacccacaggaagaggucaagagcuauuggccuccacccuuuuguuccucagcaccaacccagcccccuucuccaaucucugcuugguccugccuagcaaggaaucccagcacuuugggaggcugaggcggggggaaucacaugaggucaggaguucgagacuagccugaccaccauggugaaacccugucucuaauaaaaauacaaaaauuagcugggccugguggugcaugccuguaaucccagcuacucaggaggcugaggcacgagaauccuuugaacccgggaggcggaaguugcagugagccgagaucgagccauugcacuucagacugggcgacaagagcgaaccuucaucucaaaaaaaagaaaaaacaaaauagugcccuaagccaggggucagggagagguugcgcaagaaaccaaggagacccuugggagcaaaagaaaggugaguggggguggaggguugaaggucgggcugacugucuuaccucucuaggucuuggguggugccuaugaugaguucaucuuugcuccucggcuggacaaucugcacagcugcuucugugcccugcaggugaggagccggggcgccccaggcagcacauaaccaccagcagaggugguauguuuggggucgggggagcugccuaaagccccagcagguugugagagagggccauugucuacccgcucagucugcuggugcuggauggaccaggagggggcccuaaauguugcagccucagcaucgccaccuuuggucucugcccuugcacuaucaggguguugaggcaagaagaaggaggagaaguuguuucaggcaccauggucucuuguccuagccuugcuccugcugcuuuuccugaaguuaacaaccucugccucagggaaaggcuuuaucauccacaaggcaguaucauccaccuccuucugcuuccuacgccacuccccaggcuuaagaccccagccuucucccuguuucuugggaucucagucagguagccucucuuccuagucaccuugauauuccccaccuucucuccacccuagucaguucccuuucuuucucuccucuugcccuugaucucccucugccuuuuucugccuuuccuucccuguaauccuguggcuggagauaggcuuugggcuguaauugagaccagagcuggaccugggaccugcaucuacuucugcaggcaaccagccagucaugucaccuugauggagucugucaccucuuugaaccucagucuuuucccugaggccaaucaguuuaugugauguguguagccuuuuggcuuuccaggacucucagcucuuccucucuguccuccacaucuucuacugccuuuugcaugggaagguagagaacaacacccaaaggauggugucuccugucccaguugaaaagguuucuaccuagcuauugaucuggccaaaaaaaaaaagaaagaaagaaaaaaagagaaaaaaaagguccucaccacaccuuaaagguuucuaccuauguagcuauuuauuuggcaagaaaaaaaagguccccaccacacccucugccaggcagugcccuaauugauaaaagucauggccauggaaggcagacaggggaaugugcacacccaaggugcugguggaugggggagcgugcacacccaaggugcuggugggcugaguuccagcagaagcagguuggagaugaugcucucauuuccuucccugaaccaggccuugauagauuccugugcaggcccuggcucccuggccacagagccucacgugcgcauggucacacucuaugacaacgaagagguacguggaggguucuggggagggucaccucugcggagucuuccacagccaacuuguugugccaggcauccaccgugagccagggcucuucugggggccccaagacaggggagaugcugccugugccuccuuagcacuuggugucuccucugacucaacauagaucugcuuauucgagggugaccgucucuccuguaucucucuuugugccacauggugagcuucuuccuuuaggacagggacucuacccagcccauccucguagccccagggcucagcacagaguagguccucaugaugccugcgugugugaggcugcagucucagcugcauaacagagcuugaacagcuagugcucucucauguaacaacccaggucagaguuagcaguuuaggaggggucccugccguccugaacacaugacuuccauuucaggauucaggguggccguuccagcucuggccaucaugucuacacugaguuaguaggaagggaagagagggcaaaggggcaguagacacccccuggcuuuaagggcaugauccagaagugacauucaucacugcuuacauuccacagaacuuagcugcaggggagccuggaaaugucaucucuagcuggguaguuaagugcuuagcuacaacuuggguguucuaaaagauaucauggacaguuagcagucucugucauacacauaaaagaaaauugaccagugugguggggcaccugugcugagccccagaugugagggucacgagaggaggaaggggagcagugcaggaaacccaccaguacuguuaagaaugugaguuaguuuggucucagcccacugucugguguucagugacgaccccagguuagggguguugcuaagaacacccagugacucagugggguuuugggccaguugggcaaugggccccucucacuggcuuccaagaucaggccccuaagcccagauucccagagucaggacucuacugucgccagguggggucugagagugcacagggagcacagucacugcugacagagcuggugcugcggcggaucucagccucgugccagcacccgacagccuucgaggaagccauacccaaguccuucaugaucagcgcagacauggcccaugcugugcaucccaacuaccugugagucucuagugccagucacacagucuucacauagcuggagacccaagcauaaccugccuugaggcucugccuuggccccagccucuuccuuucucccuucuucauucugccgggagguucacgggcacuuccuuuucacuacugcgagaccaacuuggucaaagucaugcaaugccuaacccagguguguggaauacaccuuugucuacaaacuuguuuccaucuauugcuagaggcugcccggaacccuguguguggaaugacucugaagucccacugggcugggcgggaaagaguggugaucuauuagugaugucugccaugggaggguggugagugucgacaggccugcuccuguuugcuaugucuggcccuuaucugucucuuacagggacaagcaugaggagaaccaccggccuuuauuccacaaggugagacgugccauuucucccuagggacuuggaggucuggcuguuccgagcgccgacucauucccuuugggccugucauuaccucugccucaccuugacucuccccagggccccgugaucaaggugaacagcaagcaacgcuaugcuucaaacgcggugucagaggcccugauccgagagguggccaacaaagucaaggucccccugcaggugagggugggcccugccugggaaggugugauggagggagcuuggugggggcacaaacagaugggccccccaugaacagggaaccugguagauggccuugaguggaggggggucccaguagagugagaaaagcagggauuuuggauacagcuggauuccaugcuggcucugcugcagugcuagcugugugaccuuggacuagucuccuaaccuuucugagucucaguuuccacaucuguagaauaggggugauagugaugccuacuuugcuggauuucuaugaagacugaagguacagugugcuccuggcacaugguaggccugucuuucccugcagcacccccacuuccccugugucuccuacacacccugggggcuuccacagggaaaguucagggcuggggaguauggaacuccaacuacucauuuucucucuugccugagaaauuagacaucuaguccuuucuccucaguguguguguguguguguguacauauauauguuguauacauguauguauauaacacaugacaguauuguguauacacauauacacacauauauacugucaugcauugcuuaacaacagggauacauucugggaaauggcaucauuaggcaauuuugucauugugugagcaucauggaguauauguacacaaaccuagacggacagccugcugcacaccuagguugugugguguagcccauugcuccuaggcuacaaaccuguacggcuucuuacugugcugaaaacuguagguaacuguaacaaaauggucaguguaucuaaacauagaaaagguacagaaggccaggcguguuggcucacaccuguaaucccagcauuuugggaggccaagacaggcagaucacuugaggucaggaguucaaaaccagccuggccaacauggugaaaccccauccuaccaaaaaauacaaaaauuaggcaggcggaguggugcaugccuguagucccagcuacuugggaggccuucccuacuugggaaggaucucuugagcccgggagguggacguugcagugagccgagaucgugccauugcacuccagccugggcgacagagugagacccugucuccaaaaaaacaaaaccaaaaaaaaaaaaaaaagaaaagaaaaagaaaaguuacaggaagcauaugguauaaaagauuuaaaaugguccaccuguauagggcacuuaggaauggagcuuacggcacucgaaguugcccugggugaguggugaguuaaugugaaggccuaggacauuacuguacacuauugcagacuuuaucaaugccggacacuuaggcuacacuacauuuauuuugaaaauuguauuucuucaacaauaaauuaguuuacuguaacuuuuuaacuuuauuuauuuauuuauuuauuuauuuauuuuugagauggagucucacucugucacccaggcuggagugcaguggcacgaucucggcucacugcaaccucugccucccagguucaagcgauucugccucagccuccugaauagcugggauuacaggcacgcaccaccaugccuggcuaauuuuuguauuuuuaguagagacgggguuucaccauguuggucaggcuggucucgaacuccugaccuugugauccgcccgccucggccucccaaaguguugggauuacaggugugagccacugcacccggccaacuuuuuuacuuuauaaccuuccauuuuuaaaauuuuugacuccuuuguaacaacaguuggcuuaaaacacaaacacauaguacagcuauucaaaaguauuuucuuuuuuguauccuuauucuguaagcuuuuuucuauuuuuaaaauuuuucguuauuuuuaaaauuuuuaaacuuuuugguuaaaaaccaagacacaaacauacacauuagccuaggccuauacagggucaggauuaucaaugucccugucuuccaccuccacaucuugucucacuggaaggucuucagggagagugacaugcagggagcugcuaucuaccaugauaacaaugugcuccuaaaggaccugccugaggcuguuuuacaguuaacuuuuuuuuuuuuuucuaauaaguaggaguacauucuaaaauaacaguaggcugggcaucguggcucaugccuguaaucccagcacuuugggaggccgaggcggguggaucacuugaggucaggaguucaaaaccagcuggccaacauggugaaaccccgucucuacugaaaauacaaaaauuaucugggcaugguggugugcgccuguaaucccagcuacucaggaggcugagacaggagaaucgcuugaacccaagaggcagagguugcagggagccaagauggugccauugcacuccagccugggcgacaagagugaaacuccaucucaaaauaaauaaauaacaauaaaaagcauaauauaguaaacacauaaaccauaacauagucauuuauuauucuuagguauugcauacuguacauaauugcacguguuaugcuuuuauacgacuggcaguagauuuauuuacgccggcaucgccacaaacaagugagucaugcauuaugccacaacaucgcaacagcugugaugucacuaggcgacaggaauuuuucagcuccauuauaaucuuacgggaccacugucauauguagucuaucuuugacugaaaugucaccauguagugcaugacugucuauuucuauauuuaucugucuaccucucuauaucagggacucaggcaugggcgguccagugacaaucauagcagguguagaaccgugguauccugacucccagcccagggcucuuucugcugcacaguguucacucuuccuuucggaaagcugaauuguucugcccccaggaagccuucucugaggacgugauauuugagcugagaccuaaccacugagaaauaggcagcuaugggagggucccagccagagggcacaaguagaaaggccccaaggggggccaggaaugagcucgucuuuuaggaggagagaaaggcaggaugguagagccaggaugagagcaggagaggguuaggggagaggcccagcucagugaugauacaggaauaccuaggccauggaaggacauuucaauuuuauucuaaggcagugagaagacauugggagauuuuucuuuaauaauuuacagcagaaguaggacacauguauuuuagaaaauuagaaaauacagauagagaugagaaaauaaaacacuaaucugcagaaauuugguauagucuuccagauuuuuuucuaugcauaaacuucauauacacuuuuuuaaaaugauauuauauuggauauauuuuuguugccucuuuucacucagucaucuucaccuuucuauuugaguuugguuuuuuuuuuuaauguuuuuuuaaaauuagaaacagggucuugcuuugucucccaggcuggagugcaguggcaugaucauagcucacugcacccucaaacuccugagcucagaagaucuuccugccucagucucccaaguagcugggacuacagaugcaugccaccaugcuggcuaauuuucuauuuuuaguaaaaaugggguucuugcuauguugcccaggcuggucuugaacuccuggcuucaagcaguccucccaccuuggccucccaaagugcuaggauuacaggcaugagccaccauucccaaccccauuucaggaaauuguuguuucaguaaacuuguaccucaucuaaugcacagaucacuuuccguuuuccccaguuauccucaaaauauuuuuuuuacagguauuuggcccacccuaguauccaacucaggacaaugcguuauauuuggcugauauguugcuuaaaugucuuccaguguagcacaguuccccccaccccuuuuuaaauagcauuggcuuauucaagaaacuucuggauaugucuccuugcugccccauggugucauuuagcuugucuguaagccccguauuuccuaucaacuggaauuucuaaagacuugauggauucaaguuaaacuuuuuuuuuuuuuuuuuuuuuuuuuuuugacagagugagaguuucacucugucgcccaggcuggagucuaauggcgugaucucggcucauugcaaccuccgccucccugguucaagugauccuucugucucagccuccaaaguagcugggauuacaagugugcaccacgaugcccagcuaauuuuuguauuuuuaguagagacaggguuucaccauauuggccagacuggucuugaacuccugaccucaagugguccgcccaccucagccucccaaagugcugggauuacaggugugagccaccgugccuagccucaaguuaaacauuuugggcuagaagacauggcugguguauucauauggcaucacacacaugauaucugggugggccacccuuagccuugcaaagauugaccacuggaccaggaauggccucuuauccuuucauuauauagugcuuuuccccuauugaccugacagugacccauacaagugaugaguucccuauuaaccagauaccuaaugguuuuaacacuuacaauaauccuugucuaaaucaguaauuucauuagaauuuaccgaaaaaugcccgcuuccccugaauucuuucagucuuccauucuucugugaaguggaacuucuucccuccaaucaacuaggguucuuugguuaucauggaauaucauuccuauugauuggaaagcaggauaaaugcuaauucuuucuguuauccacuuuucaaggugaaaugucgucucaaauagugacaaagaaagauuuuuccuuuuccuuuuuuuuucuuuuucuuuuuuuuuuuuuagacagggucucgcucuguugcccaggcuggaguguagugucgcaaucucagcucacugcaaccuccuccccacaggugcaagagagucucauaccucagccaccugaguagcugggauuacaggcaugcaccaccaugcccggcuguuucuuguauuuuuaauagauacaggguuucaccauguuggccaggcuggucuugaacuccuggaaucaugugaucugcacaccuuggccucccaaagugcugggauuacaggcgugagccagcacaccuggccugcuuuucccuuucugacuaucuuagaaucauggaauuucauuuauucaguguccucuauaauuauuauauuugauuugugaauugccauggcuuugaccagugggagccccuucagcauaacuccugugcccuuugacucuuggaagucuccuugcuuuuuggcacaacaaaaauuguagacaugucuuguucauuucgccccccagacuugguaguuuuuggcaagcagugguauuagagaccauagccuggcacugcaaguguucauuguucuugggggaggggacggugcuuuggguccauuuccauggacauagcaagaaaaaaguacauauuuuaaaaaucaugaagccaggugugguagcucaggccuguaaucccagcacuuugagagguaguggaucacuugaagucagaaguucgagaacagccuggccaauauggcaaaaucucgucucuacugaaaauacaauaauuagcugaacgugguggugcgugccuguaaucccagcuacuugggaggcugagacaggagaaucgcuugaacccaggaggcagagguugcagcgagcugagauugcgccacugcacuccagccugggcaucgcagggagacuccaucucaaaauaaauaaauaaaauaaaauaaaaauuuuuaaauaaaaaucaugaguuaauacuguaauucuuauucauaaaauuauucuuauuuaguuaaauaguuacuaccuauuugauuuuguaauucuguuuucucuuacacugaaaaccuugauaucuagcaucauauuuucauuuucuuauuuuuuuaccauaauauaaagaaaaucauuucaaaaugucaguagcaauauuuuuaaagacacugauaccacugagugauuuuuuucugugaguguggauauuaagcaagagggugacaaggauggauacuuuuaaaaaucccccuuccugcuguguggagaauggauuggaacuagggugguggcaaugcagauagaaugggaccaauucagaauauauuguccuuuggggucugccauuuagcauuggcuuugauuuuaugcuccgaauggaccaucucccaggccccuucccacccugcaauucuaagauggcguccuccuuggcucugauaagcacacacugcauguugcucaugggucuccugcucucccuaggaucucaugguccggaaugacacccccuguggaaccaccauuggaccuaucuuggcuucucggcuggggcugcgggugcuggauuuaggcagcccccaacuggccaugcacucuauccgggagauggccugcaccacaggaguccuccagacccucacccucuucaagguaacacccaccccagacccucucuggcagcugggcugcuuccccucuagugccuggauugguugcugggacaacaucgccaucacaaagugacuggccugaguaaugggggcugguugucaugcuggggccauguaggaaaacaaggguccuggccaaccacaguggcucaugcuauaaugacaacacuuggggaggugggaggauugcuugaggccaggaguuugagaccagccugagcaacauggcaaguccaugucucuacaaaagagaaaaaagagauaaaacaacgguccuuauucuucucaaggcucaggggcccugacccaaagaaauggaaaaugaggggaugggaagaggggaucagggcugagaagacugggguggcugucaagaacagaugaaaccucggugcuucucuugcuggaacauauguuggugggagguggguggcaggacaucuccaucuggucacucacuaauuccaaacuccauguugccucccauuauagggcuucuuugagcuguucccuucucuaagccauaaucucuuaguggauugagcccucuuggaaagacuucucugccaucccuuugcaccugagaggggaaguucucagcugagcugaagcuggauuauuaaaguggauugucacucagacucuccgugcuacgcuuauuuggagacuagaggagugggaguugagccuggcuugaaccuuuggaaccagaaaaguuggggagcagguggagg

SEQ ID NO: 12757 - RNA, 7023 nt, Homo sapiens
aauggaaagaucuguucugugcuucgauaagaagguucaauacucugaagagaagucaauucauuuuccauucaucuauaauuucaaugccaugcaaucucaauuaaaauaccaaauaaaaauuuuaagagaauuggagaagaugggaggggaguguaagacguaugaaaaaaauuaggaggcugggcacagugacuccaccuguaaucccagcacuuuuggaggcugaggugggaggaucucuugagcccaggaguuugagaccagcuugggcaauguaacgagacccugacucuacaaaaaauaaaaaauuagccuggcauggugguaugagccuguaguuccagcuacuugggaggcuguggugggaggauagcuugagcccaggaggucgaggcuucagugagcugagauuguaccacuaacuccagccugggugacagagugagacucugucucaaaaaaagaaaaaggaaaaaaauuaggaaaucauagaaagaacaucaaaauauauuagaaggcuaugauaauuaacagauuuguuaaugaagaggaaauauacaaauauuaaugaacaaaauaguguguuuagaacaagacucacauacaggagacauacacauguuaaaggaggcauuuugaauuuguggggaaaacuuaaugauucaguauaggguuuggagcacuuugauagcuaagaggugggguagggggcagagugaaggcugucucucuuuuacuccuucuaaaaauauuccaguggaucaaagauguaggaaacgauggauccauguaggccucagccuucaaguuucuccucugagauuucagggauuauccuuuaaaggagucaggaagaggguagagaucacaaagauaauaagcucagacaguuuguauguuaaauaaaccucaggagguuuuagucuuaagguccuuaaucugaccuuccaaacugacuuuuccagaaacuuccaaaagccucucuggugucucuuucuuccccuccuuuaauguggcccuggcucacaagucaccccucucucuaagaaguccccuucucuguuuuauucuucagcuuugccccaggaggaccugggguguagccccauguccccucccucugccacuggugacucauggucauuucauuccccucaguccucaaauagggugaacccuacaggccccagaacuaccccagucaaccuguagagaaacuccacaaugacccucacaggaaaugaaauugaaagucccauuuccaaugucuuuguacugggauggaggaggagggauggguaaggggcuucuuauccuugagucuguugggggcccuggagucugagccagcuucucuguguuggaaacaccuggacagggcugggcucagguggauuagaggggguguguauaucugugaguaguuucuggaauccuucuuuccccugaaugaguuaugugcacuuaucugucccacaaaggauaaagggacacauggguuaggggagguuuuggaggcaguuccccucccaccccccagcccaccaaaugcuuagguauagacuagucacuaagguggaaggaauguaggaaucucaggcucucagagucagaccucagaaggcucccaggcaaugauccuugaggugcagaaacccccuucucagcccugccccacauccuucaugagcauuccucaaacucugccugaaugucuccagagcccgagaacucaccgcuucuuugguggccccuuccagcuggggacaguucugaaauaaagcucuuccuucucagcacaccugucuccugugacugcuacccacuuguccccagagaagaaagaaggcccagagccacccucuaucccccagguggggaaggauucuuugagcacagccugccuggaacuagaaauucugguucuaaucuuugccucucuucauaagagcugagcugugaccaagggaacccagagaaugggcaaauacaaaccaaaacagauuuggguuuccaccggcugcaguggcucacaucuauaaucccagcacuuugggaggccaaggugggaggaucacuugagcccaggaguuugagaccagccugggaaacugcaagacccgaucucuacaaaacaaaacaaaaacccaacaacaggggcggggcacgguggcucacaccuguaaucccagcacuuugggaggcugaggcguguggaucacaaggucaggaguucaagaccagccuggcuaacacagugaaaccccucucuacugaaaauacaaaaaaaaaaaaaaaaaaaaauuagccgggcgugguggugggugccuguagucccagcuacucaggaggcugaggcaggagaauggcaugaacccgggaggcggagcuugcagugagccgagaucgcgccacugcacuccagccugggcaacagagggagacucugucucaaaaaaaaaaaaaaaaaaaacaccuccacggcaaagccucuuccugcuccuugggcucuggggucuuaaccuucaagacucugaacaucaagaaguaacagggcucauagaaugcugaucggcuucccaccggacccaaaggaucaggcccagaccagcucugaccccagcagacaggguguaauggaagggaucauggaggcaggcaccauaugccaggacugauggaucagcagacauuuuccugccugucuguccacuccagguauauuuucacccccgucccuugaggccccuguccuauucuacucauucacccccucccuccuuccucucaccacaagcucacccaaggcacaucugcaaaugcuucaauaaccuucgauuuaacaccuaaaacgucagcuaccuaaggguagaauuuuaauccauuuuauucacuauuguaucccaagugcccagaagaaugccuggaagaauaguagguacucauuaaauauuuaaauacuuaaugaaugaauaccuacugcgcacuuuuacuuacuuuucucuaaauuaaauauucaccaggaagggcugauggcccccacuuuauucacugauucaaugaacacuuacugagauuuuucccaugugccaggcaugugguacaucauuauggcuuaagaagugcccaguggcaccuccagagagguagggugaccugcaaaggucacacagcagucuguagcaaaggaggacugggcuccaggcucccuggccucuggagcucagaucucuuuccaugacaccagaggcuugugaucgcaagacagggcagacuggcagcacacacacccagcuaggcgccaggcugcagggcacuguggggcccaugcugagggacagacgagugacuugcagccagcugucccaagugccuggccuggccuggccagagccugacggcuuccagcugucacagcuagugugggcuccucccagaagagggcaccagugacuugcauggacuugugcccucccuacccaggcccacagacuccugcacgcaaaucaacgaaugccccaauuauggaucuaggaaggcagaaggcaagucauguuccaggcucugugccaggcccuuuuaaauaguuaaucuucauuugaauauuuaauauaauaauuuaaugucauuacuacaacguaagucagaucauguaauucuucugcucaaagcccuaagaugacuucucauuucaccaggaacaaaagcgccauggccugcaaaauucuaggccaucuggcuucugcugccugucugacccauuuccuuccacucuccccuugcucccuccauccucucuggccuucgucuuggagcccaccaggcauauucccaccucugccagaagcagcccuccccagacauuugcaucauuugcuuucuuacucaagauuggcucaaauguucccaguggggccaacuccagccacacccuauuugaaagugcaaucucccaccacacucacauuugccuuaagcuuuguccacagugcuuaccuccuuguaacaaucuuuacagguucuuucuuuuccuuccuuccuuccuuccuuccuuccuuccuuccuuccuuccuuccuuccuuccuuccuuucucuuucuuaucuuucuuucuuauugagauggagucucacucuguugcccagguuggagugcaguggugccaucucggcucacugcaaccucugccacccggguucaagcaauucuccugcuuuagccucccaaguagcugagauuacaggugugugccaccaggccuggcuaauuuuuguauuuuuaguagagaugagguuucaccauguuggccaggcuggucuugaacuucugaccucaggugauccuccugccucagccucccaaagugcugggauuacaggcgugagccaccgugcgcagccuauuucuuuguauuuguuguucaucucucuucucaaguaaaagcagcaugggagcagaaaucuuugucuguucacugcuauaucccuagucccuagcacagugccaguacauaguagaaacucaaaaauauuuguggaugaauaaauaaaaaaauuauggaugaauaaauaauuaaaacccugaguugugcuaccuccauucuauagaugaggaaaccgaggcuuagagaugcuagguaacuugcuugagaucgcaucguucauuuauucaaccaacuuacuaaccagccaacauuuacagucuacccacugcauuccacacacauuuagaggcacaguguuggguggcuuuggguuauuuguuuuucgaaauacucucuauuccuuuuuucuugauguaccaucuguuugcaaugacuucccccauauugucaccuucuagaauucaauuuacacuuuagaauucgauucaucaucagugguugccagagguugguggagggggucuaugguagagucuaugacuccgaaggggguacaugagcuaguauuuggggugauggaauuguuugcucuguaugguccuggaguggcagauacaugauucuaugcauuugucaaaacccagagaacugcaccucauaaaaaaauaaacuuuaggccaggcacgguggcucacaccuguaaucccagugcuuuaggaggcugaggcaggcagaucaccugaggucgggaguucgagaccagcccgaccaaaauggagaaaccccgucucuacuaaaaauacaaaauuagcugggugugguggugcaugccuguaaucccagcuacucgggaggcugaggcaggagaauugcucgaacccgggaggaggagguuguggugagccgagaucacaccauugcacuccggccugggcaacaagagugaaacuccgucucaaaaaaaaaaaaaacuuuaauguaugcaaacuguaaaaaaaauuauuccucaagguucuuaaccucuauggauguaauucaguguuuaaaugguuccuccuauaccuuuuacacacugucucucgcgcucucucucuuucucuuugacuucaguaucccagaaugaggauggggaagaggaggcaaggguaagaguaacauucucugccucugaauacucauggcuccucucagcccuuccuggguuucaucccucagggcucaaggucaggccugggucuccuacuuggacuucuuaaaaaauuuuuuacuuuaugauaacuguagauucacaggcaauuauaagaaauaaugcagagagauccugaauuaccuucacuugguuuccuccuaggguaacaucuuguaugacuauaguacagcaucacaaccaggaaaggggcauugguauaauccaccuaccuucugcaaguuuuaccaguguuacauguacuguuaguguugcguacaagugcaaaugcacauuuaguucuaugcaacuuuaucacuuguguagauccacauaaccaccaccauuaccacugucaagauacagaacuguucuguuuuuguuuuguuuuguuuuuugagacagagucucacucuguugcccaggcugcagugcaguggugccaucuaggcucacugcaaccuccaccucccagguucaagcgauucuccugccucagccuccugaguagcugggacuacaggcaugagccacuacaccuggcuaauuuuuuguauuuuuaguagagacagguuucaccauguuggccaggcugguguugaauuccugaguucaagugauccacccaccucggccucccaaagugcuggaauuacagguguuagccaccgcgcccagccaagauacagaacuguucuaucacaaaggucucaucuggacucuugauguuucucaacgugcaacacuuaggcacaucagaaucaguugagucauuuguuaaaugugcagauuccucccagcucagcugcugaaccaguguggggcaaggaggcugggaaucuggccuuuacuugaacuggccgucauuucuauccauccuccacuuuguggccgccaagaggauccuccuaagacacagcucccaccguguuuuuucugccgcuuaaagcuguguaguggcgcccccugcuuucaggguagagaaaccaaagccuuagcaaacaaagccuucuccaggccccaccucccuucuuccacucaccccacccacuacgcuucaaucccuccaaaccucucuaauucccaggacgccuuuguuuucaucaggcucauuuuguucaugccguucccucugccuggaauguccugcccacucuuuucugccuauugcaacccuauuccaccacccauucuuacagaugaggacuuggagguugagagagguuuggugucacccagcaaguaagggcagggcgcaguggaggccccaauccaccugacucccaggcuccuggucuuacuguucgccagcuguaauggaggcgcugggggaggccauggucccucuucggagcugucugcucaccuccacuugggccugccuccccauccaccucucaggcaucucaccaggaccguuccucuucuuccccucccagcgaagccgggcag

SEQ ID NO: 12758 - RNA, 101 nt, Homo sapiens
ggcagagcagggugacaaaggcucagaagaguguagagagagcuuggccaguggcaggugcagggucucuggcugccgccagggcuccgugauggagcaac

SEQ ID NO: 12759 - RNA, 8139 nt, Homo sapiens
aguucucgcgacuugcgagaagacacgugcgcggaaggagcuugcaguagcgggcggcagagcuggagugaagggagcuagugguaaagggagcugguggagggguggcggcagggguaaggggcaggggacacccucuagacggagagcgggcuccgagguccuggcuggcccucggugcgcccgccccuguguuggucccacaaucccuggcaaugagaggccaggguuuauuggacagagucaguugugggguucagagggucagcaaucaaucaauccuccgaauccagagauuuagacccagucguccguauuaggacuggaggggggucaauagguucaguguuugagaugccaagggaaccugucuuuugauuugggguucaacauacagagguuaguuuuaggauucauguuuagcauauagaggauuuuugcugggauuagggguucuucaaauucagaucaguguuaguucaguacuuggggauuacguucaggauuuaaguuaaauaucugaggcucacucaggguuugcuguccaauauucaggguucacuauugggguucagggcuuaauaucuagaaugaagacgcaacacuuugggaauuugaggcuucaguauuuugagguuugggucugagaagggagucucugccagguuucugaauuugcagaauuuguucauggccagagggaagucuuuuagagaucaaauuguggggugugaauuucagaauuugggaggaaucacugugagguuugaaggccgacuggaaucuggguugggauuugagaugugugggauuugugagguucuguccaggcagggacuauauugagcuuuggguuuacaucuugggggagggcuaagugcugcuauuugggguuugggguuugguuggggugugagaucugagcuugauuucucugcugggauuugagaugugugggauuugugagguguuggguccaggcagagacuauauugagcuuuggguuuacaucuugggagagggcuaaguguugcuauuuggguuuuggggcuugguugggguaggagaucugagcuugauuucucuguuggaauuugaaguuuagguagcagucaccauuaugcucaaagcggugauccugauuggaggcccucaaaagggugaggugccaggggaauggggggaggagguugggcuggagugguaggcgggaugggggcagaggaaggcaggaggccgaaauguucuccucucuccucucccaggaacucgcuucagaccuuugucuuuugaggugcccaaaccauuguuuccuguggcaggggucccuaugauccaacaccauauugaagccugugcccagguaaccucaggggcuccccucucucaccucacuuccugcuuaucuucaugcuguuucccccuuucccaaccaugaacucuucccaccaggcauaacuccaaggaccaucauucacagaugacaaugugaauggcgcccccucaaguuaugcugugcagcugcccugcugucuuccccuaaucuaguuucucaucuggccucuuccugcucagauuucacuccuauuuuuaaaguguggaaugugagaucaggcaaggaucuuggagacaauguaaagccguagcauggagacucuuaaugauaaccaagcacaaauucauauccuugaucacauuguugcucauuucuuuauugcuuuucguauugagccaggcaagguuuugguuugaauucagucucugccugcugugaggucugcaacaaauaacacacccucucugacacucaguuuccuuauguguaaaaugggggugauuagaccuaccuuguuggguggugaagcuuagaaaugauauuuguaaaaugccuaguacaacgcagacccuugauaaaugguacccuuaccucaugcugaucucaagcuuaggcugacagauaauaaaaauggccgggggggagggggcgggguggaaauggauuaaugcagcuugguaggcaaagucuuucuuagagugagucccaguucagguugguggggguaauaauugauugaaagaucaggccuggcaugguagcucaugucuguaaucccaacgcuuuuugaggccgagucaggaggaucgcuugaggccaggaguucuagccuagcuuuggcaacaucaagagaccccuucucuacaaaaaguuuaaaaauuagcuagaugugauggccuggcuguaguccuagcugcucuagaggcugaggcagguggugacauggcuguagucuucaauacucaggaggcugaggugggaggaucgcuugagcccaggacguggaggcugcagugagccaaaaucaugccacugcacuccagccugggcaacagagcgagacccuuuuucacaaaaauaaaacaaaacgaaaaaagaucaggccuccgacuuccuccaaauuccucauuguccagaggagaaaauagcccagaguggugagugcccuggggccccacagcugagacugaaacugguuucuggacuuugggccagcaccaaggauuuccccaacauccccuccuauuagauauucuucaucccagccucuucccuuguccucaggucccuggaaugcaggagauucugcucauuggcuucuaccaaccugaugagccccucacccaguuccuagaagccgcccagcaggaguuuaaccuuccagucagguguuugugcacacacucguauauggggggguggggaugcccuaggccucugaguucuuggaaguggguugagucagcauuugcuggaguucauccucgccuacuagaaggauucuuguuuggacaucaaugaaucucugaguauauagaguuucucugugggccuugggcaggaguaguccugggagcaagcgguggcggucaggugcccuggcucaugguaucuguuuccuaagauccacugagcuggcucucgggucccuggggacagguaccugcaggaauuugccccccuaggcacaggggguggucuuuaccauuuucgagaccagauccuggcugggagccccgaggcauucuucgugcucaaugcugaugucugcuccgacuuccccuugagugcuauguuggaagcccaccgacgccagcgucacccuuucuuacuccuuggcacuacggugagggggucaggagggcuggaggguguagaggaggugaucccaagagcuucccggaauucaggguguuggggaggcaggggcgccccgggaguuggugugggagcuggcgucaggagggagaugcgcugcucuggcagcauggagguguuaguggagaccccgagcccucuggcuguucagaaguagggagggggagggcagcugucaguuuccacccuugcugaaggccugucaguggcagagcugcaugccaggugcuguagcggagggaaagaaagaaaaaacagacguggcugcccuggagcaggcgggucacugucucgggugugucugucuuucaggcuaacaggacgcaaucccucaacuacggcugcaucguugagaauccacagacacacgaggugagagcagagugggggcugggugggugccuacucugugucaucauccccucuaccucaggccucuagagaaugcuggcacaguauggggugggcucuagucuugucagacaggugagacacucccgauuaaucaucuuauaucccuuuaagagagauugaccagggggagggggggaaugguuaauuucccuggggguggugcuguaauaaauguaugcacagugcaugaugggaacaccaagggggccccaacccagccuugcuggggugggaguagagagggcuuccuggaggaagcaaggucugagcagagucccauuugucuagaugacaaaggagacaggaagguacuacaggcagagggaauggcagguauaaaggccuggaggcaggaaguaacauaccagaagcaggagcaugauaggcagggcagcagggcucuguccuguuuugugaaacucccuucuccuaagccccuugacuuucacauaacccucccuccuuuauuuauuuauguauguauguguuuauuuauuuauuuugagacagagucucacuuugucuuccaggcuggagugcaguggcaugaucuugggucacugcauccucgaccucccagguuuaagccauccucccacuucagccccucaaguagcugggacuauaggcaugagccaccaugcccagcugauuuuuuuuuuuuuuugagacagagucucacucuguugcccaggcuggagugcaguggugcgaucuuggcucacugcagccucugccuccuggguucaugccguucuccugccucagccuccugaguagcugggauuacaggcaggugccaggcuaauuuuuguauuuuuaguagagacaggcuuucgucauacugcccaggcuggucucgaacuccggagcucaagugauccaccuacuucagccuuccaaagugcuaggauuauaggcaugagccaccaccauaccuggcgucacauacuccuuuuauuuguucgugcuuuaauauaaaacauacauauaaacacgcacacacacaugcauguacacaccuacacacauauaguuuugugcucagcaccagguagcugugagagaaacagagccaaaugggugcagucccugccucuugguuacugugagucuaauaggagugacagaaucaaaaggcaaccuuugcaaaugauacaaugccaugggugaggcguggccagaguucaggagugcccaggcaugaacagcuaacucgggccagcaagagaggacgcacagagagagugacagugucaacuggguuuggaaaggugggcuuuccagaugaagagaugagaaaggccauuccaggcacaggcaugcagucggguggaaaugcgucugagagguaggugguggggaggaucaggcagggaaagccauggacuuuggauuuaucugaagcugaaucaggugaagggcagucaucucaggguuuaaagccaggcagcaguaggaugcggaugcgcacugcauuuuagccaggccacccuggcagcagggaggagaggcaagaagggccuagaaaucagagggucuuaggggacuguggcgguagucccuucuucuacugaacccagccugcucuguccucagguauugcacuauguggagaaacccagcacauuuaucagugacaucaucaacugcggcaucuaccucuuuucuccugaagccuugaagccucuucgggaugucuuccagcguaaucagcaggaugggcaauugugaggcaggccccauagcccugugaccccaaguacccccagucacggaccccaacacauaccagucucugcaggcuccaucucaacuugcucaccuuccuccuccccucucccuucuccacuugccaucuccagcagagccuccugagucccuccccuucuaaccucauucugucccucuuccuuauccaucccaguuccuccucugucacugccugcccacuccccuucugguccauuucuccuaagcccugagugucccagagacgucuuucagaacagacagcaacacacaguugggcgcacacaugcucgggugcagacgugugcacgugcacacacagacagacaugcauacucucaggcugaggcuccccuuggaacauagcaccagagcccugcucaccagucccagggucuucccuccuggggcuagaagcuguucccuucuagggauccuugccuuaaccccccaccgccccaucuaaggccuccucugcucauagccauuucucacucccacccgugucucugcuucccucuccaucucuccuggccucucugucucugucucugcugagcuggcaucucuaccaucucucucucccuuucuuucugugacugucucugcccucaccagcugccuugcucuggggugagucugucuguguuucauuccauccaaugagggggaggguaacuuggaggggguaaagggcugaauggggaugagaaugugaaaauggggggaacuccuuauggaaauggggcagggaugggaagcaggccucugccuggggcucccuugugauagcacccacccaagugggggcugggugggagagguuccugggaugugagcagccacaucccagagagggccgaaccagaccuggagagaggggcuuagagagguggugggaauccuccuacuccugucccugggagacuguguuagccccacagucggggcucagcugggggacuaaugucagcauucuuccucucugccagggaggacucaccaggcuuguggccaggggcagguaccauccgccuagagcaggauguguuuucagcccuggcagggcagggccagauauacgugcaucucacugaugguaucuggagucagaucaaguccgcaggguauggaaggcuggguccccuggggauugaaauuuugggguggugggcacaggcccugcugaccccugagccccugucccccuugcgguccccaguucagcccucuacgccucccgccucuaccugagccgauaccaggacacucacccagaacggcuggccaagcacaccccagggggcccauggauccgagguacccagccugccccaauuccuaaccuuuggcuuccaccccagcccucugaaccaggauucuugaccucgaguccagaguuaaagccucaaucccugccccuuccugaucaaauucgguuugggauauuugcccccagggccucucuucugcuucuagggaauguguacauccacccgaccgccaagguggcccccucggcuguggugagcacuggucccagccccagggagggaagggugguggucggauggauggagggugcccacgcugccugaguucugggugccgguuucuucacuuugucacagccuauuguguguccucgagcaggucacuuaugccuuaucuguucuagaagggaguuggguuuggggauccuccaagucccuccagggcuuauggugugugcuucucuccacagcugggccccaacgucuccaucgggaagggggugaccgugggugagggugugcggcuccgggagagcaucguccuccauggagccacuuugcagguagguaccagcauacacagcagcaugugacaccccaagaggcugcggggagggcccaggcauccccccaagaacagagaagggugaacgccgugggcucugcaucuggccacaccucacacccuccgguuccugcugccuccugccucuuccccuuaccuuucacuguccucuuuggcaggagcacacguguguucugcauagcaucgugggcugggggagcaccgugggacgcugggcccgcguggaggguacccccagugacccuaaccccaacgauccccgagcccgcauggacagugagagccucuucaaggacgggaagcugcugccugcuaucaccauccuggguauggcuuccugggggccagggcugggggaaccccucagcugauggccaguggccccggggagcauucguuccucugugugcacgcguguuucuucuuuuagcaaacaguuaccaagggccugcugugugccaggcccugugugagucaccgggggcaugagaccaggggcacagaugggcaggagggcucccucccugcuggcaguggcccccagcucccugccccugucuccccucccaugaccuccccuggugcccucauccaugcugcaggcugccgaguccggaucccugccgaggugcucauccugaacucgauuguucugccacacaaggagcugagccgaagcuucaccaaccagaucauccucugaguagggcugccagaaggcccccagcuccuacccacuccccuugaggcugcugccugcuuggccagccucuguccagaaaggaccagagaaagccaggcuggaucgucacaugccggggagcaauguggauggccuggggacuccuggguuuucucccucccgacucccuaauaaaccccgugaaccuuggagccag

SEQ ID NO: 12760 - RNA, 1608 nt, Homo sapiens
augaacugcagaucaggcaagaucuguggacagaugggguuugccuuacccacaccgauagccagcaaugcauuuuuccugagaccaagagagaagucauuucacuuucucaaagugggugagcucauuggcugaaccaagaugagaagcccagaccuucacucccaguccuggcuucucugcaaccccccacccugcugccuccacuuacccaagugucuguaccugcagagguccgcagaccucuccccaaccccacugaaguaugggcuaaggcucaacccccaggaagaacccuccaggaagagauugggaggggaggauccaagacagugaggagaagaguggacagagacaugaagaggcugauggagagguaggaaaggguaggcagcacggacccaguguguggucugcacacucgauguagauauuuggugggcagauggucucauugccugaaaggagagaagauuauuccuggaaucuacgaucacuuccccugucccccacacgcccaaauguaagcacauacaugcaugcacacacauaugcacacauuugcauaaaugugcuugaacaccacacacacaacccccacaaauacgcaaccacggauauaaaugagcaugcacguacacaaauacauauuaacaugcacacaggcaucugcaugccggcauucccacaugcauaugugaaaccauguuuaaaaaucccaaacacucacacucacacggguacagacacauacacauguuguauacaugcaccugccugugcacaugagcagugccuugccccgggaggcucuggagccuagcaggguggcauggagggcuggcuggggguggggugcccaccuggcaugugcaccauccggcaguggcagcgcugaagcacggccuccuuuucacagcgcagccggcaggcagacacacuguaggccgaguagcccugaagcucaggcucccugagcucacucucugcgcggcaguugccccagggcuggggcagguaggucagcugcagagguggggcaugaugaggucaugcucaggaaucccacccaguccuccagugcccacagccccagcaaagucaacacagcuggcaggcucugagcuucuagagggcagguuugcuccacauccccucugagcccaaaggcgagcccugugcccaauccagggccuagcaggagaugcucacccgcuguuccuggcaggacacaaaggucuggaagccuggggacaccccgaaccccagcugguggauguagggcggcuccuccuggcuguggaucugcacccgaauaccugccucaaacgacgucucaucugcacagcagagauggggaccuuuggaaacccaucccaggcagagggcccaggccccaguccccaagguggcccuugucccuuuccggccugcguacuugucucccuccagaugggcagguacuccuccugcuggauguccagcaugaucuccaggccacugcccaugcccccugcccggcugggcagcgagcuccgcggguccgcguugaagguguaacacuucccauagcgaguauagaccugggagguggggugagagagcagg

SEQ ID NO: 12761 - RNA, 7100 nt, Homo sapiens
cacgggcccugcgggccgcagcaccgacagcagcagcgaugcccgcauggcgcccggaccgcggguccccggccccggcgaacccccagagcagccagaggagucuccgagggggcgggaccggggagggggcggauccggagggcucgggccccgcgggcgggcccgcucccuccccgcagagcagagccagcggcccgagccgaauccccggagccgcgccucgauuccccuccagcagcugcucugggcugcgcaggguucuugcgcucggcacuggagccucagccgcggccgcagcuguccgacgugucacugcaagggccccgcccccgggguggggucucgggcucucgcuaccggagagggaggagaagggggagguuaaaggggaaggacccccggaagugcccccuccucagugcgggagagggagacgccgggggcggaguccccugccucccgcggcgugguuggugcgucccaugugacgucagaagcagcccgccccugccuggauggugcgcccugagugacgucaggagcagaggccggagcuguccaucagcaccaaaggccgcgggcgggcucagggcauggggccgcgguucuggggcggcccgagccccggcuccugcgccuuccccuuccucaggcccagcccgaguucccggacgccgcgggacuggagugccagccgguguuggacguggagcggcgccgccaccgcgccgacaccauucucuccggcccagcagcccccuuccucgcacgacggacuuucccuggaccccagucaguuggagccucuggcgccccgcaaccccggccccucgggccucugcacagccucuuucacucagaagcucaggucgccuccagcccagguaaaucuuggacaaucccauauugagccgcccacagaugaaucucuuggcugccuccuucucacuggcagcacgcucccuucauccccccgacucccgucccucuuuuaacuucaucccagccuccacuagccaggcacuuuuguuucccuuugucuuugcuccccacuccagagaugcuuccggagcugcacaaauguggauacuauuccuuuguccacuguccuugcugaguucucccaaucccucucccacccccauccugguggggacccaggacuccuccgugaccccaacuuucccucugucagguuaacuugggagggugacucccuucuauucccagcacuaugccggggacuguggcaacacugcgguuccagcugcugcccccugagccagaugaugccuucuggggugcaccuugugaacagccccuggagcgcagguaccaggcacugccggcccucgucugcaucaugugcuguuuguuuggagucgucuacugcuucuucggugagauccccaucucaucccucaccugggcuccccaguguuuccccgaguucuuuuucugggcccccaagucuucucugaaucccucuaccaucaugaauaauucuuccuuuucuuucaucccacacauuuauagauugucuagacucuagauuauaggaaaaacagguuuuuggauuaggcacaccugagugugaauuuacuuagcuuugcaguuacuaauugugaugucuugggcacauuaaucugucugagccucaguuuucucaucugaacaaugaucacaauauuugucucauguaguguuguaagaauuaguaagcauucaauaaauuguagcuauugugaggauguguuuggcuaacugugcuagguagccacugaaaacacuuagcaggguuauuacacauggucccuuaccacagggcauauugucugacagggaggagacucccuggagcauuuacaccugggauacauauuagagugggcuggaugguggucacacacauccauccagccuacaaggcaggcuccgguaaucagagcugcugugaauacuuguacaggacggguacuaaauaagggagcucagcugagugggcaagugggggcuaaaguccagcucaugcucugacaaacucugggccuuggcacaaagcugcuuugccuagagaaaggcacaccuuuuucuaauaugcauaaaggugccagaugggcuaguggcccaguauaaugggaguaagugaccaguggcuuugcagcaagaguuacagaacuucagagaggagagugagcucuaugggcugggggcccaaagaaagccuccaggagaauuguaggugagugggaccagugggggcaaaugagucuugggggcugggguuccagguugagcagagguagugcaagacuuguguucugcagccucccccugcaauggguggguagacaggguugggagccagauggucccucccauuccucccccaaacucugggcugaacaacugaagaguaggcaggaggaagugccccccgcaaggguucaggacacguucugggccuccaaggauucuguaucaccucacccccuccauaucuguacccacucccucugcauguugcucaaugcagccucauauucccucuccugggcuuccugacauccuaccccucuuggaugucacuacgcccaggcucauggacucugagcccuuguccacgcccuacuccucucucugaucacgagccuccuggacucucauacuuccccccacuccuggaagugacucuccucuguuaucuuucuuuuuggcucucucugacuccuugacccccaucucugauuuccaucuuuccaacuauucagaaucuccacuucccucacccuuucaaguaucucuaaugggccuaauggcccuauaaccuccuuauuucugaaacuccacaaacacuguuuccuucucuuugauucugugugaccucauguaagccuuagugaccuccaccuccucucaccuccaguuaugucauuaccuuccaucccucugacccccucuauuacuccuagucuugaucccugguuacuccucucuaauucccauaaccucauuaucugaucaccccuccccauacugugaucccaguaauuccuuguuuuggucucaguguuccucucucuuggaaaucguuuuauacucucgaugauucuauuucugucaaucucccuaaccuacaaauaccucauuuucugggacaacuccccaguaaugcugcuacucuguccucuuuguaaccuuucaguggugccauuaucucugaagcccugugacccccaaagacucaucuuucugaaccugugugacccucaccucucaaguuucuuuuuuuuuuuuuuuuugagacaagagucucgcucugucacccaggcuggaaugcaauggugcgaucuuggugcacugcaaccucugccuccuggguucaagcgauucuccugccucagccuccugaguagcugggauuacaggugcgugccaccaugcccggcuaauuuuucguauuuuuaguagagacgggguuucaccgcguuggucaggcuggucucaaacuccugaccucaugauucacccgccuuggccucccauagugcugccaccacgcccggcccucgaguuuauuaugauuuccaaauaccucaucucugugagcaaucccuucucaaagaccccaaugacucuuuuucugauccccuugggaccccagugacuucucucucugacuccuaugaucccaaagacaccaaugcacgaauucacucuugacucaaaagauuuauccuaacuccugugauccucaaauacaucaacccucaugaucucaaugguuauguuugccuucccauugaccaccaacagccauaucucucuaaccuccccugaccucaauggccccaucacugaugccgucaugacuccagugacccucaauucucugaucuuagugucuuugucucugguuccccugggaucccauguccuugaccccuuggaccugcucccuccagccuggugcccucaucuuggccccucacuagccccuguuccccuccagguuaccgcugcuucaaggcagugcucuuucucacuggguugcuguuuggcucgguggucaucuuccuccucugcuaccgagagcgggugcuagagacacagcugagugcuggggcgagcgcgggcaucgcucugggcaucgggcugcucugcgggcugguggccaugcuagugcgcagcgugggccucuuccugguggggcugcugcucggccugcugcucgcagcugcugcccugcugggcuccgcacccuacuaccagccaggcuccgugugggguccacuggggcuguugcuggggggcggccugcucugugcccugcucacucugcgcuggccccgcccacucaccacccuggccaccgccgugacuggugcugcgcugaucgccacugccgcugacuacuucgccgagcugcuacugcuggggcgcuacgugguggagcgacuccgggcugcuccugugcccccacucugcuggcgaagcugggcccugcuggcacucuggccccugcucagccugaugggcguucuggugcaguggagggugacagcugagggggacucccacacggaagguaagggggcacaggccaagguggacaugagaggaguggguggccagggauggguugggggccaagugacuggggagugggggacagcagcagaaggccucgauggcgguagagagcugacuugcucagggucugggaggauagcacccaggugccaucauucauuccacaacaacauauggagugcuggcuccgcaccaaccccauuccaggcaccagggauacagcagagauaacacagacaagguuccuguccuuauggauucaaggcaggcaggagacagauaacagagaugcaaacaaacaugauuccaguuguguagagugauaugacagagacauugugcaggauaaugugaaagaaugaccuauggaagcuauuagaguuaggguggucagggaaggcugcuugaaggaggugauauguaagcaggcacuugaaggcuaaggggccagccaugcaaagagcuagagaagagggaacagcaagggcgagggcccugagaaggaaugagcucagcuugcuugaggaaguggggcaggaguaugggaggugaggugugggagccagagugauugcguggacccucugggucauaagaagcacuccacauuuuauuagaagggcaauaagacuuuaaaccacuggagaguuuaaaguaggggaggauagaaucuaauuuagcuuuugggaugcucauucugcugccgaguguagaaagcauuggagggagcaaguguagggggaaaccagugaagaagcagcugugauuguccaguggaaagaugaugauggcuggccuaggugauugggagagggaugacagccuggaaggggguaccuggaagccuagcaaccuuccauaaagaccuauggaagaaaagaacaacagcgggaagucuccucugagagguaggagaccaggaaaggaagugacagggugggaguaagggguuauggacaagaggaaucuggaagccuagagccacaggugggaugagagagggagggcucaagggaaacaaggcgcaccguccucugagcuccuucucuacccaucccaccacaguggucaucagccggcagcgccgacgcgugcaacugaugcggauucggcagcaggaagaucgcaaggagaaaaggcggaaaaagagaccuccucgggcuccccucagagguccccgggcuccucccaggccugggccaccagacccugcuuaucggcgcaggccagugcccaucaaacgcuucaauggagacguccucuccccggugagcucccugagcccauccagccagaaugagaaggaaguguggaaacucuuuccaaacaggacugggcuuuccccacgggcugguugcuaucuagaaggccuguuuguccaugaacuguuuguccaugcaucggagcccaugcaccaggggcuuggcggguccagcuggugggggaauugggggaaagguuccugaguauggguuuuaagugggauaugguaugugguggggucucagggcuguggacucugggucuauggcagucuauagaagugucaggcuugugggaauucaggaagagguggcuuuuagggcaggauucugcggugggacucacaccuauguuugcucccccacagagcuauauccagagcuuccgagaccggcagaccgggagcucccugagcuccuucauggccucacccacagaugcggacuaugaguaugggucccggggaccucugacagccugcucaggccccccagugcggguauagccauaucugucugucuagacucugcagucaccagcucugccagcucgaggaggccugcuaggcugccacucagccuccuggcuuuggcugucccucuccccagccuggagagggcuggccuggucacuagaagggaggauugucucaggcgagucuuggccugagaggaaagcccccucccaagcucccaagaggcuccugaggaacucggggugugaaccccauuggggugugcucaggguugugaguguguugcccgugugucuguguguaugugugugggggugggcaggcuuggaggggacgcugggacccuugccuuagauuucugacugguaggguuucuccaggcucagccccaccucuucacucccugccaaggucccaugggccaccuccugcaugucuccgcggaggggcuaccuuccuucccaucgcccugccucgcagccagacucaucuaaggguucuuguccuugucuauggggcaaacuguagcaucccucacccugguccccuggccucuguaaagccaccagccugagggcaguggcaggagaugggggugggggggugcugcucugggcuggguugggaagggaguuggggagggguuuaaaugcacggugcaugucuggugucugucaugccaaccuagacaccucaugcuucugucucccccaccccacucuguuuuacaucuuuuauaaaugugccaaacuguguggccucugcc

SEQ ID NO: 12762 - RNA, 20592 nt, Homo sapiens
cuuggcucgauuuucuuccggggcgggacuuccuuuccaucauugauaggcgccgggcagcugagcugguaggaggaccagacggggagguucgguaugucugaccaggacuuauguuccucgaaagggcggccaggaggaugcucuuccucucuuuucuuucucgccuuuuucuccgcaugacgccucgguuugcgcggacgcccugggcuuuuggcacuaccgcccaccugaggcucuuccgcuuccucuuuccccccccaggcuccgccccccagcgucccguggccaugacgaccgcucagagggacucccuguuguggaagcucgcgggguugcugcgggaguccggugaguggacuuccgguugggcugggccucggaccucggacgagguggggguggugcuuucuggagacacgcccugagagucauggaguuacgacugguagggucaccaggugucagaguucaauuucuuuacuuuucccagguuuguucgcccuuacaguguccuuugccugugauagccuaaacucuagccguccuuugaggccaaagggcgguaucccucccuccgugccuucucugacacugucagaaggaagugaucauuaccugacuaaaagccccucaggaccagggacugaucucggucauaaucauuauuguguagcaagguacuaaauacaguagauagaagcacgagauuuggagucggacccacuuggguuggaauaucaacccucuuucaaacuugccauacuguuuccugaggcucaguuuuccucacagauuggcauagugauuguacuuaacauuuguggggauucguuuuaauucauguauuuaguacaaugccugcaaguauaguaacugcuuacaguugggagcuauuguuauuguaaugauuucccugaugcuuggcacugugccugggcauaauggagccacaguaguuguugaauacuugguuggcauuaguugugguagaaaaagccuuggcuuugagaucagauaggagaaguaacuuccuaccaauuauaugaucuccaucaagauuuuucacuuuuuugaaccucaauuuucauaucuguaagaugggguuaauagugcuucucuuugagagauucugagaagguuugaaugagauaccaaagucaucugguacauacuacaguuaauguuagcuguccuccaucacuccaugcuccuauugacgauaucuguggaagcucucuuuauagcaguuuucuuuucuuucuuuucuuuuuuuugagacagagucuugcugugucacccaggcuggagugcaguggcgcaaucucagcucacugcaaccuccaccuccugggacgaagugauucuccugccucagccuccugaguagcugggacuacaggugugcaccaccaugaccggcuaauuuuuguauuuuuaguagagacgggguuucaccauguuggccagguuggucuugaacuccugaccucaagugauuaaccugccuuggccucccaaagugcuaggauuaaagucgugagccacagcaccuggccaguagcaguuucauuuccuggcuuguauugauaacuuugcaaaugucuuauauccuucucugggaggagacaacuaggaggcccuuugaacgugggaagaguccuugaaccaugucuguaucuauccucagugucuaguacauacagaauccuucaugucagguuguaggacuuguuaauuuauucagugaugaauggugggugugugaaugugugacuacaaggagguagcaggagaagagcuuuguggcagcagaauaguuuuguaucuugauugcguggcugcaggaauuuauauaaacagcauauagcuauauauacauauuguaccaacaucaguguccugaauuuuuuuuuuuuuuugagauggagucucgcucugucacccaggcuggagugcagugguaugaucucggcucacugcaaccccugccucccucccagguugaagugauucuucugccucagccucccgaguagcugggacuacaggcaugcaccaccaugcccuacuaauuuuuguauuuuuaguagagacgggguuucaccauauuggccaggcuggucuuuaacuccggaccucgugauccacccgccuuggccucccaaagugcugggauuacaggcgugagccaccacgccugcccuuuguguuuuuuuuuuuguuuuuguuuuuuuuuuuuuuuuuuuuugagauggagucuaccucugucacccaggcuggagugcaauggcucaauuucggcucacugcaaccucugccuccuggcuuccagcuguucucuggccucagccccucgaguagcugggauuacaggcgcaugucgcaaugcccagcugagaauauuuguauuuuuaguagagacgagguuagagucguagaauaauuuuuuguguuuuuaguggagacgggguuucaccauguuggccagguugguccugaacuccugaccucaagugccuugcucccaaagugcugggauuacaggccugagccacggcaaccagcucaguguccugacuuugauauuguacuauagcuauauaaaauguaaccauuagggaaaacuggguaaaggauacaggggaccuuucuguauuauuucugcagcauucuuugacuccauacuuauuauauuuuuuaagccaaaaaagcauuccuucaugccuagcuuguagcugcacuuuuuuaggugcagugaugaauaccagagugaucaaaagaugcccucaaggaugaaagucucauuagagagagcaguuuuaacagacagcaauaacaaugccuuagugcuauaaugaauaguuauucuaugacauacuuuuuaguauuguuugaaaguuucuacagaugugcuuugcaaucagaaaaagaaagaaagauaaaacuuccaauuaacuuuuguguaauaaugagugacugcaauaugaaaauucagcaguauuacuucuugaggcggcuuccuggaggaggcuggucucaagcugggcgguggaagggggugucucauaacaagagagaacugugaaccaagcuggcuguauuuccagcacugucaguagaugaggcucuuuugagcagaaggugaaagaaaauuuggaagaguugguuggaguuguguagccaagcagucucaucaggcugaaugaaauguuaggacuuuuuuugaagaugaggggagccauugaaugcuuuugagcugagaaggagauagaaaauuugauccugcaauagaagaucuacaauauggauuggaguggguauauuuuggcaucauagagccuuagaauaaagagaaaaaucuuuucacugugucuucccuccuguuugccccuuuuucugcaggggaugugguccugucuggcuguagcacccugagccugcugacucccacacugcaacagcugaaccacguauuugagcugcaccuggggccauggggcccuggccagacaggcuuuguggcucugcccucccauccugccgacuccccuguuauucuucagcuucaguuucucuucgaugugcugcagaaaacacuuucacucaagguucuggguguggggaagaggcaggaugugcaaggagcccaagagaaugauggaaguuggggauaggguaggggugcagaagucugcagugccaggauccagagggugucagagguaccagugguugugcuaaggaaggaauguugagggcaggaagaucugcugugccucaguaaauugaguuuuuuuuuuuuuuucagcugguccauguugcugguccuggccccacagggcccaucaagauuuuccccuucaaaucccuucggcaccuggagguauggggacacggggggauguuggugcacagcacccaacuugaggcagccccuuggggaugggaaagagaagagccucuuuggugaggaggccaggccugaguauacccauugcucugcagucaugugauauccacugucuuuccauuuacugcuucccuaaaucauagcugggcuuuguggucuucucccuccucccaacuaggggauggggaugaggucuuugucuucugugggguucugccuuccucccuccucuuuccuugucccagcuccgagguguuccccuccacugucugcauggccuccgaggcaucuacucccagcuggagacccugauuugcagcaggagccuccaggcauuagagguaaggagagugaggggugagcucagacaccucaacuugagagauguagaagaccaagcucugauguucuccccucucugcagcucucccugccuccugcuucccucuagacaguguccucacucccucucuguguucccgcagcacucuguaacugccuguauauuuauagucguaccuaccauauuauauuacauauucuagugucuaccuucccacugucccuacagugaguucuugggucagggaccugggcuuuaagccuguaucuucagauggaguucaguguauaaaaaaugaaugagugacugggugguagagcuuggccuuggcauagggaggaaggggagggugggguaaugaagcacccaucugucugcucaggagcuccucucagccugcggcggcgacuucugcucugcccucccuuggcuggcucugcuuucugccaacuucagcuacaaugcacugaccgccuuagacagcucccuggugagugccucagagggaagaggguuucgaggaagggcaaggccaggccuuuggggaggagggccagcugguugaccagauaguauuguagugaacaucgauucucugccuccuccccgucucucucagcgccucuugucagcucugcguuucuugaaccuaagccacaaucaaguccaggacugucagggauuccugauggugaguaugggcaguuuggcagcuggcacaccaugggucuuugauugcucugcucucacucucucuccuugaccagcuuuuacucccaccuugcucuugccaugaggguggagcugcauucugggagauagcacugcuuagacacuagcaucagacaaaccagaguucauaucucaacuucuaauaccugugcaacuuugagcaaguuaguuaccucuugguuucuuuaccuguaaaguagaaaucacaagaguaccugguuuuuuuuuuuuuuuuuuuuuuugagauggagucucgcucugucacccaggcuggagugcaguggcgcaaucucagcucacugcaaccucugccucccagguucaagcaauucuccugcuucagccucccaaguagcugggauuacaggcacgugucaacacaccuggcuaauuuuuguauuuuuaguagagaugggguuucaccauguuggucaggcuggucuugaacugcugaccucaagcaauucaccugccuuggccucccaaaaugcugggauuacaggcaugagccaccacgcccggcugaauaccugcuuuuauaguauuaaaaugauugugaagaaguacccaauguugcuuagucuagugccuagcucagaaacugguagcuuuugugauuaugaugaagaaccuuucuucuggguccucccauccaccugucagagauaaagccgaacuaguuaaagugguaaggacagauuuuuuuuuucuuuuuuuuuuugaggcagagucuugcucugucacccaggcuagagugcaguggugugaucuuggcucacugcaaacucaaccuccuggguucaagcaguucuccugccucagucucccgaguagcugggauuacaggugcccgccaccaugcccagcuaauuuuuguauuuuuuaguagagaugggguuucaccaucuuagccaggcuggucuugaacuccugaccucaugauccgcccaccucagccucccaaaaugcugggauuacaggugugagccaccgugcccgaccaaguaaggacagauuuuuuaucagugauaaacuauugcagcggggaagagggugcaaccugaacugaacgccacuucaauuugugcagagguggcugggcauuuuaaaaggagagugagggaauaggaaggggaacugugagggcuugagcagaguaagggaaguggaaauguacgaaaagcagaaguggagguugauucacaugaagcccuucuggguuugcuaaaaguuaggcuccuaccuucccacagagacugggagaugggagcccugucaucagguguuggcuagaacaaaugggaaauucuuuuggcagccuugacuuuucccaggcaggagcuuaagggggcuagagucaccauucuagggaugcauccuugagauauuagaacuuugcuguuuuuguucagguuuuuuacuguggggguuggaggagucaacaaaaauaauuuguguugaauuuuguugaacuugugcugaacaagucugcaguucuuaacaggccaaaguugaggccuagucaaaaagaaggcccagaggagccugaguaggguuugaucaaggugagaaccuccucuaauucagggaaagaagagacacuccucuuuccccugaacaauauaaauccuuuucuuccuugaucaccuuuuguucacuaaaaaccaacugagccauuuauugggacuugguaguggaugaauuuugcuggauggugagagugaccaggcauuuaaugggggacauuucuauggaaacaaaaagggaaacaaagaugaaugguuggagcagacuauaaauccauuuucugaguccagagggcagccaguugagauuucuagguguugagcucuauguuucuuuagaugguggaaugaggauagcaguggcaaccgauggauuucuucguuuguaguuugaauguuuguggugauagcauagacaguguugcagucacgguuauuucccugaacagagccuggaagauacagaagugucaguggacuuuuuuccuuuuuuuuuuuuuaaugagacagaguuucgcucuuguugcccaggcuggagugcaauggcacgaucuuggcucaccguaaccucugccucccggguucaagcgauucuccugccucagccucccaaguagcugggauuacaagugugugccaccacgcccagcuaauuuuuguauuuuuaguagagacgggguuucacaauguuggccaggugagucucgaacuccuggccucaagugauccccccucuuuggccucccagagugcugggauuacaggcaugagccacugcaccuggccggcugggcauuuuaaaagagggcggcggggagugggcaggggaaugguagggccuugagcagagcugggggaguggaaaucagguugguccacaugaaacccaucugaguuugcuaacuaacuggcacuuaccaaaauaaggcccuuacccuuucacagagacugggagacggggcccuaucuucaggaguuggcugaaacaaaugggaaauucuuuuggcagcuuugacuuuucccaggcaggaauuuaaggggcuuggaguugccaugcucaggguguggccuugaacuguuaggaacagugcugguguuguucaagucuuuuaacgugggaguagggguggaugaaaucauuugugcugagugugugcaguuuuauauaggccaagguugaggccuaguccagaagaggucucagaggacccuggcuagaguuuggucaacgagauaaucuuuuucuccccuguaccccugccaggauuugugugagcuccaccaucuggacaucuccuauaaucgccugcauuuggugccaagaaugggacccucaggggcugcucuggggguccugauacugcgaggcaaugagcuucggagccugcauggugagugggggugugugauggggcaagcauggaggggaagggggagagugaggcuggggcuggccuggggaccaugugccucuagagccuugagagggcuuauggggagugcaggggugcucuggccggucuuucugcugcaaccucccccagugcaugcaccacacucacuugcguguacucauccacaugcucuuccuuccuucuugcguccaccccaggccuagagcagcugaggaaucugcggcaccuggauuuggcauacaaccugcuggaaggacaccgggagcugucaccacuguggcugcuggcugagcuccgcaaggugagaugggaaugcaucaggggccugggaaccacccuugcacguacccccccaugcugguuuggucagugccuucuucacacagggagggccagggccccaggcccuccucauucuccccuuccugccccucagcucuaccuggaggggaacccucuuugguuccacccugagcaccgagcagccacugcccaguacuugucaccccgggccagggaugcugcuacuggcgugagugaucguccuguguccacucuucuuccccuuuccugcccaguccucccccaccuugcacccucuugccaucccugggugaggggccaaggaccuggacccugcuuacuguguucuuaauaccuggagcucagcaggaugggccuaccacauacucccucccccuuuuugucuuugcucaguuccuucucgauggcaaggucuugucacugacagauuuucaggucggugugguuggggggcgaggacuguugggggaagacacgaagggagggcgcuggggagagaacagagggcuggcuggugacagggucuuccuggucaguggaaaguagggucccgccuuuuggcuggcuugggcaaggcagaggugcucccaggcuccaaccucucucuccuuccugucgucacgugccagacucacacauccuuggggcucagccccaugggcccaccuuugcccuggccaguggggaguacuccugaaaccucagguggcccugaccugagugacagccucuccucaggggguguugugacccagccccugcuucauaagguuaagguaagcagcguccuccgcugccuugugccugcgguugggugucucuccggggacucugggcuacagugggcagggaaugguaggaacugugcuugcacguggucaagguuucuuugauagguuggauggccagccguggauggcagggcuggaggcuuggcuuucacagaacuucuucccuccaccaaccucagagccgaguccgugugaggcgggcaagcaucucugaacccagugauacggacccggagccccgaacucugaaccccucuccggcugguaagucagcuucaucccacuaaccucucucguccccagcgagcucacucuaauuuuuaaguuacagugaagaucugcuggaagaaauguuauuuuuuguugggguagaguauuauagagggcuucuuagucuuuuuucuuuucuuuuaguuuagggaaaggagaagacugcuucugggagcauuuugaaaacuuuucgaggaacauuaauuuuguggggugucaagagaucauguaggccaggugcaguggcuuacaucuguaaucccagcacuuugggaggcugaggugggaggauugccugagcccaggaguuugagaccagccugggcaacauagagagauguccauuucuacaaaaaaauuuuuaaauuagccugacgugguggugugcgccuguaguccuagcuacuugggaggcugaggcaggaggaucgccagagccugauaguucaagguugcagugagcuaugaucaugccacugcacucuaaccuggugacagaguaagaccuuaucucuuaaaaaaaaaaguaaaaaaccccaaaacaaaagaaaguguauauguauauauauaaaauaauaggauuguggccagagaaguuugagaaaugugagguugaagagaaauaggugugucagcugccggccgucucgggcccuucaggaugcuaucauguaugcugagucucuggaaguagcauaggaugcgcagcuuggauugcaugugaccacaggguuccauaggacacgcuuuaguacaugccgcggaggggacgccuguagccucccuugcccguguccccauacacagcccaucgcccccucaucgcugaggagcaccguugaaggauuuggggccaucuguguggggcaggcuugcucaguucuggguuccccuccugccuaggaugguucgugcagcagcacccggagcuggagcucaugagcagcuuccgggaacgguucggccgcaacuggcugcaguacaggagucaccuggagcccuccggaaacccucugccggccacccccacuacuucugcacccagugcaccuccagccagcucccagggccccgacacugcacccagaccuucacccccgcaggaggaagccagaggcccccaggagucaccacagaaaaugucagaggaggucagggcggagccacaggaggaggaagaggagaaggaggggaaggaggagaaggaggagggggagaugguggaacagggagaagaggaggcaggagaggaggaagaagaggagcaggaccagaaggaaguggaaggugagcccuuugugggcuggggcgagcugaggccaggggcccuugggauguuugugagugguggggccuggcggguggagggccaguucgggggagggcagaguguggguacuuucccucccugcaggccuuuucucuuggucucuccacagcggaacucugucgccccuuguugguguguccccuggaggggccugagggcguacggggcagggaaugcuuucucagggucacuucugcccaccuguuugagguggaacuccaagcagcucgcaccuuggagcgacuggagcuccagagucuggaggcagcugagauagagccggaggcccaggcccagaggucgcccaggcccacggugaguggggcguggcagggucucuggaggagccaguuaugggaacauggcuguugugugcccugcacugggcugggcauuucuuucagucucuccuuggcacuaggagccgaggaggggagccucagagguugcaagcacucgggaagcugggcugaggagcagggauucugugcuggagcuuggacgucaguacaggccuuugacaggcuucagagguccugccauccuccaugcucucagcauccccucaucccucugaucaccgccccugcuguuuuucacccggucccccucuugcugcgcagggcucagaucugcucccuggagcccccauccucagucugcgcuucuccuacaucugcccugaccggcaguugcgucgcuauuuggugcuggagccugaugcccacgcagcuguccaggugauggcgcccagagugggggcccaggaggcuguggggauuaagagagccagagggaaguggcagcaggccugagggccgggggccugugggagguguccgucugggguccgccugcucacagcugccucugauccacccucugucaggagcugcuugccguguugaccccagucaccaauguggcucgggaacagcuuggggaggccagggaccuccugcuggguagauuccagugucuacgcuguggccaugaguucaagccagaggagcccaggaugggauuagacagugaggaaggcuggaggccucuguuccaaaagacagguacaaguccugcccuugaccucucugcccacacgccuccccuguuccagggaaaguggcucuguguaggggagugugaagggggagcccuagggagaaggggcuagaguggagagcaguuguucugccuggaggaaaaagaaaaccgucugccugcugcauuuacaaaaaggaaaacagaaaaaaagaagaaacuauauccuguuuuuuuuuuuuuuuuaacucuaaaagucaggaaaugcaaucucuguaacugugcuuaaacauacucauuauuuuuucauaacuugaaggcuuguuguguuggggauuuuuuggcugauauuucagacacuacauaaaaccuaaugagcccucacugcaguauuggauuguggugcugccucugccagcaaguguagcuguugagugagaugcuuggggaguuggcuugguuuauccuucccggcugaccuuggaagguacauaauguccuguggcauuucuucaugcgcuaguccuuaaaacaagaauuguuuccauuguagaccagucagcacuaucuuugaagaagacauugaagaagaaauaaauauucuugauaacagcucuguggaaaugccagaauuuuauuagacgguuuucucuucuuggcggcagcuggagcagggguuuagauuuuauucagaaaauggagcccugcuccauuccccacugugaacuggccugggcaugcagccuuagugacacagcgcaaacagaaacagcccccagccccucccggacccuggcuguacaccaugaggugcuguggucucuggagccucuuccaugguggcguuauuaaugaacauuacugugggcucuguucuccuuuaauuuuuuuuuuucuuuuuuuuuugagacggagucucgcucuguugcccaggcuggagugcaguggcacaaccuuggcucacugcaagcucugccuuccggguucacgccauucuccugccucagccucgcaaguagcugggacuacaggcgcccaccaccacacccagcuaauuuuuuguauuuuuaguagagaugggguuucaccguguuagccaggauggucugucuccugaccucggaucugcccaccuuggccucccaaagugcugggauuacaggcgugagccaccacgcccggccaaccauucuccuuucacuugcaccucaguuaccuccucugaacaaagaagggaaugaacucaccccauggugcuguuacgcuauuuaaaugugacaguaaggcaccaagcagagggccuggcacaacacaaaggucuccuguaaaugguagcugcugccguuguccccagcuguaugguccugggcagcauguguaaaugauuuaauauuuucuuucuucuuugcaaaaugggauagggagaguuucucuggugaugaaaugcgaucauaguggcauaggagguagcgcaugcccaucacgguguagcugcucagagugcugccucucucauugcugauccauguccugauuccuucccagcuuccugacacuaaggaugaguauaagauagaugcuauugucaucccuguuuuauagacgaggaaccaggcucacagagcuuagaugacuugcccaugauuacagagccauuaauugauggagccuggaauuggaccgaaauuuggcaacagaguucucugccuuuccagaccuguugauuuuggucuuucagacguugcuaggagagcccugaaguacuugaucagcccaagucuguaagagggcauaagagcagguccugguuguguuuggcccagucugagagggccuagaguuagaagguagagugcacuuugaggaguuugugggccaggguuagcucaucccucccugggguggggagugaucaguuggcagcugugccgggagagggagcugguggccuggggcgcggugguuguguaugaagcuggaggcuugggcucaggggagaccugagcauggggaaggagcaucgugagcauggugggaguuguggcacuguggggggggcucauggggaccguguccauccucccuccagaaucuccugcuguguguccuaacugugguagugaccacgugguucuccucgcugugucucggggaacccccaacagggagcggaaacagggagagcagucucuggcuccuucuccgucugccagcccugucugccacccuccuggccauggugaccaccuugacagggccaagaacagcccaccucaggcaccgagcacccgugaccaugguaguuggagccucaguccccgugaguauaggcaaaacaagacauagaugaguuuggggaagggaaggggcacugauggggagguggagauggagcccaggggcugccaugggcaggcugaugcccccucauugcccucagccccugagcgcuguggccuccgcucuguggaccaccgacuccggcucuuccuggauguugagguguucagcgaugcccaggaggaguuccagugcugccucaaggucugugcucccugacacugcccaugcccccagcuguccagggugcccacucguuuccaucacagccaacugagucagaucaagcacucuagagaccugaucuggcuucugguuucaaccccagcagcuucuugcuguguggccguggacacauucccugguauuugagucccaguuguugccugucugcaauggagauaacgaugccucccuuacacaguggcgugcgucagggcucauguugaagcugcccagcccagcaccuggcacucaucaauggggccuccuagcauuauuauaaacacaugaugucguuaggccuuuguugagcaccuguugugcuagacauugaggaucuacagaucaaucuugcccuugaucuuacagucuggugugagaagcugacaaugauuaugcaauaugcaaaugcuguaaucgggcuaaggcccuugaaggggugucuaguccagcuugagugggucaaggaaccuuccugggaggugaugucuaagcucagucuugaaggguaaguuaaggaguagggaggaaaagaaugucuuagguaaaggaagccgcaaaugcauggaggcccgagagugucgcugguggggagaacugcccaggaugagggcaccuggacaugcagggcgaggggcagggguccugagaggacucuggggggccggcaggggccaggucaggagcugccuccugugucugccaaggaguuuggacuuguuucugagggccacugggagccacugaaggauuugaaauggggcagugauggucaguuuugugccuuagaauaguuagucuggcggagcguggagggggugaggcgacaggcagggaagccagcugcugaggcucugagcgggcaggggcugcaaggcagagagcggugguggaugaagaggcugucgagugugagggaagcuccauagacuggugggugggcagugggagggucaggccgagggugcugucaccaggaacucggcuuucagucuggccccaccuccccaggccucucaucagguuucucaccaacuuccucuucccccaggugccaguggcauuggcaggccacacuggggaguucaugugccuugugguugugucugaccgcaggcuguaccuguugaaggugacuggggagaugcggugagugagaggggagaugcagugaguaaggggggagauggggugaguuggggggagaugggggagugagggggaagauggggugaggggggagauggggugagugaggggggagaugggguguuaaggggggagauggggugagugaggggggagauggggugagagaagggggagauugggugagugagggggagguggggugagugaggggggagguggggugagugggggggagguggggugagugggggggacguggggugagugaagggggagauggggugaguggggggcggagauggggugaguggggggcggagauggggugagugaggggggagauggggugagugagggggagauggggugagugagggaggagauggaaugagggggaagaugggguguggugagcgcacgggggugaugcagugagugaggcaggugcagcuggggcagggccucucugggacucucacuccacucucaugcuucuccauugcucuguccccucucuccacagugagccuccagcuagcuggcugcagcugacccuggcuguuccccugcaggaucugaguggcauagagcugggccuggcaggccagagccugcggcuagagugggcagcuggggcgggccgcugugugcugcugccccgagaugccaggcauugccgggccuuccuagaggagcuccuuggugagagaggggaggggaaggcaggagggugggcaggagggugggcagggccuuggggccaggcuccccaccugguacccaguagcggagacagagagguaacaggacuugucccuuguagaaguuucugaaauccagaaauguggagaauaggaagggauugagagguggugaguuuaggcuggaggagagcagagccuucuaaaguucccuggccugccucugucuagaugucuugcagucucugcccccugccuggaggaacugugucagugccacagaggaggaggucaccccccagcaccggcucuggugagucgauaggaggcagaggcugggguugcugcccaauccucuuuccacagagccccagacauggcccugugcugaguagguccugggcagccaccuguccucaugccaugccccuuaugggccccuagugucuccucccaacccccugcagggcuuucuucccacuccccucucuucaaguccuucccacccgcuagcugaucuuccugugccugccauauucccucuaggccauugcuggaaaaagacucauccuuggaggcucgccaguucuucuaccuucgggcguuccugguugaaggugaagccucugugcagcugaugcuucccuggucucuguacccuaccuugucacaggcacuggcccacgcgcagcaccuguacagugcccuugcagcaacugucaguuccuggaaccuggagaaccucucacuugagggcauagcugaguaacagccucagugugcccugacccucugggugggguuaggaggcacccaggauccucaguuacccagagccuuugcucucgggcccaggcuuucuaugaaguggagcagcguggcugagucggcccugccucaucagucacagaaggagaggguggagccuuguuucugaguaggguggguguggggcaguggggggcgguaggccucagagguauuccagaguagagauucauggagcuugggaaagggagggucuuggccccaggggcacaggcugcuuugugacccaccucagagugugguucacaccucuucuccccagcagcacugggacgcuggccccagggaucugggccccuccaugaccuuccacacuggaugccucuuucccugcaggcccuuccaccugccucguaucccuguugcugacuccguccacccuguuccuguuagaugaggaugcugcaggguccccggcagagcccucuccuccagcagcaucuggcgaagccucugagaaggugccucccucggggccgggcccugcugugcgugucagggagcagcagccacucagcagccugagcuccgugcugcucuaccgcucagccccugaggacuugcggcugcucuucuacgaugagguguguauguguaucuccagugagagggagggaggggagauggugagcacagguuggggccaugagggcagggugggaaaugggucuaggaacccugggcauugguggcaggauggcacuuacagaugagagaacuaggguuggaggaacugggggacucuaggcuuggaugaauaucaagucagggaggcagcuguaggcaggggagacaccuggacugggagcccagccauuuagcugggccacgaggcuuucagugagguuuccggcagcuuugaguuggcaggauugggccgguuguaugccagccguuuggccuuugugaccaccaccugaggagauacgguuacugguccuauuuacaggugaggaagcugaggcuuggggauguuaaccaguuugcccaguccaaagugguggagccgggaauugaauccacaguucccugaaauugagcccgcaucuucuguacaacagggaagaugaaaaagacagguccucuggaggcuuucaguaaacgucggcuggauucuguuuacaaagcucagagucaggaucuuuuauggggagugacaugggccuggggaaggggagaggcacugagccaagguggagacagugaggccuucgcagagaccucccuuguacccacccuggugugguccccaugagccucgccuugcuaacugcucggucugccaggugucccggcuggagagcuuuugggcacuccguguggugugucaggagcagcugacagcccugcuugccuggauccgggaaccaugggaggagcuguuuuccaucggacuccggacagugauccaagaggcgcuggcccuugaccgaugagggucccacgcugaccuuggcccugaccucaggagccacgcuguagacauucccucuccuggucucugggucuggcuuccaggcucuggcuguggaugucuucagccucugggugcuggccagugaggucccaaaugacccagggcuuaagggagaggcgagagaaugaucuggccucaggggacaggccaccuggucaggaggaauauuuuuccugcacuuuuucucagguaucaauaaaguuguuuccaacucauaggucaugugugguacuuagagucacucauaaggccugcaguuccccuaaccucuucugacagaagcuaucccacccaucaccuuuccugaaugggcagcuccaagcagccuuguuugugccaugagaccccaucuccaacccaacuguggucccagcaugggagaucaaguagagcuccugacccacaggcacacagccccaagcuggcagugacuugucauguggcccggcauggaauugcugccaaacaaguagcugggccagauacgguccugcucucuugaacuuuacauggaaaguagugaggacuucaggccaucgcagagggugucuggggagaggguguguggaguugaguggugaccucuggugcuuccugccauugccuucucagcaccgccucacucagccuggaggccuggauggucagccccacucccucaccucuugucuccaagucuggccccagugauugguucaggaauccucaugugaauucguuuggcuuaugaagccccagcgcaggcauuugacuagagcaaccaagaaggaggcaaguuuccucucaggguugcugugaggauaagccuggagcugcuggcuguggggaggcgcuuuccuaaaguggaaccaugagagagaggaagauggcccagauggagagagcagggccagacucuggggauaucuuugaagccccugggucuaguugugcccgaagacagaaaccccugugacuuuagguaacaugaucuaaaaaagaagcccuccccucccuguuucuauggcuuaagcuaauucgaagcaaguaugagccaccaagagucccaacuaaacaaaccccgacuccaacuugagcugggcugagaucuguuucuuguacccaagaaugaacacaauggagaucauuacagccacacaguugugcagagaggcucugguucuugguuccgauucugaagugaggcagaaugauuaauccagcucacuuuuugugucaggucuauggccuugaccacuuugugacccgacugcuuggugggaacagcaguacuggggcugugucacuggggccuucuaccuggaaaggaugugggaaggguugccuggccuaaccagcccacuacaucucuaaauccauggggcgaacuuuuuaaaaaugaaaaagggucauugaaaauccuguacuuuuacauuuauuuaaaauuauuuaaaauguauuuaaaagaauguauacaggaaaaaaauguauacuguacuuaagaauguagagugaguugcucucauaugccugacccccuaacucuagauucaagcauucuuacccaauuuuuguguaucugcuuaaaaucucagugcauguacacaauuuuccccagaaaaggguaauuaagccauucacuuccauuuagaaaaaagauuggccgggugcacuggcucacgccuguaaucccaacacuuugggaggcugaggcgggcggaucacgaggucaggagauggagaccuuccuggcuaacauagugaaacccugucuuuacuaaaaauacaaaaaauuagugguggaggugggcgccuguagucccagcuacucuggaggcuaaggcaggagaaugaugugaacccgggaggcggagcuugcagugagccaagauggugccacugcacuccagccugggcgacagagcaagacuccgucucaaagaaagaaaaaagaugauuucuaagauuaguuucucccuggcaggucuggccugcuuuggcgggagaguagggggggaaugguaggagucauggaaccggcuaguugggaaaugcuggcugggguagaggccucuuggaaacagcugcagaggcugagggcccagaaagaucugugcagaggcccagaaaauaaauucaccuacuucuguuuugcucagaacugcccucaauuuuuaauugaagcaaauuaaaacuucccaaaaauau

SEQ ID NO: 12763 - RNA, 154314 nt, Homo sapiens
cuccuaacuuaagcauuuauuccacugggauagaagcggcaggagcagcguuggcaccggcgaaccauggcugggauuuucuauuucgcccuauuuucgugucucuucgggauuugcgacgcugucacagguuccaggguauaccccgcgaaugaagguaagagcgggacggccuuucuguggucggggacagcgaggggccaucgcgggugagggguccucaggagcgcagggccagguggugcggggggagcccagugugaauggugcgucccgauucgggagaagggggcugaggcgaggggaucggcgaaggggcagcggggaaccgccggacagccugccccgaggcggugacccgugcacgcggcgggucuguccaaguuuguaaccaaaggccaaaguuuaucagcauccgccagagaggcccgcucgaggcgcccugaggggaugcacgggagacaacgccgggauuuaaaaaaaaaauuacaagaaccacguccucuccugagccagcccggggcgaggggaaaacgcagccuggagcacagugaaggcuuggugcucccggauucuagcgaaagccuuucgagcucugguuucugcaaaguuucccgagcccugcgcuucucgggaccgggcugcggggccugcuccgcagcgcagcggucguggcgccgcucgucaggcgccagugaccugauuucuagcacccggagucagacaccuuucuccucgccaagcccagcgccccgagggugcgauugcgggccugaggggcccgagcucuucgccccgcagacuuggggaacccgccggcaaguugaacgcagucgaguuuuagcuuuucgccccagaauugcacacaguuuagagcuaacgugcggggucgacgggacccgucugggugcucaguuuucugugcauccguucggacgugcugggaggauuguaugugccugugugucugugucgggagguggggcggggcgggggggcggugaucauuuaguuucugagaaacccagggagaggcgaacuguguguguguguguguguauguguggugugugugugcaugucugcgugugugugcaugucugcauguguggugugugugcaugucugcgugugugugcaugucugcgugugugugccugugugugugcgcgcgcgugcaacugcguguauguaggugcgcgaaugccugcguggaagcggacgcggaggauuguaugucugugcgcagauguccugagugugugcgcguguguucgaguguaugcucgugcucuguuccagcguaugcuggugcucuggccugcgugcaucuagucucacauccgucucucauucuucuccuuuccggcauccaucuaucuauccguccguccauccgucuaucuauccauccaugcauccauccaucucuccgugcauccguccguccguccaugcauccauccauaaugcauccauccauauaucuguccguccguccguccauccaucccuccauccauccacccauucaucuauccauccauccacccauccauccauccauucaucuuuccaucucuccagacauccguccauccaucccuguguaaucuaucguuuucucuguuccgaaggagggagccaaaaaccaacuuagccuuggcugggcagccgguacccggagcccuccagacggaggcucugagagauuuauacaccugcccacagacaucgcuugggaggaaaggggcccucucucgcccucuggaucucccaucuccuuccgacguggcuucuggugguucuggugccaucucggccgucgccgccccucggucccuaggguuauucauuccccugagaggaaucguggaucccgcguucuccuggccacuucacacacuuguuaggacguccccugagaccucucucgccccagauguagagacuguuuucuuucuuuuuuuuaaacccccucuuuuuuugggggggggggagaaaaacuugggagcccaagacaaaaaggcucugagagcccuaggcuaauguugaaggggagggagggaggucuguuccccuccccucccccaccucccccuuaaaaauuaauucacuuuguugcuuucuauucccaucacguuuccuuuucucucuuuuacccucccuuucuacucccuccuuuuuuuguaaauugggucuuauuguuuccuuugugucccuaauccaccuuacauaaauccaaauggauguagcgggcuuuucucuagggacagagagaagagaaugguugcgguggggguuggcgguggggagaggagaggagggaagggggcgggaacuccaggcgggagcgacccagggaaggcucuacauuuuaaaaucauuaacagaccccaggaauucagacuccccgggaaaaguaggggaaagagacugauuuuuaacuccauugacuuugaggugaaaugagagggaaagugggcagaauccaggggucuggggguaagcuugaguguuggggugcgcaugagcacggauggcggcuucccauucccaccccucccccagccugaagagccagccuggcugaucaaauuaauaacccagugguuccuuugaggugggccuuucgacccccaggacugcagaucucggugggaaagagagguuuugaauucauugcgucccuuuggauguuccccuuaccuagcgcucuucuagccugagcgggguaccgcagcucggugggcuguccucccuuccccccaagcuuugacgcacucagguguagcacaagcacacuaaagccguuaggcagcacuccauaccuaaaauucaagccagugauuuccuacggguggaagacgagucucugauugucccccaacacaucuugagaaagagagaauacuuucgguacguuugcauucugauucugcacgucuggcauucccucuuucugaaacuuugauauuuaaaaaagcagcggauaccauauucagggacuauuuacuugguuguggaagggaaaauguuagggagagccuuuuccugacccuuuggauaggauacucucugauagaagagagaauucacuuguggcucugucacccugaugaguuauguggucaucugaaacuugcaaaaacaaauaauucuaguagauaccagacagagaugaaugcagauuuugcucuggaguguaacugcucuacauagauguauuuaucuuuuugaauuguacuucagauucucuauucauccuuuuuagaaaaaugaaucaagugaguccuaggauggaauuuuaaauguuaagcaaguugaauaaauaagaaccugcagauuuaaagagggggagaagaucaaaugaguaaugauuauuuacauaagugagcccaaguuuagguuuugaucaguguuggauaugcacagccucagcacauauggaaacgcucaggcaaaugguuuuuguguuauuggcuuuuugcaauuggaaauucaucuauuuuucuuuuguuuuuugcaguuaccuuauuggauuccagaucuguucagggagaacuuggguggauagcaagcccucuggaaggagggguaaguccugaguugcucucugauccaaaggguaaaaaaggagugauuagcaacuuucugagaguccuaauggcuugauucuuguugauuguggugagggggucagauuuccgcuguggccuaugaagugaauuacgcuuuguuggagaaauccuauacucccuuuggauaacucugucauggaagaacuagaaaccaaaagggcagaaagggguuucaaaauuaggagacugguggaggcacagacuuagaugccuauuuaaaacuaaaauaccaacaggaaauaugauccggggaccaaauuagaauuuaugccuauuacugugauggccaugaaguccugacaagguuaauuuaagagcaauuguccugcuuccagaugaaaaaaaaagaauaaauaaagauaugagagagaagacauuucuaauuguaccugcaugaacugcaggaaggcucuguaccuugcucucacucuuaaaucagcugcuguucuuuugcacacugagagacagucaugugaacuuguguccaaaaaacccuaagccuguguauuaauggugcuaaauaugaaaaguuuaugugucuguaaucuugaagaaucuuuggggauugaguagucuggauuauaaggucugaaaaaagcaucacuucauuuauucucaaauuuguaauacuugucauuacugccuccaucuuacuaggucaacggccacauucuccuacucccccuaaauaaccagucagaaugaaucagcuuuggaaagaaaacaguacaacauguaacugacuucugccaaacugaaauaacucucaaauccuuuuaaaauuaaacaaaucauccuaccuucacaggcuugauaguuuauggcugaguccauugauuaaaaacaaugggggugaaagauuaggaguuuuuacuaggcaaaaauuguaaugcuagaaccuggcgugggcuccacaccgguccauugaauaaagaaugaaggauuuuaaauuaaagauucauagagucugcuaucaaggacauauuucagaacuaagacuaagcaagaaaauaaucaugaaaauggagaauuuuaggcugucuuguugcaaacagauuuuguaauccaccugaaauaaaacagauugcccugucuuccuauuuuuucugccugaacuugacugccauugguuuguucucuccugaaaaauuccagucugcccuuaaaaccaucuuuuuaaaggagggaggagugauuggcaggccucuggcaguguagacaggcuguauucaccacugauugcaggcaauugcccucauccuuugaaugugaagaaagguacggcuuuaucuuggugagagucagacucauuguuaauccuauacccuggaaaggucacugauucaggcgaggcuuucccaggcuacauguaccagggguauugcuugguagguuaaaauguauuagaacugcugguaaaauuaaggauggaaagugucaguacuuguauuaauaaauucagugagccuuauuuuucuuacuggcugcuuuuaaguuugaagagaguauauacaucuaaucaaauuuugaaccugacuuguuucacuaaauauaugugugagcuauaugacagcaaggacugacacauuuuaggguacaguccauagucuaucuaguuucuggaaagcuuuuauugcaauuuaauaugcugcagacauuuuuuucuucuucuucuucuucuucuucuucuucuucuucuucuuccucuuccucuuccccuucuccuucuccuucuccuucuccuucuccuucuccuucuccuucuccuucuccuucuccuucuccuucuccuucuccuucuucuucuucuucuucuucuccuucuccuucuccuucuucuccuucuccuucuucuccuucuucuucuucucccucuucuucuucuccuucuucuucuucuccagagcugcugaaagagcaccuggucacuuuuucuagacacaaaacuuaucuugguugacuugaggucuauuuaaaacuaugcagagcugacuguauacgacccaguacuuuuaaugggcuggauauaagcagguuuuuuuuucuuuuccuuaaauauuaggcauguaacauuuuaagcauuauuguaagauaaauaauuuuauuuguauauaaaagaauuagucauuccaaaauacacaguagccauugagaaauugugucaaguuauaaaguuuaauuaauuucuagauuuuauaauugacgaggacuuuuucaggauuagagcaaaggaaugaauuggguaucugucaaugaggaauggauugauugucuuuaaaaaguucuuucuagcugagaguaaaagcauauugagucuugaucauucuaaaaucucugcuugcaguuaggacauuuaaugucuuuauucacuguuaacuugagauaguaauuuggucugauaaugacauuuauuucuuguuguuauguuuaaaaagaaaaaaaaacaacuugauuugacaauaccaccaaggaaaauauaaauuagaaucagagacaauccauuguuugucuauaagaacaacuaagcaagacaugagaauuagggaaagugauggcuccugauaacaucguuguagccaaaagcuacuuucuugguaauauucacuuaaaagaguauauugaguugcugacacugacugugaaauauaaaacuaagggaggauuugucacuguuccagugaauugaucagugugguuagacaauuacguucaggcugcaaaguucauauuagaccugaauuauccugcaugaacucuguagagauacccuaugugccuucauugacaaauguguuuuuccaaauucccauuguucugagaagagaagcaugcugaguagguguuuuugaagaugggaaucuauuuuuggauuuacaugaauuuccuaaaauaaguaaauuacuggugauuuuauugcuuacuggauaaaaagaaauuuucaucaccacagggcacuuacccccuccuaguuucaacuuuuauaaugguggcagaugaaaaggauacagaauuuuauggcuuaugguccuucacauaguaacauuuccauccauuaagaguuugccagugcauaguugggaaaccuauuaaaagauacauuaugauucuaugcacuucacuggacugcauggagcuuuaccuggagcuauuacagaauacaauuuuuuaaaaaaacuaucucuuguuccuucuaauuauauucauauguuuguuaaauacuuaagcugauuuauaacagaucuguaucaaugcauuacuguagauguuaaugaagaauuugaggcugccuaccagcuuaguaggagucccaaaaguuuugcugcuuuucggauuauuuuuaaaagcuauaaugacagugaaacuuuuagucacagugguagacgcaaguuguccuaccauuagauucuuuguguuaggaaguggaaugcaaagaaaaugcuaccaucuccuuucauuuucuugggccuucagucauaaacagcacuugcuauuuuauuuuuaauguccacggaagaguuagaagcaaagcaugucuguuuucuaguuuuguuauuugucuauguuuuaaaaaugagaacauguacaaauuuuuuaauugaauacacagucuugaaaaguugucuacuguuauaaaugauagcauauuugagaaauccagccauaaaauuuacucccugucuuccuaggauuacugaaaccagaauggugggauuuucuuuucaccuuuaaagaguagugagggugccaaaaaaaucaauugccuuuuuuuuuuuuuuuuuuuuuuuugagguauuagagagcaaaguucugacaggagcacuacuaauuaacugauaauugucuuccuuuggcaagcucugcucuuccugcccuuaauuugcaggucucugcucagugguugaaacaauacccauacuaguuuuuccuuuaugaguaaauuugaacuguugccacuugaaauuguagcuguuguaauaggugaauuugagguuguuggaccaccacaaggaacugccgagaacucacaagcaguaaauccaccauugccucuggauuucaggcaaaagauugaaacaauuaaacaaacaaaaaaaaaacuuccucaauaaaauauugucuuaucucccauaagauccuuuauuagugaugauuggugcucaguaguuugcuucauuauugaaagaaaaauaaucagguguccuaugagaauaaaaugggauugacaaaucacugcaugaugaaacuuuguaguugauacaucugcuuuggaucuuugcagugggaggaagugaguaucauggaugaaaaaaauacaccaauccgaaccuaccaagugugcaaugugauggaacccagccagaauaacuggcuacgaacugauuggaucacccgagaaggggcucagaggguguauauugagauuaaauucaccuugagggacugcaauagucuuccgggcgucauggggacuugcaaggagacguuuaaccuguacuacuaugaaucagacaacgacaaagagcguuucaucagagagaaccaguuugucaaaauugacaccauugcugcugaugagagcuucacccaaguggacauuggugacagaaucaugaagcugaacaccgagauccgggauguagggccauuaagcaaaaagggguuuuaccuggcuuuucaggaugugggggccugcaucgcccugguaucaguccguguguucuauaaaaaguguccacucacaguccgcaaucuggcccaguuuccugacaccaucacaggggcugauacgucuucccugguggaaguucgaggcuccugugucaacaacucagaagagaaagaugugccaaaaauguacuguggggcagauggugaauggcugguacccauuggcaacugccuaugcaacgcugggcaugaggagcggagcggagaaugccaagguaagaggguccauauugcaguuuuuucacuggggcuuagugcgaguaauuaaaucagagaugagacuaaauggaguaaagccaguaauuaguagccccugugggauguggugggacacaggggucuaaugaguaagugcuauagcuccagguggcaaagcuaagacguuucuaauacugacaaaauaaaugaugcugcuguaaucagcagaaagccaaacacauuugcuaacaggcacuuauaucugaacuggcuugaugcgcccucugaaauguaaaugaacaagcugaagaaacagccuugauugauccuuacuuaaagagggcggacacauuuuugagccauaguuuuccugucuauggacuugguaaaaugacaaagauuguuaaauaucucccgucuucugcauaagugcgugaaugaucuaaaugugaaauuaggauuaaguuguuccaguucccucccacugacuaaaaucgagugaagaaaguccauuuuuucuuucugccuuguggaccgguggagauaugacccaacaaaguggagggacauugcuucaaguacauucuguucccugaacacccaccgauggguucucuaaaugaaauuaaucuugaugaaagaccucuuuauuucucuuaggaggugguaauuaagcaagcaagagucuucuuauuugaucuguggucagaagcaauagcaaauugugacccaauuugguauugauuucaguuauugaguuuuugaagaaaucuauguauuuuuaucacauuaauuacuacuuaccauauuacuaaguggauuuuuuuuucucaccucagguucaguguaugcaguugauucuugcuuuuuuaccccuuccugucagaauacuggggaguguauaaaguccuuugcuuuacagaaaguuuauaucugaguaagagaugagaguaauuccuauuuauacagauuguuugucaugugugaaauaaggcucaaaaauaucuuuuauuccaaguuuuugucuugcuugauacuuguuuuuauaauguaguuaucaacagucugcggcugccaauccauuaugguuacuacaaaauaguuagaauguaauucuggucucaucuauggaacaaucagauuaaucuuuucucuggguaauuguugagcuguagauggcauugccacaugguucaucugauuuggugguuaaagggccugaauuaacugacugccaaacaauuugucuggcauuucaaccauucuaaugacagggugggauuaacuauggggcaauccacuugauugacugaaaauccaguuagaacaugaagaaaauugcauuuuuuggugauuuggugucauaaaguuacacguuacuccauucauaguuuacacuugucugaaguggcauuccugcuuagcuauaguuauuucuaggaguaacuaacagugaauguucuuucauuuugugguaaauagaaaaaagaguggcuaucuuuucuguugacucaguguuaaaaauucaaaaaaaaaaaaaggaaauguguaaauuuaaaaguuuacaaguuggaauuuaaggauuuuuaaaauaaagauuaaggccucgauuuuugguuugcucuugacuuagcaacuacuagauaagcuguacugaauugguaacccaaaguauauucugguauuaauauaagaaaauaugugagugcauuguuacuggcaacuaaauuacuaugaucauagcaggaacagugaaaugagcagggcaaugacaugccaucacauuuuagaguaaauuauucugccuuuuccguuuuguaagacaggagccgcacaucuucacaugucaagauucuuauauauauuuuuaaaaaaacaacauuggcuuccauuuccugcuaaaauguucacucucagcauuagcacaucuucguguaucuaaugucauugauuuucaauugucacagagccuaguaacucauacauugcuacauugugaaacuccuugacauuuuuacaaccaaaauuagaaagaaaagagaaaaagauggugggcaaagugaauauaaaagcaaucgaacauuuuucugguuugcuuuauggaaauagucuugggggauccaguuaaucacgugcguccucgaaggggaggaauuuaggguuucaaaucuaguccacuuccgagcaagcuguuccuaacaugaggccagauauuucacagcagaagcagguggauugagucguuuuugagaaacuucaguguuuucaggugugucaaccaaguuuguuuuuguuuuuuguuuuuguuauuuugcuuuuuuuucugcuaauaaaaugauuaacucuuucaagacacuuuuugcacaagaccuugcacuuugguuguuuguuucuguuauugccauguaaaaauuucugauguaguuagguaagaaaaaacuugaaugacaaaggauuccaagcuugagugagacuuuauuuauuuauuuauuuauuuauuuauuuugagauggagucuagcuccaucgcccaggcuggagugcaguggcgcgaucuuggcucacugcaagcucugccucccggguucacuccauucuccugccucagccucccaaguagcugggacuacaggcgcccgccaccacgccuggcuaauuuuuuguauuuuuaguagagacgggguuucaccguguuagccaggauggucuccaucuccugaccucgugauccacccgccuuggccucccaaagugcugggauuacaggcgugagccaccgcgcccagccagagugagacuuuuaaaagaugacuugagacucuaaaagucuuaggaauaauaaaaacaguuggcccuauccuugauaucaugauaggcaucaagaguagcacccaggcacaguggaaauaauauagagacgaggaaagauguaugaauuuggucacuuagcuagaugaccuugagcauguuucuuaagcccugugagccuugguuuguucauccauaaaaugggaugauaauaguuauauuuaguuuacagacuugcaaugaggacuugggguuguaagauugguaaaagucaccucagagaucaugcaacaacuugauacuagcauuucuguugucauugugcucuucccaaggucauagcuauugacuuuuaagagcguugaguugaaauaguagaaggaaaauccauccccugaccacuccuugauaucaaggcuaaagauaggaagcaucucucuccuuugcccuaacaaauaauaauauacguuuucacacuuuguauugaaaauauuauauggaguaugucauuuuuuuuuccuccucgauaggaaagagaaacuuccuuugaacgagcaaaaagugacuuguggguaggacaagaaagaggguguaaagaaagcuuaagaaggaauauaaaggaaaacuggccaagucuucagaacucuggcagcaguuuccuccccaauugucuuuucaaugguucuacuguggcaggacaaauagaagaacaggugaaaggucaccuacuuccucauccaucuuccuugggguccgggaggucagagggaagauugauuaagaucuuaaauguuugacaaaggauccuugggcaaaaaugggcagggcgggcgggggccuggggugugcuguuguuugacucuaacccugaucauccacugagucgucaaaggaccuuggggacagaacuacacuuccucuugcaguuccuacccccagcaguacaugcuaauggagaggaaggaugagggcagggggaugguggcuuugcccucugaagcagaggcaaguucauucugcucuugaauaacauuuucugaaaugauuuggcuuggucucaguagaacaacaauguguaugagcuacuuacccaucuucucaaggagaauguaucgcaggaguuagcagcccuuugaacuugccuagugauuggaugcagaggauaauauaaugauucuaguuaguccugcuuccaggccacaucagacuguuggaaaaaggaaacaaaauccacuucagacaucuccuuccggacagacauaccccuaaugaagaaauguuccagauguuuuacaggacuguuuucauuacuuuagaaauaguaagcagaaggaagagaggaaaauauuccauuaaauuuuuuuuuaauuuauuuuuuauuauuuguuuuuuaacauaagagaugaagucucacucuguugccuaggcuggucuugaacuccuggccucaagugauccuaccucagccucucaaagugcugggauuacaggugugagccaccucacccagccaaaaagauucguuauuaguguauuuuuugcuuaauuaaaaagcugaaaaaugaaaggagagcuccagauuuucucuuugggaaauacuaaucagcaguuuucagagcauacauauaaaaaauaauaccaauaaaaacauucuuuuggagucacucuuaaggccaaaugauuacaacuaugacaaaauuaagcuagguaagaaucaagccuugcugaaguauacaauuuuguuguauauugaggucaucaguauuaaaauguacucauaucaacaaaagguaucguauuaaaagcuuuuuaaagaaagaacaagauagaaauguuccaaugguuuuaaaauaaacagacuugugcucugaaaagaggaagagagcuaugucaaaaaaaaugauuucuuuuuucaacuauacuauagaaggagcuuaggagaaagaaguaauggaaaggaaauauuuaaaaucuacuucacagagaugcugcuuccauauccuuugcacuguugaaauuuuuccucuaccuuugaaucguaucauuaagaaucaauugcuugaaucacauggcugcuuuuaucuccggcuuugaagcauggcugugaucauugaaaaaauguaauucuuuaucuauaagagagcagcguuuaauuauuguccuuuuucugauauacuuuuuuuuuuccucuuugugugaccaggcugccuuugugagugugaaucaugcaauagucucuauuugggguucaccaaaacaucgcauagaaaucaucucagggauuuuugaauaugguauucaagauuugaugacuuauuuuagucuaacugagcuuccuuguaucuuucagaaaugaauuaacacauaauuauucuguuaagaucugagccucuaggaaaaagccuucuuaagugguuuuucaguuacugcugugcaaagcagggguggucaugauauaaguuugacuuucacauaacugaacuuuacuaguuaauggcggggggugggggaacggguaauugguaaauuuaacauuagcaaaggacugcaugcuugucagauaaauuucucauauagaauuacauaaaguaaaaauuguaagucuaccauucccugcccacacacacacacacccacauccacccauacauacacacacacaguuuucaaaagcuuacuccaacauuuuacaaguuaccauuuuucacaauuuggcaggcaacucaaauauagccauauacauguauuuuuaaaauaauagauggaaucauccuuguaauugucauccuguuuuuaugaugcuugacugucauagauaucgcuguauauuagagaauauagcuuuucuuaauucuccuucauugaagaugaauauucuguaguauaaguauaccaugcuuuauuuaauguuuucguuauugguagcuaucuagguugucucaguauuuccuaguaauacuuuuaaacuaacacauuaauguguaaucauacauguauauuuuuguuaaaacauugaaugauuaaccuugcuuugcuauuuuucugccuuuaucuuggacauaugaauuuaguagaacuuccuuaugagaaugucaguggggggagcauuaggcauaaccaaaguaguaacaucgauuauuugguggaguuauguuucauggaaucaauaugauauguuaaaaucuuugcaugugacuaauguauuaaugagguccuuguucaugauuucuacucaauuggguccuuuuuaaaucguguuuaugaaucuucuuuacaucugaaccuucaaaauucucugcagcacaugaaguuaacauacaguuagcacaaaauggccaagaacugccuuuggaguugagccacuuaaucagaugugcaauuguagacacuaacuuagcuucccuaaacucaaguucacguuugcaaauugguggcaauaguaucuuauuauauaugacacacauauaugcaugaauguauaaagggccuggcacagugccuagaaucauuaaaaugcuuagaaagugaaaauuguuacucuuauuuuuauuguuguuagauagaaauauggugacaauaugggcuguuugaucaauccaacaaagaaaccauuucauuuagguuccagaguagagaguuuuuuguuugguugguuuugaucuucugaggaggcaauggugacaaauacagggaagagugaagcgaugguaccaaauggcuggucuugucuacauugauccaauccucugugccccaagucacugugguucuccaugugguccagcuauguuccccaagacccuuucauguggucugcaaggucaaaacuuucuuaauaacacuaagauguuauuugccuuuuuuuucuaauucucucaugagugaacaguggaguuuuccagaagcuaacugauguaugauaauguuauuaaguugaauacagaagcaaauacagugauccccuuuaacuuuggacgauauguuccaagacccucaauagaugcugaaagcucaaauaguaccaaacccuuauacauuauguuuuuucuauacauauguaccuaugcuaaaguuuaaguuauagauuaagcacaguaagagaaugccaacaacaauaauaaaauagaacaauuauaacaauauaucuuaauaaaaauuaugugaauauagccucucucuaucguuuuuucuaucccuuucucaaaaauaucuuacuguacuguaccuucgguaggcaaaaccacagaaagccaaaucauggauaugaggagacuacuguaaaagaaucugguuguccucuauuaagccagacauucaagaauaugaaaaaaaaaaguagugacugggcgcaguggcucacgccuguaaucccagcacuuugggaggcugaggcagguggaucacgaggucaggaguuuaagaccaauauguugaaaccccagcucuacuaaaaaaaaaaaaaaaaaaaauacaaaaauuagcugggcaugguggugugagccuguagucccagcuacucaguaggcugagccaggagaaucguuugaaccugggagauggagguuguauugaaccaagaucucaccacugcacuccagccugggcgauacagcgagacucugucucaaaaaagaaagaaagaaaguaguaaaacaaugucacuuuucucacuaaguuuacuuuuguuuuggacaacaguguuuaaaauaugcuauuuguguuaacaugcaaugcguuaauuguuauuuuucaaugaauuaaaaauaauuuaaaaauuuauuuuucaguuucaauuuguauugguaaauauuaguaguuauaacucacacacacgaaaacauucucaauaauuuuugagaguauaaaauguuugagaguucgguucugaggccgaaaauguugagaacuacugcaccuaguccaucacuuuucaguuucuuuggaagguaacacagacugcacuucugcaggucauggagaggcuuuaaaaaugaaaaugaaaucaagcccuaaaaacuuuuucauaaucugggagacuuagguaguuuagaagaaugacauuuuauuuacucaacccuuuagacauuucuauaaaauuaggcagcaauuuauagcucuuggcuuuuuaaaaacugguuaucuguguccaauaacauggcucagugcucccuuuaguuuuacugugcucgugagaaggaaugauuaaagaaggccucagcuguccccuguaccccgagagacuguaucucacuuaaggcauaaaagcuuucucccuguauccuguuacagcugguaccucugagcuguuuuggggaggagaacaggugaggucacuugguuccaugaucuggaggguaauuaagaaucccaugacuaaaugaacauuuuaugaauauucagggucuauuucuuuuuccugggaaacacacauguugguacugcuuacaacucccuuuggagaccucagccuuuucugggugaaugcaggucgucagcugucugcccagcccugcaguuccaggcagcagauucuucauuugcauauucuguauucguccucaugcaaaacagcacacccauuucccccuuucacaaaggcaaugagggcuuccuuuggaaaccccagccaaaaucuccuucuguuuaugcagagcccaaugauuuagacaccaugcaaauuaauucgguuuugauuugaaugcuuccagagaucaggggugggaggcagagaggagacuauuugcacagggcucuuuuuaugcaccucugcccccaguguggcugguugucacucuccggccccccugccccaugcaaaauaacccaagucccugcugcucauuucauuuugaccuuuggaaaaggaacccagccuuggugaaucccuuggcuugucuguuuagugacagcuucagcuggaaucuugcuguucuuucugaggugggaggggauggcacuauucagauuaugcuaggaauguucagaugugucccaacaaagggcuuuaaaaaauuguaaaguaaaagauacaauucuuugaaaaagaauugucagagcucaggaaguucugaaaauaggccuuaggucacuaaugggcuggaguccauucaugccaucagugaguagauauuuaaagucuaugauguacaaaucaccacugggauuuucaucuguguuucuucaucuaugaacgaauacaucaaucuucauaccuagaaucacaauuaaaauuucauauuuucacuuauguccccagauaaaauucuuuaaaauguguauugacuauaauucuguuucuuauuauauuuguggauucacuuuuuguugaauauugucuuuuguuucugucucccuccuccccacuccccccagugucuccaaauuuacuuauuuuuuaaccuuaccuuuauuccuucuagaaugggaaggcaagcguacugcauauuuuacccaacaaacuuaacucugguugaaaccagcacuaucuucugaaaggccacgaucauauaugcauucuauaaacuagaagaagaggacuuugcaugaaauguuuuugaaguucaauuagacuugaguucaaacuaauuucacagagcagaaaaugggcauagcuagacguugcagucuaauuaaguaaaagcaaagucaguuaaaacaacaucuaaauguggaagagcuuugguuuugcuccacauggucugacaaaguuugaugaugcuguucaaaguccauuugggauggauuauuaggauuaaagagcagcagaaugcucucuguacaugguguguucccuggugucauuagcggaugagaaaauucagcugcuuaucuggcucuuguuucucaggauggauuuaaacagacccacacuucucaaaggugaucuuacuaaccucuucuuaauaaguuacagaucucaaauugcucaaaauccuuaaaauaccauuugaaguaaguugauugauaauuaucauuucccuuccguuuacagauauuuucugcaccaguacaaagcugugguacaguuucuuaauuacccagauaauccuguuugcuuguauuuuuaaacuaugaagugcuggguaauuauucaauucuuaauagaaggcaaauggcaauguaaacaauaauuaggauguuagacagacuaaugcgcuucaaagcaaauuggauuuuuuucauacuguucagcuugaagucccauaaagcuaacaauuuagaagcaaggcgaaaaagguuccauguuguucauauuuuauggcguuaucucuucauggcuuguuucugugaauagcaguuugccccaaugaagcugccugugcccaagccaaauguuucuguaacaaucgcuucccugcuguuugacauuuggcuauguucucccagggcuccagauugggccuuugucugcuucagaucugaggggucagagguuaacagaauacugauuuccuccuauaauaccauggcagguaaauaugggccaaccucaugaucaguuaagacucagcucaguuaggaaugcuuuuucucuugggcuuuuguccuuaagaacuucccugauuuaagacuucacguuucccagcuauugcuuuccacaguggauucuucauuaggaucgcagcugucucuuuuaugugacuucuuccuuuaauaaccguucgcaacuaacuauccccagaaauaccugagcugaaaacuacaagcaaauuauugcuuuugaugaaugaauuuuacaaacugaauaugguaauacuuugcaaucuuuaggcccuuaauuaugucuuguagucuuaucccuacuguauguuucacugaugaaauaauaaacugauaacaaaggcaguaaacaaagauacuuuuauaauguggcaauuccccaaccccuccuuuuucuugucuagccucaugauguguugccaguuagaggugcaauuaaaugaacaaucaguuuuauuuuccauuuucaucacuuauggagaggcccaaguauucaucaauaucaauguuauuaauguuuuacaucaguuuaauuauaucagccuuaauuuuucuuccauagacuaauguuacuaaauagguugcaucuuaauugguuaugaugcauucacaggcuuuagacauuuaaaauacucgaucaaauuucucgaucaaaauucaucaauuaauuuuaggacaucuuucuacauauuagcuauccuguuuguguuuggccaaccucucuugcuuugcacugugaacuugaggcuuggauucauuuguuuucagauuuaaguguuuaaaaaagacaucuccacuuugaaaaacaguuuccuuuugaagugcccagccuggcaauggcugaagcagccccaggcaaauuaacauguuaaaagaauggaucaauaccuuucuggcuccuuuacccuccucgcacucuuccaagggagaagaguuuugaagaacccuaggaggcccuugacagaggugccaggaggcuucaagaggacugucaguagcccaaguggggaacauugacagcuugaucuagugcccagaucgcuucuccgcuggccauuugaaaauggaugcaagaggaauugacagcuucaggaaagcuuuagccguucauguaauuauggagaggauuagaagaaaaguguugggugacauaagagaucaauacaagggcacuaguugacugaauucaccuuuagcuguuagggcacuccauuuuguaauauuuagccugugcuuagagaagaauguuugauaggcuuguuuauuuuuuuagggguuguguagaccuaugcauaagaaaaagaagacauaagcagccucugguuuuugagcguggacuuguagauaauuaacaauguaaugcuuccaguccuuagggugcaaagguacuaauuaacuaaugggagagauugagauuucauuacuguguucuuuaaggaggugccagcaaagaagugcaguugaaaguaauauaugaauauucagguuucuuuuucaaacccuuucuuuuagaauugccucucugcuuguauccuagaguuuaaaauuagcacugauacacuaaaccaagguaagagugugguuguuuuuguaagaaaaaaaaacucauguugauggagaagugaaaacauuaucuuugcaugaaugaaaagcgucuuuaaaagauuuggaaucaaccacugaauggucucaaaugaucugacuuuuggaaguuuuccuccauaggauaaagaauggcuaguguacuuaacuaaaauaagcccaaguaccuaauuuauucuagccuucauacaugauucugggauucucuuguacaacauguuggagcuacaacuuuuucaauaauuuuaaaugguuacugaauaugacaagaauccuacacuauaauuucagcaauuguacuaaaacuuuuuaaaaagcauuguuagaucuuucuucuagagaaccauaaaaucuuuuacugaagagaaguaauguuuuaccguaugaaaaucauaacuuuuauugcaacuuugaaaacuagauacacuaaaaagaaccccuccccaaaaaggauuguugacuucuacaagagauagugauuagaaaacacaacccauugaguuuuuccaauauuuucaauuauaucuucuagcugguuaucacugaucuacaggaaagcuauugauuuuuguauguuuaucuuacauccaaucuucuuauugaacuaucuugugaauacuaauaaguuuucaguuaauucuccggaguuuucuagagagcaaauaguuuccauugcaaacaaucauauauguauuuuucucuuauuuaaaaaauuaagccucuuauuucaaacuuuuauauuacaacauuggucagaauuuucagaccaauaauaaauaauaggguagauugugaacauccuuaugaccaauuuuaauggauauaacuuaacuauaauaucagaucuauuuucuuaauaucauauuaauuuuaaacacuucucagaggagugaauguugaauuuuguuaaauuuacauauuuaucuugguuauguugcuuuuuugguuuguuguauuuuguauuuaugagaucuaauauauuaguagauuuuuucucgugauaaaccauaaacucucuuugcauuuguagaaaaaaaaaagccuuauuagauagcagugaauuuugacaaauucuuuugaauucaguuuguuaauugaaaacagugauuaggagccagaacuuuggaauaccaacugaauuuuaaucucagcucugccacucacuaugugacuaugggcuaguuaguaaacuuuaguaauuuggcuuucucuucuauaaaaugggaauaaugauaccuauugcauggguauacuuaguguuaaauaagauaauauaucuaagucucaacaaggaaauggugucuauuaaguguucaguaagugucacaauuuuuauuguuuauuuugaauuucuaauaaauauccaggugacauuagucuacauucucucucucucucucucucucucucucucucucuccccuuuccucaucagguuuugguacuauaauugauuuauaaaauuaaaauaguuuuacauuaaaaaauuagcacuguagaauguuaaugugcaugagaacuaucuuuucuuugcaaauuugaaagauuccaccauuaacacuggcucuggacugugcacuuugaauuggggcacuuuucucuauauuugcuagacuuuaauaaaaaguaaaauaaccacaacaaagaaacuaucucucagaccuuguucaguugcuuuucaaaucacauauguagauuuuccagcccagcguaguggauaaguucuuugauuugguaucuuuuuagccucuguuucuuuuacggugaacagcaaagaugacacauugcucucauccauaauuacauuauugaaauuucucauuacuuguguaguuuuuguuuguuuguuuguuuguuugagauggagucucacucugcugcccaggcuggugcuaucuuggcucacugcaaccuccccaucccugguucaagcaauuccccugccucagccucccgaguagcugggauuacaggcacaugccaccaugacuggcuaauuuuuuuuaguauuuuuaguagagaugggguuucaccauguugaccaggcuagucucgaacucuugaccucaggcaaucugccugccugggccccccaaagugcugggauuacaggcgugagccaugugagccacugcgcccggcuuugggcuuuguguagaucuuaaacaugcgaauuaaagguaauggguuuguuaaacucaguuaguucauaggcaugguagagcuacucuuuaaucaggagcccuggcugccaaugagaauucugguugagaaaauacuuaauaucccauuaggggaagcuacuuuucacugcagagugaauguggaugcagccucucugagcuguggugcuuuacucuccuuuuuauugagagaccaacagccagagagagaggggagagugaaagugagagcaagaaugagagagagagaccaagaaauaacuguuuggagacacaucuggugcuccuuagaucagcaacuuugacacagcaauuuguaaauacuuuacauugguuuugaggauuggaaaguuucauuuuucacauaaccacacaaauucugugggccacagcaggcaggaugaagaccagaggacaaacauucacuggcucaguauaaagaagaacuguuuagcauuuugaacuaggcaagaguagagugugaugcuuuuugaggcauauuuuuuggauguguucacauuggcugcaugaccccaggguaccuaacagugaaagauuggagguccuguguuucuuaaaaggagcaccacuggcauuuuggacaggaugauucuucauucagugaaacuccaugaagaauggaguuuuacaggacucccaaguggcugggacuaccggaguuauagagaauuuaguagcccuaguagucccugagcgguaaauccuggugucguccucagucauuuugacaggccaaaaccugcccuugcauuuugaaauguccugggauggaugcuaaucucaauuaugaacuucuagacuaugagguuacuaagauucuaagauagaauguugaguacucugcuuuggguauuucauauauccuuggguagacaaucuaggucuaagaucuuguaacauagaaaagauggagaagcucuuccaacaaucccagcuagccaucucucuuucuuauuuuuauuuucccuaaaucuaagaguacgucauaauauuucaaaaucaauaucauguuuccuccauguauuagucuguucuuguauugcuauaaagaaagaccugagaaugggugauuuauuaaaaaaaaaaagugguuuaauugucucaugguucugcaggcuguacagaaagcauggccucagcaacugcuuggcuucuggugaggccucaggaagcuuuuacucaugucccaaggcaaaggcgaacaggcauucacauggugagagugggagugagagagagaaggacaacgucccagacucuuuuuuuuuuuuugagacggacucucgcucugucgccaggcuggagugcaguggugcgaucugugaucuuggcucacugcaaccuucaccuccccaguucaagcgauuccccugccucagccucccaaguagcugggacuacaggcaugcggcgccacgccuggcuaauuugucccagacccuuuuaaacaaccagaucugugugaacuaacugagggagaacucagucaucaccaagaggauggugcuaacccauucaugaaagaucugcccccaugauccgaucaccucccaccaggccccaccuccaacacugggaaucacauuucaacaugagauuuggaggggagaaacauccaaacuauaucacucaauaaacacaaauugaagaagauaggaaauaucuuugggaagaaauuauuaacguuucacaaaaguaucuggaaugaugaccaucagccaagugcucuaccaguuuuaauuuauuucauccuuaaacagccuuguaagucagguacuguuauuauccccauuuuuacacauggaaaggccagggcacgaaaugauggauguguuuggccauguauacugcuugacaauuugaacccagauagacuggcuccagcuuacacacuugagaacuguuagaaagaaacuuucccccagugccuugcauucuuauauaaggugagaagaguauuuaaaaaugccugagugauugacuuguuaagagugccccguaauuauucuaacauuuuucagauauucaccugccaauggguggcccuuguguuauuuugaacggccuuacaaagagcaaaaugcagcugcaaggcuggagaccuugucaaagaguauauuacugggcaaauuauuuuuauuuugacucuguaucacagcagaaacagaugaucccuuuucuuuucaacuuaaguaauugggaaguuacaagcauagacccaacuugagaaaagacagaacaucaucucaucuuagcaggaggacagcuuaaccaaaugagaaguuuuggauuucucuaaugcuucuguaauaaaucuagagagauuuagaaggaaaaucaaucuuaaaaugagaaugaacuuuuaauaaucuaaauguuggguaugugauuuuuagcugauucagguagaauauuuguuaaacguuuacagaauaaaacaauggcaaugaaccaaccuauuuggaaagcaauccauuuaaguaauaagaagaaaagggaaaaaagauggaagaagcaauugcuguuggagguacuugucacuuccuguagcauccacaaguacuuucucaccuuccccuguuguauugcuaccuguggcuucaguggaaaugacucaccuuucagcucaguagagccaguauauccugaauuaugauagccacaaaaauuuguccccccccuuuuauuuuuuuagccucuuagcuauucagagucagauuuucuguuucuuguaacacaacccuaauuaauacaggaggcagcauuauuuuaacaggcagacuagcuaucuauauacaaguauuucacauaugaaacacgauguuugcccagggugaguaguuguuuuuccaaaagauuucuuuauaguacuauaaacaauggggacaucuuaaaugguucuuuauugucuuuucucagccuuauggcaagauagaacaguuugagucacugacagaggcagagggaaagccucuucuaagccauagcuuagugaagcaaaaaaaucucucuuuauagccuuggagaauauuuaaaugggaaggaccuuagaaauccuuuaguuaguucaugcuucucacuuuacagaugaggaaacugaggcuuaaauuaauaaaauauauaauaaauaucagaugggaagagguggaggggaaaaaaggaaauaaaagaaaacugauaaaaauaaaaaagaaaaaaguauauaauaaauauuaaagacuggugcuuuaauuccggauuuuuugagucuuacuuucuugguaguguuaaagguagaauaagcucagaaaacacaugggcagccgaaggcaaaguugcaucuguguaucuuugaaggaggccuugaggagugaagucucauauacccaaaccuacucccaacuuaagccuucggaauuagaucaaacuuguucccucaccacaaucacugggguuucagcugcccccucccccauccccauauaggcuugaaugccuggauauaucgugucuaugccaguacauucugaggucuccaugccuuucccugaacuguugcuuugcaagaguucacagucuaaggugaugggcagaccuagaaaaaugauuguaauauguuauaacuaaguucagguaaagcccugggggagggagaugcugaguccugcuggggaugagguauaaaggaagguuuuuggaaaauuaaacaauguugaacagcaguugacuuucaacuauaaaccuuuccuaagcaucugcucagacaauggaaaggcaaaaaugccugacauggccuuuaaguguagaaucuuguggauuaagcaagugcauuccaggucaacagaagagggacacauugugugcgggugguguguguaugugaauguguguacugccgggagcccaccaauggauacaguggccauugggguuuaggggaugagugacagggaaagcuguaacuucuaaguuuuaggcuugaucuauuggugcaugguuauuccauccuuaguuucagaaaauccuugaggaggagguaauuuuuaagggguagggguuuggcauggcaggauagaaggucaguuuaauuuauacuugcugaaaguagaauauauaaacggcugagaguacugauccaggaaaggaggguggucaccuuuuguuuuguuuuguuuuuuguuuuuuuuaagauggagucuugcucugucgcccaggcuggagugcaguggugcagucucggcucacugcaaccuccgccuccuggguucacaccauucuccugccucagccuccugaguagcugggacuauagguaccugccaccacgccuggcuaauuuuuuguguuuuuaguagagacggaguuucaccauguuagccaggaaggucucgaucucccgaccucgugauccgcccaccucgaccucgugauccgcccaccucggucucccaaagugcugggauuaaaggcgugagccaccgcgcccggccauaccuuuuuauuugcuuuguaauucugaauuugacuuuguagaaaagcaaguuuugagaggcuuuauuuagauugauaccuuugggagacuuaucagucaguucaggcuggcauaacaaaaaauacaauacuacagacugggaggcuuaaacaacagcaauuuauuuucucacaguucuggaggcugaaggcucaugaucaaggguucaucaggguugguuuuuagugaggccucuuucguggcuuguagcaggcugccuucucacucuguccucacguggucuuuuuucuuuaggguagagucgagagagcaaucucuggggucucuuccuuuucuuguaaggguacuagccuuaucagaauaagaucucaccuuuaugauuucauuuaacuuuuauucacuccucauaggcucugucuccaaauauagucacauugugggguuagggcuucaacauauacauuuuggaggggggauacaauucauuccccccacauucauguauuucuucuuuuuucauaaaagguugugaacaagccuguagccuguagcgugguggccuguaauggcagcacuuugggaggccgauacgcguggaucaccugaggucaggaguucgagaccagccuggccaaaauguugaaaccccaucucuacuaaaaauacaaaaauuaguagggccugguggugcaugccuguaaucccagcuacuugggaggcugaggcaggagaauugcuugaaucugggagguggagguugcagugagcugagauagugccauugcacuccagccugggugauagagugagccuccaucucaaaaaaaaguaaauaaauaaaacaugaaaaaaugaaagguugugaauauguggcagaucuauaagacuuagccuuuguaucaagguuucuguguucacaccuguguggguuucuugugauaacaguguagcuugguacgaugaucugaauauuuaugcccccuucgaauuuauauguugaaaucuuaaccaccaaggugaugguauuaggaaguagggccuuugguuggcguuuaggucaugagaguggagcccucaugaauaugauuaauguccuuauaaaagggaccccagagagcuagcuaguccccuuuaccaugucaggauauagcaagaaggcacugucuaggagccagaaaucgagcccucaucagacacugacuuugcuuugaucucguacuuuccagccuccagaaccgugaaaaauaaauuucuguuauuuauaaguuacccaguuuaugauauuuuauuauagcagcccgaacagaugaagauacauggcauccuaaagcuuccacccccgugaccaggacuuuucuggaugugugaaucuuguagaagucacuuuauccuucuaagcccuguauuccuuguuugugaaauggagaucauauuauaucuaucaaucaucuauguguuuuagcugauuaauauuucacuagacuuuaacauaaucagauuuauuauuaauuguacugugguuuuauugugugcguagcugcuaaguacagcauagaaagccuuucuuaguaagguaacuaaauauggcuuagagccauguugaagcgaacuuauuuaucauaagguuaucagguuuaguaaaaaaucgcaaauuaauuuuguauguauaaaaaugcggaauacaggcaaguauaaagauaggcaaaaucaucuauaagcuuaccacauaaugagagccacacuuauuuugcuuuuuaugcuuccagacuuucuuugauguacacauauacaccacaaaaugaguuaaugaucauggagcaugaucauaaaaucuuuucagaucaauaaauauaacuucauaacauuauuuuuaauggcuacagaguuuucuguugccugaauguaccacaguuucuucaacuauccucuauuguuggacauuuaagaugcuuucaguuugaugcuuucaauaauguugcccuuaauauccuuggccaaaguuuuaaaauguagccuuaauuauuuucaaauaauugccaaguugaaaaauaugcauuuuuuagaaaagcuucaguacauacugaaaaaggcucaguuuugagacacaugcuuccugagcuugaaacaaacauaacgagaaagagcauacauauaggaucauuauauguuaauuuccaugcaauacucauuaaugaaaugaacuccaaaguggagguaguuuuacucauuagcacuugcaugugagaaaacuucuuuuaaaguuuuacuuucucaagguuuuuugccaucaaagccuuucuuuucauucuaaaaaaucaauuaauuuuaacacuuguuuuaaacaaauguaggauucuuuggcuacaucuguuggcagcuacccuuuaacauaaaggguuauguauuuuagucuccugaugcaaauuaucgccucuaacucuacugcaaguuuuccuucccacuauuucaggaacaucauugcuuucgaaacccaaagcaaaacucccuuucaaaaaggcauuguuaaagugagcuugaugaggcugauuguuuuuauauaauggcuuggacacuguagucuuacaauuuuacagaaugccuuuaggguuucaccaacuggaaaggaaaaugacuucauggaugaaguauggacuuuaaaauauuuccccauacagaaccaggaguucaaauccuuguagaguugccuaauucccuuucuuuaugaguucaaugcauugauugcuguguaaucaauuguuucugugaccuugaaauucaucuuguuagacuccugagcucuaucaccuugaaacugggucaucuaaaugccuguacuagcaguccauaaacuuguuucccagcuguaacuuauacaccauggacuauuauuaauaauuauccaguuaaguuuugcaccuucuucuuaaaaaauauuuuuggcaaguuauuuuuccaauuguuugcacagauuguugaacaaugcuucacucuuucuuucucaccuuuuccuaguccuuuugccucucccuucucuccugccuacccuggccucuggucuggaagacauugucauuuagaaacagaguagacuuuccaaggucagugaaaccagggauguauuuucuugaaacuaaagcauucauucugcuuucuguaacucuucucuucagcaauaagaguauaaaaucauauuuuuuugauuuuuuucuauuuauuuuauuuaugaaacaaauacuguuuauuguagaacauuuggaaaaugcagagaaagaaaugcugcugcaugcaaaguaaaccugaaaucacauuugguaacgucugggugccuauccccugucucauugcuguacuuguaauguacaaaguauaaaugcaauguacaaaauauaaagaguauuacucuguuugggugguggugcuccccuuuuccucucuacugcugguccagaccaaggaaagugguuuguugguaacgucagaaucaccuaccuugcuggguaaagcauucauuugcuguuuuagauugcauuucuguuuugcuuggguugaguacugucaucuguaugccuguggaguuacagcuucccacacacuuuauuggcccacaaacuacagcuacuucuguccgccuccccggcucaacauuccaguuccccauuaggacuggcaccuucggcuguaacucugaaauccucuaugaaugagcucuugccauucccuucccuuagggugcugcacccuguuucucaaucccacagaaucuuguucugaaucaccaggagcuugaauuuggcuuacugaucugacucuaauaugguaccuucuuaggggauccccucgcugcuucgguucucugcccucugccuagauguccugagagcuugaugucaucccacagcaagacuuaguucucaguccaggcaaaguggcauaugccuguaaucccagcacuuugagaggcugagaugugaugauugcuuaaauccaggaguucaaggccacccuaagcaacauagcaagacuuugucucuacagcaaauaaaaaaguaauuagugaugcgugguagugcauaccuguggucccagcuacucaggaggcugaggcgggaggcucaccugaacccaggaguuugagguggcagugagcuaugauugugucacugcacuccagccuggaagacagaguaagacucucuccccgccauacccucaaaaaaaaaaaaaaaaaaaagacaguuuuccacaacauuuuggacacugaauuggcccuacaucaguuucuuuuaauguaaucccccgaauuccagcuucuucccaucucccucuguugccuaugucagugagguuucgacaagccuguacagcucucccgucaaagauaaacaguaaggucuaugucauggaaagaugaguccuuaauaaaagggaguccuuaguagagggaauccuuaauaaaagaagcuucagcuguuaccccuggcugguuauccaguugcagggacuggaauaacuccuggucccuuauaauucugagguuauugcaauucaacagugauugccuuuccuacuucacaggcaaugaaaaguuucuuacuauguucccagucccgugcagagcaugacuugguacagguuuugugguguauucaucucuugaaaaagguuguaucaguacagaaagaggggaaaaaaugaguugaucaaaacuggcguauuugaucauuuaaguuguauuggccaaauuauuuguuacauaguaauccuguuuccuucugugagauguuaugacaacugaggacaugcuuugauucacuggcugcagugcagacuaguuggguguucauuuguuuuguuuugcacguggaaauuuaaguaaccacaacagcagcaacuggauauuguucuuugaauagagagaauucauugaauuaaauaagaaaacugggcugggcgcgguggcuccugccuguaaucucagcauuuugggaggacgaggcgggcagaucacuugaggucaggauuucgagaccagccuggccaacauggugaaauuccaucucuaguaaaaauacaaaaaauagcugggcaugguggcacacaccuguaauuccagcuacucaggagucuguggugagaggauugcuugaacccaggaggcaaagguugcagugaguggagaucgugguauauugcacuccagccugggcaacagagugagacuccaucucagaaaaaacaaaaagaaaaaagaaaacuggcuuguaaagaugcacaagugccaagugccaauaaaugaguguaccaacacaucuuucuucuucuaucugcuccccuccuccacacccuuccagccuucauuguauugggggauuacaagucuuccuaaaucugaguguugauccugugaucacuccuacucugaaaccaccauuggcuuuuaaauauuagcucuuauuucuaccacuacuacucccgugacuacuccgcguuacuggggcccugugucaaagcucuaacgucggugagaggaguuuacgcuguauuuuaggauaggucuccaagcucuuucuucaaagcuccuucacuauucuaagaaucuagcugcugugccuuuuucuacacaauuuacccugccccaaaggcccuccugcuggucacaauuuugcacauuccacaagguucuacagaagcaucauuuuuuucuucucucuccuaacucccaccagcauuuugauugcguuccuucaugucacuuaugcuguguaaugccaucuuaucggacuuguuagggcacagaguacaguauuacucagugaguaauuguucugccauuuauuagcuauuugacuucaggcaaauuaauaauuuuucucuguacuugguuuucucauauauaaaaugcaaguaguaauaguuccuacaacaucagcuugucgucauaaguaaauacgugaaacacacaugaaccguggcugggacgcagaaauccugcaaucaauauuagcgcuuacuccuacuccugcuacugcugcuacuacuccuggauugucauggcccugugucaggaccuugaacuugguaaaaggaguguaggcugggcucuagaccccacuuuccccuucaguuggauacucuuuuucagugaacaaccuguacaacuauauauggcaguucuguaccagaaucuaugcacuucccaggcuaagucuguauuuaucuuugcauucacuauagcaccuaaaacaauacaguacauagaguccuauucagucauugcacgccacgugugaucauugaaaugaacgaagaaacaaauguaaaaaggaaaauguaaaaaugucaauaugguuuuauuuguaagcagcccauugauuuuugaagcauacucaccgaauacaucauguauuuucagugagaaagcaguauuugucacaauacuagaaaugucauaaauuuaaagaguaauugagucugaauuuucugcagguuuauuuacuagaucaaagagugacuucaacuuucagugcuuauuuuauuugccagcauaaacuuacagguucagucaaaugccaagaaaauaaguuaauaaucuaaauuaugcagauucuggcaaauucucuuucuuuugggggagaaaaaaagagagagcuuugaguuuuuaucucacuucagcaaauccaacugacuauaauaguaagaauaaaacucuagcaauuaaucuaauagcucuaggcugcuagucauuccagaaaagugacauuacacagaauauacuaguuacucucauugcaugucauugauauauaauucaauugauuuucacauuuuuuacacuccaaaaugaaauacaacuuuugucaugucaccagauuggaauucauugacaauacauuaacaugccaaaaauaauauuacacacaagaauaauguagaaauaaauuacagguagagcaguaucccuaaggagauuuucauuuguguccuauaacagaagacuuauaacccuacucauacaucuguuucaucccacuacguuuuagacucuucguucaauucaauaaauuacucauuuugccacacacucagcacucugucaguuuugcugggcaguauacuuacacaaaagagucuguauaauucuaaaguauaacccccccuuuuuuuuuagcaaacaaauacagagacuuucaugcaaaugaauccuugaaaaagauagucuggauaacuguaaggcugccacaacuuuuguggaaauguuuuggaacugucuucuucaaaaugucugggaccuucuuuuuauugauaaucuccuccuccuccuucuucgucaucgucaucuuugucuuucuucuuccuucuuucuucuucuucuuuucgauggaaucucacucuauugccuaggcuagagugcaauggcaccaucauagcucauugcagccuccaacucuuagguucaaaugauccuccggccucagccuccugaguagcuagggcuacaggugugcaccacugcaccuugcuaaauuuuuaauuuuuuguagagaugaguggucuuauuuuguggcccuggcuaguccuaaacuccuggcuucaagcacuguucaccuccuuggccucccaaaguacuugcauuacagaugugagccacugugccaggccuggggccuucuuuuuaaaugugcuuaguucugaacaauuuugucccuuaagguggauuuaauuuuuggaaaucaaauaauucacugaccaggcuauugauaaaugagaucagccauacuggguaauauuggguuuuacucaagaacaaugagugauugcaaaguaacagacuauuuuuaggagugacuuuuaaauugcuuugaguguacuuucaagagaaguauuuggagcacugagaacauaaguggaagaagaauguggaagaucuccagcauccuuggauuuagcugucaauuacaaugcuacuuccaugagagaaggcuuuguuuuuugggccuugcuuguuuuuugcaggacucucagagccuaaaacugagccugacacacaguuguuauugaaaggaaugaaugaauggauuaaaugcaacaguucacaaaugcauucaaagucccacggcauagagauuucucucucucucuuuguuuuagccuuuauggcauuaauuuaaaauaauuuauguuaaggucgcuauguauuuaccugaugagaacuuggcuuugugcuaagcacuuuauuuucaguauuucauugugucaccaugacuuggugaaauagugacugucauuauccucuuuucauagaugaggaaacuaaagcccagagaagcuaagcagcuugcccaaagucacacagcuaauaggugaggagucuggauucaaccugcaaagucuggccacugaccaagccuucacccuuaacuacaaaucugggcugcuuuucagcacaucuuuguuguccugauuuggucauauucucacauuauguuucaaucauucuaaacuggguauauaauaacccccuuugagagacaagggaauugaccaaaguacauuguuuagagggauuuucugaagaaugacuucauggaugaagcauggacuuauuauuaccuccuuauggccucugucuccaaauguaaucacauuggggguuagggcuuaauuauugggaauuaaugaggauuuggggaaacaucuuucaagaaugccagggucuagugcagagcaucguaaggccgguaaucuggagggcagccuucagugagcagguucgcauucuaguacagggauuaaaaaccauuucucauuuaaagcccacauuuccaaaaggcuuauaaucuuuagaggaauacaauacaagagggugggagacuguuucuaauuuuuauucugaauaauuaucugaucugaucauggacaaguuccuuaggcugccacauuaguuuccucaucuagaaaauagcuaacuggacaaggucauccacagggugcccgguagcucuuaagugucaaaaugagugauaagauaaagugcucuuuugccaaagauaagaaggacuaucuuuguugacaguuaucuagaaaggcuuccaagaauaggaacuugguaaacuguaguuaaauaaagcugguaaaagaggaaugaauaucccuugagccaagaacaggaguuagcugccacacccugggguugaagagacuggguagguagguggagcugaguuuugaaagauuuuugaagagcagaggaagaguuuggucucuaccccuggcucguucaucagauauuucuugauugccaucuaucuuccagccauugagagccauugaucauguaagauucuuucccuacuggaguugggaaagauauuucauccaaccaaagggaaugugcccuugauaugaagauuuguaauguuuaccaaaaaaucuuuguucuaccacuuuaggcauagaagaagaagauaagaaaagccucacaguaaaguugacuugcagguuauauuuaaaggaugauugucuuuauuugaacaaaaggagaaaauaacaaauccguuguuugaagaggaaaaaaaacagaaaaaaagaagugccuuugauuuggcauaauugaugcuuuauugcuuuguagauaggugguuuagggcauuggacaaaagacgauaauguuuauuuagauuugggauuugggacuguucuagaaagucaauauaugguuguuacuuuuaguagcuguaagaauggcauaagauaacuuaguggaagguaagugcuuucugagcuuuucugucugaugaugaacccuagugguugcaaaaaugaguuuauaccuuagaaucauuugagguacugauuacaaauguacacuuuuaacaucaauccucaagacuuuagaguuuggagucugugaucugaauuuuucacaagcuccuaggugguucugauuaauuuagguugaggaacagcauuuuggaagccacagguaaacuuguguauugcccacaccacuaaggcugacucuggaugacacccaguugaaagugauuuccagguucccuugcuaaguaaaagauccaagagagagaauagugcugcuuauuucuuuuuaacuggauaagauugaaaaggucuguggauccaauagcgauggagaacgugcagaagcugcaccccgaauugccgaugaaguuaaucccagacagcuagaaauuagccaguauagcacauaugcuuagauuggaugcugugaauauaugcuuucuggucaacaaaaaaguuaaaucauguagaugcucaagugaagagcaccucugucgacuggaaagaguugaguuauuuaccuuuuuucccccagaaacuguuucuugagguggaaaagcaacuggaaguacaacuacacagaacugaaaggcuauugaguuugauuaugggcauaaaauuaaauuuucagcuaaaugugacagcccuaguagaacaaagaagaaccaaucaaaaaguuauugacuauugagacuuuuagacagagcuaacaaauugaccauggguuccagggauagucacagccuggaaguugcuuauucucuuucuucuaaaagguagggaaguucacacaaccacagccacuguagccaggccagggaagaaggccaauuuaggcauuuaccagcaugugcaagaugcaguuuuucaucugagggggugagaccuuuucuaggugccuguguuagaacuuggagcacuugcagguaaugagaacgcauuccaauacaagaaaaaccuauuuagggcaguacuggauauggauuagccaagaagauccacagaucaaaauagaauccagggcagaaacagagcagagaaauuucccagagccacuuauggguaaguggaacaccaaugauuuacuaauuacaggcauguuuuugcacaaauucauuuuuuaguaaacaagauaugcuuuaugcuacuugcaggccauucuuaaaucauucuuuugggaauccuuauaaagacaucaguuaaaaaucucaucuguuauccuucaagagaaguaguuggcaugauuuuugaaauugagucccugccuaccuagauucaacagauuaaauaugaauuaucaguggauaauuaccuagggcuguucuuauauguauauuuuauuuccuuaagugugaagcacauggagugucacgcagaugugggaaaagguaacucacaaggaucuuuugcccagaacucuucugguagggcgcugcuggcucuuccaguaugcacccaagguggcaaagagucugccugucaaugguauccagaagugacaguggggauagcccuggagaagguuguuuggauuuucauaagggagagauucucucucugaucuuuauaaucugaauccuacccucacaggcuuuuuuuuuuuuuuuuuuuuuuuuuuugacacuagucacaaaauuaacagucaggaugcuuuugaaaucagaacaauuucccuggaggaggcacagcccccgguaccaucauuauuauauauguuuugaaacuccauagacuggaacucguucagcgugcuguaaucuguguguuuagaagcuguauugacuuuaggagucacacagauggguguagacccauguuucaacauuuuucuuucagggacacaccuuugaaauucugcuuggaacauaucagcuuccuccucccuccgagucaucagccaucucagugaauagcgcaucugcauccuuuauugauacauacgggggcaggggugagggcaguuacugccucugccucuguuuucucauucaaauauuagcaaagguccacaaacagaaauagagaaaccagauuaaagaggacagauuguauuuaugguaggcuguaacacauuuugaucaacaacaacaaaaaaguuuuuggagcuauggggcugccugaugguaggauacauacuggguuuauuauaaugcauguacauuguucaauguaacuuucccaucauuuuuaugccaaggccauauguauggcucagaugaaauguaacuggcaauuuuucauuguuguuguucuuuauuuaccuuucucuuuuaaucaucucccuguuccaacuaaacaaaucacccccaaaagccagugauuaaacacaagugaguucaaagagccaaggcaagucugcccaagaguggccgacucccccuacagaaggccaagucugccaauugcagucuucacucagagccugguaguaaaacugcugagaauaaggugguuucagaggcaaacagucaccuggcccagagggcuucugcaauggagcccccucagaagggcuaggcuaugugagaagugguggguguuggccgugucaaacagcuccuuccaguaggcauccaggaacugaguggugugcaccccuuaggaggccaagccuaaggcaccagcuacagacaaggugcccagguggcagaaugcagccccuggcccggccaaggcuguguggaucuauaacagacaauuuuggcaugacugcauugacuuucacucuggucuucuggguucuaaaauguugguuccuuaaguaggaacuaaaaguuaauaucugcccuugugaugacuaggaauuugguuaauucaugugccugcuuagcaaauuaaaauggccaguaaucagaacuagaauguuaaaucucaacugaucugaguuuuucucaucuuuugauagaauaaauugaacuaucuggcugggcacaguggcucacaccugucaucccagcaguuugggaggcuaaggcagucagauuaccugaguucaggaguuuuagaccagucuggccauuauggugaaaccccgucucuacuaaaaauacaaaaauuagccacgcauggcagcacgugccuauaaucccagcuacucuggaggcugaggcaggagaauugcuugaacccuggaggcagagcuugcagugagccaagaucaugccacugcacuccagccugggcgacagagugagacccugucucaaaaaaaaaaaaaagaauaaauugaaauaucugugugacaauugccugguguuugaaauuccccuuuucaaacaucccagcauauuugguuugucucagugagcucuccuuugaaagagcacuggcuacucccuugguaaaagaaaggggucagugauggggcugcagguccuuguuccugacacguuuuccuugggaaauucaguacaagguauuucgucucucauucagucaucccuuugcucagcaaauauuugucuuuaaagacucucacguucucugagaaaaaaaucauggccuucgcacaaaaacaagaagauucuauuuagauuugaauaacuaauguaaacaauaaaaauaaaauagacauuuacauauuuuaucuauaucuagauacauagaaauuaggccgaauguaugugugagacagauagaugaguauaacuguuuucauccuauuuauauuggcuuuguucuucaaagaaaaaaaaagcuuuuuagauacuacaccaaugaagaaaaagguaucaucuagaaucagcccugagaugaaaaagaagugugcuuauuuauauaggaaguagcuuugcauacuuuuccuuucuguuauuguucaaucuugaauuaaacugucuuuuauuuuucuacuuccauuugugauuacuaugaaauuucugccuaagggcugccaggaauuuuguaaaaauuaaacaauacaaaauucuuugaaagaggauuuugagucccaggcaugcugacuuuuuaagcucaaaaaguacgcguggcuuuugcaagcagaagcaaguccuaaugcuuugaagaauguaaaauauaaucaguauuucagaggcauugaggugguuaaucuauuaaucuauacuaggguaauaaaccuaccaguauaaacaucugcuaacuagaauuuggagcucucaccuuaccuuagagagaaaguuuaaccuaauucugcaguuucaauacuaaucauggguuagauuuuuuucauuguagaucucacuuguccuugcuuucuugaguagucuuagagcguauuuguuugcugcaauuaaagcagccguagucugauuauuuucuuaacuugauuguaacuggguacacuuggcugaucaugugacucucuaaauuagcuguuauaaguuaauucccaagccuuugaggugucaacucuguccucagccacuuagagcuaauauuugaaggaccuccaggguacuuggagggggaggugguggugcuucaagaaucccauuugcccacagcacaguggaggaguacgaucugggcuguguaggaggugcugauuuuuggacugaaaaagcacugacccccugcagaccacgauguccugcugugauucuucccuuguuugaggcagggcuacagauacaccccauggagccagagaacagaauuccaugugucccccaaacccaaaucauauacccaaagcccucagcccucagauuuaagaauuccuagccuaguagcuuuuucgggugguuucucugcucccaagaaggauguccaggagguccaugggcccccagucccccuacuucuugcagggugcugcccuguggcagagccaccucuaccuucaugccugcugcagggauucacccauccuuaaguccuccagcccguugcugguuugcuccauucuagaauuugcuuccuacugcgcgcaaauguuucauguuagagaaugguaacugccaucucuauaaugguuaaugccgaacaugacugcagaugaaaguaacagugugaucacauccuuucucuuccuguucuguggcaugagucagucucuuugccuuaauguuuauacagauccuuaauaacaaauaacagcugauggcgacuugcugagacauguacaauaaggaaagaaauuacaucguaaaagauuugggcuuugucccaauuuuuuuuuuaagagaaaaaaaaaaaagcagggagagagaaccuuguucuaauaaccaguuugugcaacaauguuccuuuuuucaaaucuaaugagaucugauccccacaaguauuaugauuuauuaccugccccuacuggacuguuugcguuggguguuuauuauuuggauauucgguuaacauaacacuugaaauaauuucgcuuucugaaucugcucuucucucuuuuucuugggugguuuugugguaggucggacauccucagaugaaaauaacucacaagagagcccuuuuucuguuaucaguguucugucuucauguccaggaaaauagacucguggguuuccucaaauguaggggaaaaacaaaaguuguuugcuuugugucuaaaaguuccauggugucacaccuagaaacccucgguguuggagacuggugcuucauacuccauugucagcaacuuugcagaaaguguuguacuaaagcuacuacagugagcaagcuuaugcccuucagcguugucucaaauuuuguuuuuaaguccaggcguaaagauaacaugugauaaugaccucuccauuuauuuggagucacagauuugauacuggaggaucucaaagcauuaggucaaaauaauuagcucugucuguagaauaaucaacucccucucugccuggaugcaacagauuuguaaccuuguuuuaaaagcuaggcguuuccauugguacaagucagcguguuuagguguggagagaguuggcagccugcagggagggguggcuguuucccagaagucacaauuccugguggagagaggaagcugucuacucaguuucccuccugugcuuugugaauggugaccgccccuucucccagccucuccagccuuccucaagguggggcaaaaucagcccccugcagcaaagucccuuuccuuccuuccuguggagaccuggaauuuuucagugcuuucacuacugaacauuucugaaaucuuuuuuuuucugaugucaagcaacagugucauguauguaaauuauagaaaauuuagaaagaauagacuauugcaguaaaggaaaccaugcacaauccucuuacucauggaaaacaucuauuacuauauuguauguacucuuggagugguuuuuaaaauuuuucuuuaaaacuuuuuuuggcauauacguaguuuuuuguuguuguuguuguuguuuuguuuuguuuuaaugauccaugcauuugauguauuugagaccuguaaaugccacuuugaucuuuaucugguuguguuagagaguaugucggacagaggauaagagcaugccuuuaguugugugggccauuuauuuauuugaaaucuggaauguagccuauuuggugauggcacaggagggcauggaacccagaagccaaggcuaaaaaauguauagaaguggcaucagaggauggggaaauggugucagggaagcagcacaggaccuagaaucagaaaagccaguuucugcuccugcuggcuggguaaucucccugaaacucaguuuccuaaucugggaaaaaggagaacuccuaccuuaccaguuguauugaugauucaguuaauuaaaugagguacuguuuaggaaaaugcuuucuaaacaagcacugcaagacucagauaauaauauuauaaugaaaaaguuguucagacuuggcuguggugauucaaagggaauaagauuaaggugagcaguugguggcugggauuuauagucuuauguccaugagcagagaaaacguugaauuggcugcucgaauuuuguuguuauugcuguugcugaugcaucuaaugguuaauauacacuuccuguuuaaaugguuaccgagccuggauuauuacuagggaggcagcguagcaaggcuaguauuugcuauuuuaugcuggucacccugucuucuugagucuguguauuuuuuacucaaugaguacauucucccacaaugcuaauauguuugcucuuucaccuaagagacgcuuaucagacuuuuacuauggauuacaggccuuuguaucaggaaucuugcugcauuuacacaagagagaaugagacaggcauaacucuauguuuuaaacaacagauaagguuugucugcugugugcacagagaaggaaggggaggggaaacggcgggguugggggugguuagguagggguggggccugggaaagauguauaaacacuuuuaacuugugaaagaaugucuuugucucugcucaugagccucagaaauuggcgaaauauuaaaaggagggguuugcagggcagcuugugagcucuggagucagauugccuuggacuccacccugcuccgacaguuccuuagccaugugacagauaaguucccucaucucuuuguuccucaauuuccucuucuguaaaaugguaauaauaauacaaugaaccucaucgggcuauugugagauaaauauaaaccgcugauaucuucagaacugauccaggccaauguuauguugaauccuuaagaaggauuugagaagguggcccugaggaagcacagacacacgcucuugccccauugucuguaacugcccagugucgggcagaccccgguggaccuccccgguugcuggggcuggggccuccauacucagcuguaaaugaccaggugacaaugagaguggacucucagugggccucaccacaggagccucugucauauggggcugaaucauuguccuguaucuggagauugugaaggucuguccagggcaucuuuugaggaacuguaucuauuucagcuaccucuuuaguuuucuauuucucuuuuucucuccccuucuucuuaauauuuucugaugagagacucggcaggugaauaugugcacguggacauuaaucagaggcacuugucauucugaagaggccucaagagccgaacaggguuauuaauaagaauccucuaaaccaagagaacauggagcauguugaauuuauccaauuuccacaacguucuaguuuauuccuauguuguuguaaggacaaaguaguagauucagauucuuuuuuuuccuuuagacagagucucacucuguugcccaggauggagugcaguggcgcgaucucggcucacugcaagcuccgcccggguucacgccauucuccugccuuagccuccugaguagcugggacuacaggugccuaccaccacgcccggcuuaauuuuuuuuuuguauuuuuaguagagacggggguagauucagauuuuaauacugcucauuuuaaacguguuugugugucaauuuuuuuuuuuuuuuuuuuuuuuuuuuuuuuuuuuuuuuuuuuugaggccgagucuggcuauauugcccaggcuggaaugcaauggcgcgaucucgaucucggcccacugcaaccucugccucccggguucgagcaauucuccugccucagccucccgaguagcugggauuauaggcccucgccacugcgccuggcuaauuuuuguauuucuaguagagagcggguuucaccaaguuggcuaggcuggucuggaacuccugaccucaagagacccgcccaccucggccucccaaagugcugggauuacaggcgugaaccgcugcacccagccaugaauuuuuuuuuuuuuuuuuacacuagauuguguuguuuccugagcacacaggagaaagguggagaccuuugagacguguauaucaggcucaugaccuucgagggacacauguauccugccugcaaccuucgaggcacacguguauuguggcugugaccuggaauuacacugccuuacuucaaauccugacacugucacuuauuagccaaauuuacucaagcaacugcuuaacuguauaugccccaguuuccguagcuuaaaauggggauaauguguuuccuuauucauaagugucuuauauauuuaguaugauuauguauauaaagugccggaauuacacugccuugcuucaaauccugacacugucacuuauuagccauauuuacucaagcaacugcuuaacuguauaugccccaguuuccuuagcuuaaaaugggaauaauguguuuccuuauucauaagagugucuuauauauuuaguaugauuauguauauaaagugcugagccauaauucuucaauaaauauuaguuauaauuauuuuugaaaugugauaaaccucaauuggacuccugcuuuggcuauguaaccaguuggaccuuugcuaaaccucaauuuuuuuuaucuagaaaauaaaaugggaaacacaguaucuaauagagaguuauaaaagaauuauacauuauuucuaucacucuggagacacagucccuaaaaguacuugguagacccuuuccuauccucccagcuucuuuucuuggcaacguuuuauuuuuuuucagagaaucucaguucuucccuguaagggauauaggcuccaacuuuguuuccuggagaggacucagguagugguguauugagugcuggugccaaguacuuugugggcaguuucuuauuauuauuccucacuuaauaucaaccccauuuugcugaggaagccacagcugagaguuaagagccacaucucgccugcucucucaaguggcagcaacaucauucaauguguuugucugacugucgagccugugucuaaccacugagucguucguccuccaucagaucaaaccugggaaaggcgugacagugagcauccucacugccggaacuaauggcacggaaucaaggacauaucucucucucuuucccucaucuuuuuuaaccgaaaggaaauuuacggagcauaugguaacucguuuuccuccacagcucuacuauccagaccacgagucagaaaauuaaccuuuuaacuuaaucuacauguugugcauugagucucacgccuguuuucaucugccuaaauggggaguuccacgcagcgugauggguguccucucugugcucacauugccggggacagaugauuugcagcugcucuguccugaggccauugugaacacugaggucccugacagguuggucuagucugcaucgucaauuuuuaucacauucuuuuaugaaauagaaauuucuaucaugggcauguaauuuggugagcauugcaaauaguaaacucuuucaaaaggcuauaaaauuacauauuuauagauuuauaaaaauugccucuuuuuuucucucuccagcacuccuuccagguaaauaagacaauaggauacuuuugagaacuuaggaguuauaaaaauauaauuguuacuuggaaaacuucauuuuaaaucucugaauugggaaacacauaccuuaaguaugagcauguccauuuuaauucaugagcaguagccgugccguagccaucacaucaagcuuuugggugcuaauaagcaucaauuguguggcaacuaauccagcugguguuuaguaauguaaauggagacgugagauguuuuuauauguuguaucuucccagguuaagucaagccguuaaagcauauuugcaccuuauguagaugauuaagcauuugguaaauucugaaaggucacuaaguacaauguacuuccuugucuuccccaauuugccuuuucauuugacauaggcuuuguuaggaaauuacagccgcuuuucccaggugacauucauccccauguaacacugauuguaagucuaacuagguggguucuaaugacuucuacuaagauguaacauggaccaaccacugccuacauccucauucucauucucauuucagcaaaaaguccugaaaagauaggcaaacacuggaggaaccauagagacgugucauuuaccacuuucccucuugacuguauauaggugauuaugcuuucucaaguuucacuuguucuuucuuuuaccccgaagccuagcauuaaagggugcucaggcaguaccugauggguuggauacuggugcuaagaaguggaguuagcauccggcaggagaggaggcagcacacggacguggcuggacaucuuugcucuggaguuuucucuuggcaucugacuucugcuccgcuacuucaugaacuuugcauugcccucugcaaguccagcaugauuugggugccucaguuuucuccauuggaauauaugucauuuuuuuccucuccuucagaacguuucucaccacaaggcauuuuauauauauauuuguuuugcuuuguuuguuucuuuccacuccccucuuuuuccaucaauuuaacaaaagggguuugaauuuaucccagcaccuaggacauaccaggugcucaaaaaauauucuacugagggccgggcacgguggcucaugccuguaaucccagcacuuugggaggcugucauuugaguucaggaguuugagaccagccugaccaacaugaugaaaccuugucucucuuaaaaaugcaaaaaauauuagccaggcaugguggcacacgucuguaaucucagcuacccagaaggcugaagcaggagaauuucuggaaccucagagauggagguugcagugagccgggaucacaccacugcacuccagccugggugacagagggaggcucugucucaaaaaaaguuacuaaaaaauauucuggccaggcacgguggcucaugcuuguaaucucaacaauuugggaggccgacaugggcagaucaccugagguugggaguucaagaccagccugaccaacauggagaaaccccaucucuacuaaaaauacaaaauuagcugggcgugguggcacaugcuuguaaucccagcuacucgggaggcugaggcaggagaauugcuugaacuugggaggcggagguuguggugagccgagaucgugccauugcacuccagccugggcaacaagagggaaacugcgucucaaaaaaaaaaaauuauugacuaaauauauuaguuagccaauuaaaaauagccccuacuucuuagcguuguuggggguaucaaaggaauuaaugaaagugcacauagagagccccaguaacuacuugcuauucuuauuacccaacugaucgccaguguucucuuuuguaagugaggaagguauauuggaaguacugggguuuucaaaugcugcauaaggacagacaguuuaaaaaaaucuuuuggcugggcgugguggcucacaccuguaaucccagcacuuugggaggccgacgcaggcggaucaccugaggucaggaauucgagaccaauucgagaccagccuggcgaacauggugaaaccccgucaaaaauuagguggaugguggcacgcaccuguaaucccagcuacucaugaggcugaggcaaaagaaucacuugaaccugggaggcagagguuggguugcagugagccgagauugcaccacugcacuccagccugggcaacugagggagacuccgucucaaaaaaauaauaauaauaauaauaauaauaauaauaauaauaauaggauuuuauuuuuauuguugccuuugauuuauggcaaguugcuuuugacauaucaagaacauaauugaacucucagaagguaaaacucauaaaaaugaagcauaaguaaaugaagugugggaaaccuuguuugaaacacauuuuggggugagagugggaauuuauuagguaagccaguucgguuucagagacaccaguuucacuuaguguucaaaucccuguaauaaugaguggugucgugucaagaaucuguuaccguauaucauuuauagguuggucauugaacagguguuuuuagcuaaguuuugauuaauugugccuuuaugcacuggaccaauccuacagcuuaacuucgucuuugucacuucccugugcaguucucaaagaauucaaacgugugauauugacaauccaagacucuuuuuccaagccucauuuuccuugauacccuaucugauggcuggaaauucugcuuucucuuggguuucuucaugcaccuuccccguucuucaacgaugaauguagcauuaucuguaacacugggccucaaauuuaucuggugccucacauguaugggcauaacuggcaaugucuauaucaagggaaaauggugagaauuaaaugagaaugcauauuugaagugccuggccuagucccaggcagugcucaguaaaugcuaguucccuuuugcucuguauuuccggccuauuuuggguuuuuuguuuauuuguuuuuuuguuuguuuguuuuuaauuuauugagauggagucuugcucugucacccaggcuggaaugcaguggcacaaucuuggcucacugcaacgucugccaccuggguucaagcgauucucaugccucagccucccgaguagcugggacuacaggcgugugccaucaugcccaccuaauuuuuuucuauuuuugguagagacugggcuuugccauguuggccaggcuggucucaaacucuugaucuuaggugaucugccugccucagccucccaaaacgcugagauuauaggugugagucauugcuccuggcuuuguuuguuuguuuuguuuuuuuaauuccauauucuccaauuaccucugacauaugguauuuacaagguucuuccuuaaacuuuuucugaaucuacaguucaugaacuccugugacacuuacgcuuuuggcagauauuuuccaaaucucugccucuaguagugcugaccuccagaccugucucuccaauugcuuccugaacaucucaacucaaacauaucaugacccacuagcugaccucaugcccuuccuuuugaaacugacaugucuuccugucuucccuauuuuggcuauagcaucucuacugucucuggcauuuggucugggaaacuuaaguccaguuucaauucuacuuuuuaaaauauccuguaacaucuaaauggaaaugagauccucccguugcacuggucuuagauagagcuuucuuccuuuccuuacucaagggcagguuuggaaugaaguuggauucuagaaguuaggccaagcaauaauuaguucauugacauucacaacaguagguaauagaguccgaggguugagaauagggaagaauucuuacaagaauuauccuuggguuaacacuauaugguccaagccuuguuguguaugaaauaaucagaauuucauaauuucuguuucuucaaaaaguaguuuuaaauguuguuuucuaaaaagcgucaaagggggcgcaauauaacaaaacauaaguuauagccaauuucaaaugcaugcagauccuaccaugguuaacaaaaugcaaauauauuuuaaagacuuauugaauguguaguagccuuuugucauucuauacuuuuucuaaaaauucaugcuaaaagugcaacuggcagaggaguuucaugaaacucuuacgauguuaccuuaugaaauaugaauuucaagaaugauugaugauuuucauuuguucagcgucaccagcucauagaaaacaaaaucagagauuacaugaauuuucaaaaauaggaugugggggaagagaaaguaaaauugaaagucucuaaacacuuggcuacucaguuuaaaacuucugcuuccuaaagauacaucuauuauauuuaagauaagauaauaggcacugucuguguuucucucucucucucucuccccccucuugcucucucucucucucucugugugugugugugugugugugugugugugugugugugguuagaggaaauaagucuuacacucugggucuaccaguugccuacuggauaauaaaguaaauaaauauauguucaaagacacauauauguguuuguauacagaagugcuguguauacagaaaacauuugaauucugauuccccaguguagcaaugcuugauagaaaagguacuggcugauuuuaggcugugaagagaagauaaaauuucauuauuuguaggugaugggaaguguuuaaagaacaauccaagugagaacaacugguacucugucugguuugauugaagugcaggauguuugagggacaaauuggggcuggcuaugagaggcuuugagcuucucuguucuucugguugaauccugugguauauacaguggggaucauugagagauuuucaauacaggaaugacaugaucagcaugaacaucauacuuuuuaaaaauuacacaaaauggguguuuaaaaguuaauuuuaaauuuugauaauggucaguaaacgaaaugggagaggaagcaaaagagaaaagaagagacaccgagaaacuacagaggaaauaaagaggucucaguccagagggagagaaagggcgaggcuaggacucuagguugcauuggagguaaacugcuuuuguuuauuugggcugugaguauagaaugcuucuuugccuugcauuugaaaggcugauuugguuauucuaccacuauguacaggccuuuuuaauguucuuuguuucuaaacccugaguagcucccuugcuaggggauaguaacuuguagggcugacuuugaguggcagaggcagaaacauuaauaucauccaugagcagagucucccagguagcauguccuuacauuagguugguuguugcaaagguaauugcgguuuuugccauugaaaguaauggcaaagaucgcaaugacuuuuguaccaaccuaauaacuggagcagaggaaaagaaguucuguuggauucgucugaagagcugaaggaaaggaacuggguuuucucacuguuaauugccccuuucucaucucaaccuggcuccuuuccucagauucuugcuuuggaaucaccaucuguuuuccacuccacagagcuuugggaggaaugucagcucuguugucuccgacuuaagguccaaaugccccuuuucagaaacuguccaucauuuaaaguucgacgagaaaacuuggacuugcuuuguggccauaagacccuauauuuucagauuuccuauagacgauguuuuguuauauccugcuuuaaaaaaaaaguguuuaaaacuacauuuauagccacccuagcuguugcacugcacuguuuuuugguuaaaacaugcaccugcuuuguuaguaaaggaaccuuugccaagugaauuguaugugggagggugugacuaacucugcaaagggacuuaucucuuauccuaucugccugagcucccaaggcugccuuugauaagauuuauuucuucuugcaccagccccaccccuccaaccuuuacugcuaucuuuccucugaaaauuauucauaucuaaauauuuuaacuuuucaaaacuacucugcucucugguuucauauuuuguugagugaucuaacccuuccucugggagacaagugcucccaagcaagagagcauuacaauucugccuccccugcuccucccaccuuuuaaguauuaucagcagaccugcuugcuuacccguguuaggauugugcuguuuccuuuuuggcaagcuucagccaagcccauaauguugcaaggcuguuugaagggaaauguaagucacaauggcaagaaacauagaaacagaaaacauaggaacagaaaaagaaaaguaaaucugaaaugaucuucguacagcuugguucacagcaaggaguggucugaguugcuuucugugucuagacauuuagaugcuaaaggcaacugugucaucauucauucauucauucguauacuuagucuacauauuuguggugaguagccaucguuacagguuacagguuaccaaauguuagagauguaauaguaaacaggaugggcguauuugcagcugcuauggaucugagaguguguucugcaaagggugauagacaugaaaccucaaaacacacaguucaugacuggauuacaguugugcagcaggagcggguaaagagcggggucuagggaagagagauuuccuaaccuagacuacaggcaucaggagaggauucuuguuucuuacaagcuggaggugaggaccauuuugcauuggaggauaaggacugagcucuuaaccacagaagccauggaguggggagggggaagcaugaacaguuucagaucugaauaaauccacucaauuucucaguuuuccugaaaaccagcuaccuauuuucugccucccaauuagaugaaauucuguucugggaggaaacaggaaaguaaagaccucaguuguaaaacaacacugcgcugcccacaccagcagcuaccuaaugucaaccugaaaccucauaacucacuuacuucaauggcuguugacaaacucuugucagcugcacccuuaguuccgguuugaaucacgcucaggaagcuggccccucggcuggcuuccucaaguuagugggugcugucaugcagcugcuaucaagguguggcccacuugcaaguggucaggacccagggccugguggccaagccucaucaaagcuguugugauagcacaugcggguggcauucuugagcugggaaguggugucccagucugcuuaaguagaugcagacaugacucauuuggaaggauacagccaaggggaaaaucaaaauuugcuuuguaugucacuuguuuggaaucuuaaguccacuuaaaaaaaaaaaaugcccugcaacugugaggaagagcagaguuaguccuuuaugucacuuacuuggaacucucgacucccggcucgcccuccuccacccugguccagguggccaugcccucucugcuggaucucaagggccuccuuacagguccccugcuucuaaucauacuuccugucauccacguucuaccagcagccaaaugaaucuuuugacaauuuguaucaaaucauauugccagacugagaauaaaaacuaaacuccucacugaguuaagggccugugggcucaggaugaccacucugaucucaaucuuggcaugccucuugcaacauuuccuagcaucaguaaucuucugucugucuaauacaugccuacuguaggccuucugcaacuuucucuucuuccuggcaugcuuucccauguaauguucacaauugcuggcccuuuauuaauugagauccccuaugaaccaccuucccagccccauccucagucucucauauuaccagguuuauucuccuguacaguucuaucccugccaguagaauaugugcucuguggaaacacaggccgugccagucaucccuucccuaugucaggcacacguaggagcgcucagcaauacauguggaugaaugaaccuucacaccauagagcaaagacauuuguuucccucuuuuuucugaucugauuuuuaauaagugacaaaaagagcacaggagugcuugggaaucucugcuaagacagguaagagaaauuucaauaaacaguuuggagggguggauuuauuuggggaaaaaaaaggaccuugcucacaguccuagggcugagaaaguguuggagcucaguuccugagcuccauaaaugagucugcaccaguccuggaaggaaagauaaacgugcuggacuaaugugcucaauggcauuugaacugaauuguaagugacuuugggguuuaucagagcauccuagguuauuugagaaucacugaaucuaggucgggcaugguggcucaccccugugaucccagcacuuugggccgaggcgggccgaucaccugaggucaggaguucaagaccagccugaccaacaugguaaaaccccauuucuacuaaaaauacaaauauuaaccaggggucgcggcggacgccucuaaucccagcuacuugggaggcagaggcaagagaaucacuugaaccugagaggcggagguugcagugagccgagaucgugccucugcacuccagccuacaggacagagcaagacugcgucucaaaaaaaaaaaaaaaaaaaaucauugaaucuaucagaucaugggaaccguauagacuuggaauuuuugaggauuaaaaagagauauuuuaaauuauuuagucugguacucuuagaggaaacugaccccuagaaaccuuaaauuguuaaauguuaggaauggaauccagguccccuuuucacagagccuggccucuucucagucauuguauuucagccauucacuuccuccacuucuacauagcagggaacggauuccugguuguguuuuugacaggagaaauguaaccuuaacacagccuugaggaaaacaugaaggugaucauccaucugccaaaauuuuuaaugcuauguuuuguuuuucuuucuuuuccugggggaaggauuuaugacuucaucuuuuuuuuuuuuuuucccuucaaaucugagccucuuuagaaaugauccugccucaaggcuagggggaaaaaauccuauuuuaaaaaauaaaauguagaucuucuuauggucugcuuuccagacacaaaagagaucuaugucuuuuauuauuauuauuuuugagacagggucuugcuccguugcccaggcugagugcaguggcacaaucacggcucacugaggccuugaccuccugggcucaaaggauccucccaccucagccuccccaguagcugggacuacaggugcaugccacuaugcccagcuaauuuuuaaaaacuucucguagagacagagucucacuauguugcccaggcuggucucaaacugcuggauguaagcaguguuccugucuuagccucccaaagugcugggauuacaggcaugguaagccacccaccgugugugauguggccaggaucuaauuuugauuguugauuaagaguacuuuuuaaguaauuuucaacuguuuugugauauaugaaaaagaagacuaauuaauaaugagauaucaaauaauguuucuuaaauugagguagcuuggcuggccgugguggcucaugccuguaauuccagcucuuugggaggucgaggugggaagaucaccugagguugggaguucgagaccagccugaccaacauggagaaaccccgucucuacuaaaaauacaaaauuagccaugcaugguggcgcaugccuguagucccagcuacuugggaggcugagggaggagaaucgcuugaacccaggaggcagagguugcagugagccaagaucgugccauuguacuccagccuggccaacaagagcaaaacuucgucucaaacaaacaaacaaaaauugagguagcaucuuguaaauagaauccuagaaaagguuuucaacuucccaugccuuuuauagucauuuuugaauguuggucuagagaucugcuugggaugaguaagauuuuuuuguacaucugagauaaauuuagguuguuagugacaugcuguucuuuuguauuugauaauaagccugaucuguuucucuugcuuucuuuaaaugggucaguucuggcuuccagcucauccauguuuuacaaagaacaguuguuccacuuuuucuucucucaugaccaaacacuuugggagcaugucaacaucauggucuuguuuuuauuaugauuaauaucaauuuuucacccaucguuuguguuuaauauuugggaugagaaacggacaaacaaaugagcagauucugacuugguauuucuccugcaugccauuugugauuuauaauuuauacauggaaggauuuacugaccuaccugauagucccucccaacaaagauaaacacacuuacacgucaucaggguaaguaagaugcacuugaaagggacaaauaauucaccugcaagcacuuuuggcuucaugccuuuucccaugaauuugaacuguugacagagaaugcucaggcugccaaaacacuucccacagaaccucccaaaauccccgagguugggaccagcuccacuugccaugcugugagaaggacuaaacacuaaccuuuugugcccuacaagagugcaucacacgaaagcaagaaaaugguccacuuccuuugggauucaggucuggggaugugcugcucuccucuguucccuuuuguggaugugguccuaugaaaggcucaccuguaaggcuggacaaacugccaagucguccuugucaaacugggugcagaggaccuuccacugucacacuguguauuucggcugccgauucaaaccgauuucuugggacaaugacccaucaagcugaagaguucaaaaugcauuaaguagauuuucaaacccccuccccccggcuuacaggaguauaacugaguccgugggaaaggguggguuguugccagcacccuuuuguacuuuuaagaggaagaucaucgucuguuaucccaagcuuuuggggcucucaucuuugcuaccaucccugggacuucucuguacuguaccaaaaacagacagugcaaauucuccauaaauuucacuuagucuagacuaggucucuucagggagcuccuugagaauuuuuauuuugugcuccucagacauaagcaauguugaaagagucaaacacauaugauauuaaaugcuggcagaaaguuguguaaaaucauuaguccacuacaugcaauaccaaaaauagauguuuaaccugaucguaucuguuaaauauaaaacacuuuuuaaaaaucuugugugcucaaaaacuuucagaaaauuuuuaauauauacacucauuuuuuuuaaaggugacccaucagaggagccaggauuaaaaaccucagcagagaaucguaauacguugcuaauaacuguagcauuggggaauucagucuuuuaaagguucugcuucuugugugugugauucucaggccccaucaacauaacaaaaaagaagaggugcacugagcacuuauuacugcagucauuucagcugcauaaaucaugauuccugacaacucaggcuguaaagucguuuggaugacaaugacuagcaaugcugcugccggaguuaaucaaauaauuauuuaacauguguuucucuuggucuggcccuggcuucagaacauauuucauucguucccaggccucuguagugccuuuacuuuuaaauaaauggaggagcugagcaaguguaagauaugcauaaaguuaaugacagaaucacuuaugucuccuauuggacugugcucucccucaaaagaggauucuugucuaaauuaguuugggugauacccacaguacccaccucaguguuuuguuccaggcuagcagucacuauuauuuuagcuucuucugggugaagccagcuuccugguuaaacucuuuuucuccaggugauacucagggggcaccuuuucuuucgggugguuuuucuauuccauuaccucugcaagcagacagccuggguuaggugcaugggugagguccccaggaaagucucaaagcaccucugccagagaucacuccuuaaaaugugagaggaagcaguggucugcuuccuuccugaagggaacagccucauauucccagccuuuuagcucuuaguaugugcucaauaaauaguugcucucauuauugccauuacuguuauuauguaaaggcuuaauaaauguuugcuaaaacauaaauggcccaaugaaugaauaaaugcacauaccuaauaagggaugaaauuucuacauaaugacgcuaaucugcauagacccguguauuaaauucagacgggcuagugugaggagaggaagaagaaaagaacagcugcuuccuuuauucagugcccugaccuguuaucuguaaucaggggauguauaaugagccacucaucuuuauguaccccaaauaucaaagggugaagaaaacaauagcaacucaucaaaaagcuugauccucugugaaauguccugggcaaucaaguuagguguuagugucuccugauuugcauuucauggcugcgaugugcuagcgguggugaggauugauaguuuauauggcagcacuuauuuaaaucuuucaaaaguauuuucagauauuuucaguaauuuuaauucaaauuaauggcagggguuuucuuacaaaauaugauuacuuacuuucuacauuuaguucaucuaaaauauacgcuuuucuugauuuuuucuuacaugguggucauuuuaauuuuuagcauccauuuguuucuauuccuaauauaaacuucagcauauuaggcaaacaaguuuacuuggcuuuugugacuuaaaaauauuauuauagagucauucaauuaaguucugcuuaaucuacuugaauuuauaucuccaauagaauuaauuuauugaaaaucaaauuaauauuucuuuaaucucaaaauuuacuaaagucauaaucauuuuuauuucaggcaugaggggaaaaaaaggaaaauacccuaaaaauuuguagagcccuagguauuaguuuguuuccuucagcuguuuuauaaggcaauauugaaaaccauauuuuguuuuucagauagcaaauuuucagugcucuaauggaagaauuagaacaaagguuagaauaagaauaagggaucuuuaaggaaauaacauguuuuuuaaaaaaggaauuauugugauuauagguugcuguacugccuucuauuuuuaaauugucaucucuuaucaaauugaaauaacauauuuguuuguuucuaacaaugcucuauugugauuaaucaaaaauuccuauuagcaacuucagccaaauuaaauuuaaaggagcuuaauugagcaaugaaugauaugugaauuggcagcccccagaaucacagcagauucagacagacucccgcagacaugugguggaagaagauuuauagacaaaaaagggaagugacauacagaaaucggaagugagguacagaaaucggaagugagguacagaaaucggaagugagguacagaaacagcuggauugguuacagguugguguuugccuuauuugaacacaguuugaacaguuagcaguguaugagagguugaagcauggcugccgggauuggccaagacucagccauuguuauaggugcauacuccuaaauuagauugucaauuuugucuaccuacuaaguuagguuacaguucucccacaaggacucaaauauagaaguacagagucguucugaggccguuuuuaguucacuuuaacagggaaaacugcaaugaucaaacuaaguaaaaguuucuaagaguauuuuuaucaaaccuggcagcaacaucuacacuuuaaaacagaaugcauuauguuuuuuuccaaaaauacagaagccuaucacuugucuuaccaguuacuuccauggaaauuugguggccucauugcuuuuguauggagcccugaugagagagaaccccaggauuaucaacuagagauuggagcuagcaaucuuuauucccauucccuuuauacauauaugaagcagagcuguuuuuaaguagaguuuaugacaguggaaguuacucuucagagaaguaaauuagagaguuuaguugaauguguuuaguuuacuuacuuuggaacuuuuacuguuuaagcuuacuccuuccaaacucaccaaagagaaauagcuccucaaauaaucagaugaucuguucuaaaggcaagaagggaaaauaauaagucaucucccccacugcauucuuuuuguuuguguuuaauauuuuuuauagaguuaauuuagauuuagcaggcuuuauguaaaguuucuucuggaagauuuagugaaucuuuugugaaaaccaucuucaucugacauuuuagaauuacucaccuauuuaugggauuauacugcauucuguucuugaaagagcaaauccauuuucagcauaguuuuuuucugucacuuuuuuucguugucuguuuuucugaaaacuaccuccaagguaagaggggaaaaaugggaggagauggaacguagaaaauaggauagaacugugucuugccagaggagaugaucugaauuagaaacuauugguugaaggaagaaaccuccaaagccaauacaauaauuuauuuaacuuuaggaaugguguuuaaauugucuaaauaaaaauaaauuuuuacauacuuccaaucuugucuauaguuacuaaacugcagaugcuaugaguuagacuucaaucuuggguuuucuaccccauguuaauaacagaagaaauaaaaacaauaaugaagaaguuaucccauaguguuuuagaaauuauauccaaucuuauuuuaaaacaaaacaaaaaacuugaaguuuuaugaaaauccauuggucauuuccaucuuccccucuugcagccaugcacugugcuauaggaauaaugaguuacucuuagugaguagcuuauacacagaacacacugucuuuuauccuccuguguauuaucucauuucaucaucauuucagcccuacagaugaaaaaauugaaguucagaguaguuacauaguuuguucaaguucacacaucuaauaaggggcagagcuaaaaaccaaguucaggccuuucccguuaugucucccacugcccuugcuaucaauuauucugcagggcaaaaagagaccaccagacagugaauaugaaugucagacagaaaaucaccuuugauuuguuuguaguuuauuuuuugcuuuugucauucuuuacuuacauucuugcuguuguugucugugaaacaucucuguccuaaauauuuuaaccuuucuaaauggaugucugguauauuccuuuauacacuugauuaagguaaccaaaauuaaauauuucaauuuuauuucaacauuuacauaucuacuaucuccccuacagccauuuuaaaauaauauucuaaagcaaccaaagaccaggauuaggucagagccaagcaacucaguacaucuuuucugaauucucagagguuuacuagagaaaguagaacuuuguaugaaugaaauaaacuugaauuucuggugaugcaaucauguuuuggaguuuagucuccucagagugcacaaaaaaaucucgaaauaacuaaguuuaaguuuuuaguaauuguuguuguugugguuuuuugaggcagaguuuugcucuuguugcccaggcuggagugcaauggcacgaucucggcucacugcaaccuccgccucccggguucaagugauucuccuaccucagccuccugaauagcugggauuacaggcaggggccaccacgccuggcuaauuuuguauuuuuaguaaagacagguuuucuccauguuggucaggcuggucucaaacuccugaccuaagguaaucaguccaccuaggccucccaaaguggugggauuacaggugugagccacugggcccagccuuaauucuuuaguaauuuuuaacaacaaucagguuguacuauucugauuuuacuauccagaaaacagaagaguaucaaauaaacaaauacuugaaauaaaauaaguaagaauuaacuguguuauuuaauacuugugaaacaguaucaaaaaacaacaaugaucaguucacaauauugaugugagaggauaacuacuuacuugagacaguauuaguuugguaaguuuccuuugaauuucaugguguaauuuuuagcauaacagaguucugugugagagcuucaucucuuuuccuuucucuuuggcagcuacccauuucuauaaggauauuucacuccaggcucugucccauaauuuggggggcaauacagggcacauucauacugguuugagaaauaauuuaaauuuuauauuucaaacaugucagauuucuuuucuuucuuacucuuuuuuuuuuuuuuuccuguuuugagacagagucucacucuguugcccaggcuggagugcaguggcaugaucuuggcucccugcaaccucagucucccggguucaagugauucuccugccucagccuccagaauagcuggaacuacaggcaugcacaaugccuccuggcuaauuuuuguauuuuucagcagagacaggguucaccauguuggagaggcuggucucaagcuucugaccucaggugaucagucugccuugaccucccaaagugcugggauuacaggcgugagccaccacgcccggccucaaacaugucagauuucuggcaugcccucuccccacuccaaaaugaauuccaaaaccaauuauucuucuccugauaaugauuugucccuuuagcauccggguauuagagaaaggaugaggugguuugaaccuauuuaagaugaacugcauuguuaagaguuuacuuagacacgggucuauuuacaguuaagcagugguucucaaaacaugucccuggaccagcaauguugucaucggguccagggacacauuuugccugggaguauauaagaaaugcaaauucucaggacucaccagaccaucauaaacuaggagugaggaccagcaauuggucuuuuaacaaguccuuuguuaaggucauucugauacaugcuagacucugagaagaaagauuagaaacuacugaucuuccaagauuagaagcuucugagaugagaaguuugguauucuugcugaauuuggauucagguaaucuccaguuuaaaaacuuuuuuuuaguuagcuaauguccagacuagagcuuaggccgcaccugagagaccuguuacaucuuucaaagcucuugaacacuuucuguugucucugucuuuaucucagucuugggauugagaguaaacccuuuucacaggcaaaagauuaaggcauuauuucucuacaucagucaucaacacaaagcauuucaauugcuauuguaguuguuucaugaacuuaguggcucagaaauuaaaaaaaaaaaucaguaucauucuuucauuucauagacaaaaacaguuuaagcccaggauccucagggaagaaaaacccuaaaacaauguaaauguaaaauuaaucauaauauauaauugcagaaauuugaacugauucaaagaaauuguccccacaaugguauaggaauagcuuccaaaucaggccauaccauuuaaucaaaaaaagaaaaucaauugaaaagugguuuuacuuauaaugauacugaguaaaaucagcuuuuccaguaagacaguugaugaaaaguuuacucauuugcagcgaugacaagaacaugcacuuuauuaugcuuugucauucaaaacuuggggaggcacugcagaguaacagacgaaccauggaguagaggcucaauccuaguaugcuccagaaaggacccguggacaaguuauucaucucaaaaaugaacauguccuacaagaucacugguuggcaaaguaugacccaugggcaaaaucuggccugccaccaguuuuuauaugaucugacagcuaagaauguuuuuuaauagaugacauuuggaauugaauugguaauaaugaacauuuuccuugaaaccaaauuaagugaaauguucucucuccaacaaagaauuccauuccccucacuaauaacucuauauugcaaaaaaguacuuaaugauuuacuauuauauuuugaauucuaucacuaaaaaaauaauuguaaaaauuuguuuucuaucuuauuacauaaauaccuucaucauauccuuggucuuccucuuggccucuggcucuuuacagaaauguuugcccauuccuggaugagaugauuuugaaggucccuucaacaaucuaauuuuuaacuaugcucaacagauagcagucaaaccacuuguagaaugcaggugauuuggacaauauggauuugccagcguuuggcuguucaugaauggaagagagucagauggguccaauaacaguuccaauuguccaucuucacccugcauguuugaaaagagaaagcagagaucuauagcguauuaguuuaagccauauugucuguguuagaaaauccacccugccuugggcaaacccuuaaccuuugugccuuaauauuccaucuguacuguggggaauuaauugguuaauguucacaccuuccccaaagauggcuggggcuugcacauauucacaaaaacuucaaaagcuguaaugcuuuuugacagauauuuuuucuuucccaucauuuuuucuuauauuauuaacauaagaaauaguuuaacaaaugaaaaauuuauugaagaacuaauuuaauaauggccauuaagagacuuugauauuucuaacauagaugccuaagcauacuggauauauuauguauccagugcacaaaaggcagaguucccauggaaacuuuuuggucaugugugccuaguaucaugcccacaagauaggguuggagagaccuauaagccucucuuugccaaauauuguauggagaccagcgugcauaaaggguucagauucuccuuagaaucaguguuggaauuucuagacccucaagcgacucuauauuaaggugcaaauuuguuaccugggaagguaauuuuuaaccccccauuaauguccauuuguuaguacuuuagcccaaauuagguuuuuaaaauuaccuagcugguugagagcaguucuucaggaaguguaucagauucuucuaaguagguucaggguaaguuuugaaaacagguccuugggggauugugauacauccuccuucacuuucagcacccugcguuugcaagaguagcaugugugugcacacggcagcacacacgcaauacuuaauacucuagcuucuagagcagcauugucugauagagauauaaugcaagccacauagauaauuuuaaguguuucaguagccacauugaaaaauaaauuuuagcccaggugugauggcucauuccuguaauccuggcacuuugggaggccgaggcgggcggaucacgaggucaggaguucaaaaccagccugacuaacauggugaaacuccaucucuacuaaaaauauaaaaauuagccgggcguaguggcaggcgccuguaaucccagcuacucaggagguugaggcaggggaaucgcuugaacccagaaggcggagguugcagugagcugaggccacaccauugcacuccaaccugagcaacaagagcaaaacucuugucucaaaaaaauaaauaaauaaauaaauuuuaaaggugaaauuaaauuuaauaauuuaaguauacauucaaaacauuauugcuuucaacauguaauccauauacaaauuauuagugauguuuuacuuuugggauacuaaguguuugguaucugguguauauuuuauacucacagccaguauucauugaccggccauaucucaagugcucaguaaccacauggggugagcaguuauuuuaauggacaguguagcucugagggaccuugaacuggaaagugggucacagagagcaaaguguggcugccuuuguggcugauaaaggcagcaagaggaugggcugggggaacaaauagaaguugggaccagcccagauccuuaccccuccauuauacccaagucauauuuuugcugaaggucagaccuaacucuagguaacuuaaccuuuuucacuaaaaacuuuuagaaaaacauaagcacuggaguuaaaugcuuggccuuaccacuuaacuguaugacccuggacaaguuacugaaaacccuguuucuucaucugcaaagugggaacagugauaaugccucaagcucacagaauuauugugacaauuaaaugaucaaugagcauauaaacaaugaauacucaaugaauacuugauauuuauuuucacaauugcuauuauuagcuacucuuaggcacuaauuuaguuuuaaaaugaacuauaaagacaaucagauacuaucaauuauucuacauuucuuaaaaagcagaaaaaugacauagccauauauauauauauauauauauauaaaauuuucaaauaguagguguaaucagcucauuaaauugggcauuauacugucacguacacacaucaaugcaucaaaaauccagaagauacuacguuaccaagacuaucuuaaaauucgacuuuguuaugguagugggugagccaaugaaagaagaguugguucuucuuuuuccuccuccuccuucuccuccuccaucuuuuuuuauucaaagccagcagaaagagauaauuaaagcaaagcuaaaggaauugaaugcaaaguuugcaucauacgugugaacuaaucuuuucuccauggcauaucuagaagaucaaguaagacacccauucagaugguucauuaacuagugaaacuucgguggaaauagggcaggaggaaguaguuucuugcucacaaagucauuaguauucaaaaauacagcauagcaguucucaccuaaaauagaaggauaaaaaauacuaacagucaaugcuuguuaugccaaguacaucuuucacagggguuuuguuuagaauaaaagagauagugaaaguuuucagaugcuaguaaguagugaauaaaugcagaauguacuuacacauuuauguaccaaaugcuggaaggcugugcaccacauagagcaaagaaauguacuaaaccaucaauuuacuaggucauuuuaaauguaggcagcaaaauggcuaugugcgugaaaagccacuacuauauuuugagagagccuuucuaagaauccugaaauauuaauaacauggucuuaauguaguuggagacaaaagaagguguuaaggguagcaaggcugccgagaauagcacaaugacaauuuuguauuuucugccuguguuuuauaaaagcaaaaggaaaagagugucuguuuaaagaacagcagccuucaauuuuccaaacugguauaaaauugguauuucccaaaugaauucacauauauuuauuccuggugacauauuaauaccagcuucgaggaaaaauaggaaaaaauguaaacuugcaaaugcacuuuuuucuuaaauucacauaauauauaaaacagguuuuugcacuguaagaaauuuaaugaaauugaaggcaacauuuuccauuuugauuuuugcaaaagaugaguuuaauuuuuuagcuggaaguagucuuaucagaauagcuuuucaaauaugccauuuggacuuugugaugaucagucacuggacaguuucuuguccuugucgaucuuccacucccacugugaguuuuucguuuuugaugcuuguugaaauugaggggugcaugagaaucagucaguaauaugcaguuuucugcaaacauucagaugugaaaaaaaugaaagcauuuugugccuucuuugcaguccugaguugccacaaguugcuuuugucgacugcgacugacugagugacaggcgggacccaguggguuuguguuccuguucagaggcucauuguguuugaugugagaaagcugggcuugacccccaguccuucuuccugcuaaagucaggguuucugauuuuaaucaaaacccuagggccaucuuaagcaugaccaaaaaagcaccuugcaaguugaaccuuaucuaauuaugcaauguguauaaacuugagacacauaaaucucagucauuggagcaacuuguuuuucuaagaugcuccgguccagugaaagacgaaagcaaauaagggagagauugaucucccagcacuuuuauugucagugcuccacacgucauaaaguuuuggcuuguuaaaggaaauuccauaaacaacuucaguuaguaagagugaaguaacugugugccuuccugagccccugcuaaauucccuuuccgcuugccauuacaagaguaugauuaagaaaaugccaacaggauaugcgaguggguggaacagacuucagcuggaagccauacagaugcuugauggaugaguagugacagugagaugauggcccuaucuccagagagaaucaagcaguuucauggaucucuuucuaguacucauuucaguaagaucugcugcguugcugcaugguuguuccguuuuggcugccaggcugauggaaaauggcugauagguccuucuccccacugcuguuucugauaguauagacaaguccuaaggacaugaugaaugaaaagaaacgagagugaaucaugcuggaaagauuguggguuacuggcacauuuucuuugaaccucugguguuaugaaauaacuuuacucuuaauggccuugucucuguggguuuaaugcugaugguguuggucaauuuuuaucugggguugagacagauuugagaggcgaucaugaaaggccaugggggaaggaaaaagaguggggagcaaguagucauuauuuuuuauuaugaguuuucccagaauuagugaguuuuuccacacuacuaaaagugguccuuagugucaguaugaugacagugucagugugauguuuaugaagaugaagucauggaaaggaugucagguguauaaaaaacuauauggcccguguucucuacaccaggcucucgggaggugugugcauugcaggggaagggugcuggaaaaauggaaagagggaaaaacaggaggguuuuaugaacuugaaaauagacacaaaauauucgcugaucaaaaaacaaaucuuagcauacuauauuccaaaaucuccaguugauaguuuuuguuauuucacccugaaacugugacccgugccuuacaagcucgucuuuuuuacuugcuugccuuuguugaucuuucgauuugguucuuucuguaguuguaauugggaaauaaucaccacccgguuuuuuugucagcacuuggauacacuucccacugguuggcuaaaggcuacacucugaaauuccauagcaugugacuaagcauacaggcuuugagggcagaacacuuggggucaaagcugggugcugacacuuagcagauguauggucuugugcccucaauuaacugcucaaagcugaaauuccucacuucuaagguagagauaaugccugucgaaaaggggugcuguaagaauuaagcagcauaauguguauaaaggguaucuggcacauagaaaggcguucgguaaacuuugcugugcuuuuccuugauucugccagguuuaagaaaauuucuuccuuuggacuucuugacaccugaccaggaauguuaauggcccuuaaagagcgacuauacucaaugaaugcuuuugguugcaugaccugcauuucaagccacaugaucgcuaaugauuagcaagaacgucucccuucuucugaaacaaggagguggcuuugcauuuuugcuuuggucuauuugcagugguuucuauuuguuuguuuuuuucuucuucccugcagcuugcaaaauuggauauuacaaggcucucuccacggaugccaccugugccaagugcccaccccacagcuacucugucugggaaggagccaccucgugcaccugugaccgaggcuuuuucagagcugacaacgaugcugccucuaugcccugcacccguaaguuguaugcuugucucucauuccugugaugccaacagcuuucauuaccaccuagcaaggcacugccaggucuucuccugggauaaucauucagggggcacuugagaucaaacauucauccuuucucaaucauagcaggggaaaugcuuguaaaaagaaagggucuuucccacugcuucugguugccuucagugugcacagcugccuacagacuacuugguggagaagagauugaguguucagagguugucugacaguguaauuagagcugagauuggaauuuauuaguggcuuugccauugcacugaggacucagggaagcuugacaacuggcaggagaaacagguagacggcaggguuugggaaugugguuucagucuguaaaggacagcucagugugcacugagaucauugcuuagguugucauuacaccucuuccuucucuacucauaguuuuguguucauaagacuuaggccccaauccuaauaaaugcuuguuuaaugauugcauuuaauaaaugcuggguuaaugaauggaugaggcugggaagcuugguaugaagagcaggagugaagaaauauuuucucacacuuuauauggacaguguuccuagguguuaccauuccuuucauguacacuugggccuucacagacccuacaauggcugugaccuugaucggaauggggagcacugggcccaugaauuuccauuaggugaaucugugcuuggagggcuagccucauggcucaggucagacaccuuccacagauuuugaguuuguuucccagccuguuguguagcuggguggcuguugagucucuucagucuguuuccucaccuggagaauggaguuaauaacagugccuccuaaugguuguugguauuaaacagccucauguuguuuaugugcuauguacaucgcauaggaugaugccauuucauauauuuuagcuuuggccgggagcgguggcucacgccuguaaucccagcacuuugggaggcugagguggacggaucaccugaggucaggaguucgagacuagccuggucaacauggugaaaccccgucucuacuaaaaauacaaaaauuagcuggcaugguggguggugccuauaaucccagcugcuugggaggcugaggcuggagaaucacuugaacccaggaggcagagguugcagagaggcgagaucgcaccauuacauuccagccugggugacaauagcaaaacucugucucaaaaaaaaaaaaaaaaaauauauauauauauauauauauauauauauauauauauauauuaguuuuaguuaucauuaugacuauuauuauuuuguuuccuaacuacuauaaaugguauuuuggccaaucuggagcuaacaacccugcaaauaaaagguuuuuggguauuugagcacuuugggccacugggcaaucaaguccugucuuuaaaaugaguggagugagucuccaggucucucugacuuuauauucaaauugcuguaaccuccagaguuucuuucauaaugagagauaauaaugaugaugaugacaauuuuauaauuaugcccagguaauguauuagguacuugaaaaaaaucuuaauacgugguuuauaagaaaucuguuagguagguauaaucuuuauuuuauagaaaagguaacugcaagcucagagauguuaaggaacaugcucaagaucacacccuaccuuggacagaguuguacaaccugaagacucaccuaguuucuauuuuauauuauuauuauauuuauauuauuauauuuauauuuuauauuauuucuauuuuauauuauucuauuauagagaaucugggagauucucuugcuggcucucccaagucaagcauaaacauucagaguuagggagaauccuagggucagucucagauguaacuguuaaaaagguuagaugcaguagcucaggccuauaaucccagcacuuugggaggccgaggcaggcggauuauugaggucaggaguucaagaccagccugggcaacauagcaaaacuccgucuccacuaaaaauacaaaaauuagacaggcgugguggugugagccuguaaucccagcugcucaggaggcugaagcaagagaauugcuugaaccggaaggcagagguugcagugagccgagauugcaccacuggacuccacccuagaugacagaggaaacucugucgucucaaaaaaaaaaaaaaaaagaaaaaaaaaauagccaggacuggugccuuucaccuguggucccagcuacuugggaggcugaggcaggaggaucacuugagccugggaggucaaggcugcagugagcugcauucacaucacugcacuccagccugggugacaaaaaaagacccugucuuagaaaaaaaaaaacgaaaacagaaaaacuguaaauaggcaaggauuguuuuugcuuucuuucuuuccuguuccuccauagacuaagaacuuucucugcguggccacuuuuguuugaacucuucagucccaaccuuuuucuuuuccaauguaaauauuuucaugcuauguuccauuugugugauuaguuuaauaauaaacuccccaucuuuauccacaccugcuaccaacaauuuucuuguaggaaucuggggcacaauaguaaacucaaggggaaguguuugaggcugacauuuugaggauggcccucaauuugcaucauguacucccccacuuacuuuccaugcagauaaagccuucucuagguugagauuugauuguauuaugagugucaugaaauguaucucugauggcaggagguccuggcucuuucucccagguauuuuucagucucaugaugcugaccuguuuagcauuuaaggggaccaugugcccaucacuuuauuaccaagucuugcuacuugggaguuuaggaaaccuccaaagauggccauaugucuguguugcuggaacauuugauguauguguaauaaggcugugguaguugagcccuuggaauuguauuuuuaacuguuagcuuuaucuuaaggaugcaaaggggaagaagagaaaauuugauuuuagcauauggauggaccaaaaagucuaaaaauuaaaguaacauuugcauguuucagaagucauuuuccacaaggugaagggaaggaaggcugguggcuuuuugugucauuguuaaaagguccaugaaaauaccugcucuuggaacuccuucuccuacacuuuacuacuucaaggucuugugcauuacuuuacuuacuuauuuuuucauuuuuuuuuugagauggagucucacucugucacccaggcuggagugcaguggugugaucucggcucacugcaaccuccaccucccggguuugugauucuccugccucagccucccgaguagcugggacuacaggcgcccaccaccacaccuguuuuuguuuuuguuuuuaguagagacagaguuucacccuaucggccagacuggucuugaacucgucaccucaugugauccauggaccucagcuucucaaagugcugggauuacaggcgugagccauugcacucagccuugugcauuacuuuaaugguuaucacaucccacuuacuuuauaugcagcacuucaguuaagaggaaacaaagugcugauggcgacgccaucaacuugcugaucggaucgccuuggcuguaaccacugaccaacacugugauauucagagagaguuuacccucaccaggccccaauuuccucaucuguaaguuggaauucucaccaucuaccucuggggcuguuuuaagaaugaaauaaaaaaaauuugcaaaguucuggcaccugguagggaucuaaucaauguuuguucucuuccucuuuuauuuccagcuggucacuuccuuccccaaacugccuccacagcagguugacagcuaucucacugccucucuaucagugauuuuuuacccuugcgugcauaauuaaauuacuugauggcugcccuguaccccaggauuucugguggggggguaggacucaggcaucaguauuuucaaaaaucagucuguuaauuuauuguacaguuaagguucagaccccuccaauggaacuaaauuuuuuuuuuuugagaccgaguuuugcucuugucacccuggccggagugcaaugacacaaucuuggcucacugcaaccucugccuccuggguucaagugauucuccugccucagccucccaaguagcugggauuacaggcacacgccaccacaucuagcuaauuuuuuguauuuuuaguagagauaggguuucaccauguuggccaggcuggucuugaauuccggaccucaggugauccacccaccucggccucccaaagugcugggauuacaggcaugagccaccacacccggccaacagaacuaaacuuguaaguauuuuuuuaaacuuaaacauuaacugcauaagccucugaagacuuccucugagauagggauaaucagggaagugacuauacuuugcugauaauagauauagucguaagucaggcagcagaacuggauucuaauucuuagccuauggcucuuccuuucgacaucucccuuccuagugaauauaauggaccuguauugucuaguacuguagacacuugacacguggcuauuuaaccuuaaagucauuaaauugaaauuuagguucuuauuuaaacuuggcacauuuugagugcucaauagccauauauggcuaguggagacuauaccggacggcagacccagagaacguuucuaucaccacagaaaguucuauuggacaauacuguaguagacguuccaacagagaagacaguaggaguuucucaaagaaccucuuguucagaugauccacagaguaacucuccccacucgcacgcugcccccagcuuuaucggauucucuugacaagauguggggaugggaagcagcauaaacaucagggguccuuucaaacugauuccagccucuaaucaguucuucccaguugguuaagccaggugacaaacccaauucccuugugcugacagccaugauaaucaggcaccuucuuuguucauuaugcugucuuuaaccccagcauucuuaugcagccucgcauuuagugaucgcucacugugacggcacacuaaugaagaaauaaaacacacuaucugagccucauucuucuagccaaagagagacugugcuccacuggcuuguaaaaucagguuuuuguucacuuggagaacaauuagaccaggugaauaaaaguagcauuggcuaauuuagaaggaaacugccuaggaaguuugcaccauugacgcugcuggagagcuuaagagaauuuaaucguaaacaaacuuuaccuuugggaauacuuuugcuggagccucugguuagguuaacauaaauggcugccugugagaugugcugagauguuucuauggaagcaccaucggaacauuuucuggaaaauagcccauaacuauuuagaacagggaguuuagaacagagcuuuuuaaacauccacaugcacaaaaaucacauggaaaucaccugcggauuaggaggagcgagguuaggccugagagucuguuucugacaaguucccaggugaggcugaagcuacugaucuguaaaaccgucuuuaggcagcaaggauuuagauucccagccccacggcugucaggagacaggagauucuguuuugaugccuguaacuuucagaccuguucuucagcucaguggugacucuagaaagguauuucauggauucugaucauucucccuucauggaaauggaauacuucaucugucuccuguaugaagaaaauccagccuggguagaaucauacaaccaaaugcacucacuguggaauuauuuuucuuuuuaauuuugcuguuguuuguuuguuucuuccagaauccucaccaaguuauugccagagaguagaaauguaaauguucaccuuagacaccuguaucagucaagagaggcaagaaguuuuuuuuuuuuuuuuuuuuuuuggcaacauugccaggacaagcaccauuauuucugcacauucagggcugccauuaaagcugaugucaggauuuugauuuuaugaaucuuuucuuaacagggauuuugaugugauuuuuauuaaugaaauuaaaguccuuuaacucuacgaaugacuagcucuuucccuucuccagaucuguuucuccuuguuucccugccccuucuggaaugcagucugguuaucagcaggacugggcguggucaaccucacaccccugcaggaagacuucugauggucuuagucauguacuugcuuguucaaugauuguagugagcaagaucuucuuuucccccacugggaagcuaaaucaauguuauauuuaaaguaacuuucuuuuuuuguuuucccuuuuuugagauagagucucacuguguugcccaggcuggaguacaguggcgcuaucucagcucacuguaacugccaccucccgaguuaaaacaauucuccugccucagccucccaaguagcugggauuuacagacaugcaccaccaugcccagcuaauauuuuuguauuuuuaguagagccuggguuucgcuauguugaccaggcuggucucgaacuccugaccucaagcgauccgcccgccuaggccucccagagugcugggauuacaggcgugagucacugcacccggcauuaagguaacuuucuuuuccaaccccuuauuguauuucaaaaugugcuagaaaaguaccuuguaaagguaguaaauuggcuuugcauaucuagaaaaauguagcucaucugucauuuugccaccuugacuucugagcacuguuaccagaguaguuuuucguauuuuucaauuggaaaucugucccugugcuuuugggugcucuuuauuuaacuuguuugaugaaacuucuuagagccuggugauugggaacacucuguaaaugagagauuauuauuuuagauugccaacuugaagggccuuuacgaaucugucuccaaguaaacagccucgaaugugccaaacaaacaaagagugauugauugauacuuagacguggccgaaaauauuccaaaauugcagcuuucaagacauuuuauacuaggagagcucagagcuaaugagggcagauuuccuaagaucuaugaccagagguccugauuugaaaaaacuuucuccagguuuacguuaucaagaaauugaaacagccaaguuccaaacaacaaacaucacuuacuuugucucuacauuugccuuuucuaauugaauuuagugcgcugcuguauuuccucccagaaaguguauuguuuuaaaauuaccauuucaguucuauuacucaaagcccucgcugcuaaugcuuucugacaguuaucaacauaaugagccauaaugaaaugaugagcaaucuucgguggaaacccaaugucgauucgaccggugcugugugacuguguugugaaaauuugaaugcaaauuaaaauaacaucguccuuacuuguuuccaaggucaggagaagggagggacucuuuuccuuuuuuauuuuuuuauuuuuuauuuuuuuaagggcuuuaauuuugggaaucucacauccauuuucaaacaagcucuugaaggugccccuguuauucuguucaauucucuaccccaaagauuuacaugcuuagcagucuggcuaagggauuuggggagggaugucuagagcgaggcuuugauguauaaaccauaggauaaaaugcagccuucaguuucaaguaaacuauauauuuuuuuaucuacccgaaagcauauuucuuuuugcuuuagagcugcaaguaacuaaucauauaaugaugggggaggcauacauucugugaaauaggucagugagggugcaguuagcucuagugaaagacuaguuagaaaagugagaacaaaggccaaagauucccaaagugucguaaaugaaaguguuucagaagauucauugguugaucucuagccauuuuaucauucaugcaaucaaucauuuucgugaacauauuuuuaugaaaaaucucaaauccaaguuuuccaggggaauuucucauuccaugucauuuaucaaauuugcaauguaauaguauaguuucauacugcauuccauuugucauaggacaaaaacucagauugagacaccaacuccuccacugccagauuacauaguugguuuuuaguucagaacauaugguccugcugccuguuaguugguaagccagcuaaugugucugucccauggacuguacaaacugaucaaagcaaccaaagacauuuggacgauucagaugcagccgucaacguaugcugcugcuucaguuagagcuuaguaguucaacaucugauguuagcuagugaguauaccacauuuuuguuucuuccuuucggauugccuuucagcauuuuagcuacuaaaaggaaaaaguaccucuagacaaccaaguggaugguuuuuguuugaagaaaauuaaagauaaagggagaaagaucaccaggugagcuucaacgaaggcacuagauagaccccagacugaucauuugccauuugguuguuugcaaaauuuuaagagccucaugauauuucauaaagaucagguaucaucucacugaauucuuuuuaaaaaaaugcuguuuuagcuuccucuuuuuuuuccccacauacuccccauuuuauagucauaaacagcccauuauggauuccacuggaaaaugcaaagauucgagggacacuaauauaugcccaaguggaaggcuugaauaaucugccaaugccauuuagccagguuauuacaauuuuucuaccacccugaauaauuaagaguggcuugucauugaccgaguccugucauuucuggaugccauuuuugacacuaugcauggaagucauacagugguuauucacagcaugcuucuaugaaacaagguuaauuacacauuuuucugagauccccuggggugagaacgggguaucuucuuuuuuucuuuuuuuaagacagagucucacucugucucccaguggugcaaucucagcucacugcaacuuccaccucccagcucaagcaguucucccaccucagccucccagggugcuaggauuacagaaacgagccaccacacucagcccaggguaucuucuuugcuaucaacauuuagauuuaugagagauucugcuauagagauauaauugccccucgcccuauuccuaugaucuuccaccuagaaaaagaaccuuuaauagaaacuccuagccacucucuugcacagaagguaggaacaaggcagaaaagauaauccccaugaaaaugauaaaagaggaucaucugggaaguaguacuagcuagccaucaucaucaugaagggcagggaagugaggugaaauugaacucuggggugaacugagaaaguuggaaacuuucuauccaauucucaaaaagaauuuguaauuauggguuauuauuuucuuuauauuauuuguaucucuaugaaagggaagcaggguuguuuagccuuggagucaggguuucugaucacagcuuugcgcauguuggcugucuuaauuuuggcaauuugcuuaacuuaucuuaguuuuuggcgaucagauuguugugaacaauaaauacuuuucugucagauuugauugcagcuguuaaauaagauacaaaaaagugcuuugcaaggaaaguaaauuaaugcacaggcuagauaauuuuaaaaaugaaauacucaauucuacuuuucuuggucuuuggcgugguagcuuucuuguguauaacugagaauuuauaaggcacuucagccauaaacaagucauccuaauaaaaagaaaccaaaccccuaauuaacccaguaaaaaaaagacaaagaucacuggagaggagaaugggaaaggagauagaaccagaaaaauagguuaugggaaagucucacaacaagaaaugaaccucuauaggaagccaagaauuuuucaugacagcagcaagugauugaugcauccaaaagguucugguuuaaucauggacagcccugcuuggcugucuuuguuguaaaaacacauaaaccaccaugauaagagguuaugcacuguucauauaugucaggagggaugucuuuaaaacagccaucuuuauguaaacuaacccacagcagauaggacugggagaaagcaauuagugguggcaacauauacaaaugucaggggaagcaugggcuuuauuucagagucaaaacguaaugcaucccaacuguugacucuuccuuauaaccugucuuucagcuggagagagauuaacaacaaaggcuuaucugaaggguugaaggguuuuacagcuaagacgcugaagugcuauugacaguccaaaaguuguacaugauuaaugaagccuuaggaaauggaacuacagacccaaggugcugcuuccuccaagauauguguuggacugguugccuuagcauuuuagugaggugacagcagugcuuaaauacaucgaucaugggagaguuaccuuucugcccaugcucuugggggaugcuccauuucccauccagaaugaauuucauagcccaggcauugaauuuuaaaauggcgauuaaaaaucaguuaaguauuagaugucugugauagcucuggaaacuacucuaucacaugagaccagagacuuugguuuuucuaucaacugucuucuugccuugguugcagacuugauuuucuuucuuucuuuucuuuuuuuuuuuuuacauuuuagcaugugauugccauuuuuucucucuuuauuauuauuauuauuauuuugcuuagcuuuugugacauacaaaagugcuauggcaguggguuuuuuuuuuuuuuuuugagacagggucucaauucaucacucaggcuagaguacaguggcaugaucccagcuuauugcaaccuccaccugccagguucaagcaauccucccaccucagcuucccaaguagcugggacuacaggaacaugccacuacaccuggcuaauuuuuauaauuuuugcagggacaggguuucaccauguuucccaggcugaucuugaacucuuaggcuugucaagccuuccaccuaccauggccucccaaaguucugggauuacagucaugagccacugugcucagccauagugcuaugguagugaugcuucugauuagugagcuggacugggcuaaagcaucaucauucauucauuuguucauuuagcagauauuuauugaguuucuaccagaugucaggcauuacucugaaggcuguagauauucucauaaaccugaaaaagagaagauuccuuuucuccuggagcuuauguucuaaugggaauauaaacaaacaaaugaauaagauaauugaagguucuccuaagaaggaaauuuuuaaaaaugugaugcaauugggugcauugggacagggaaagggaggauuucaguuuguauggaguagucaggaaugagaacuauuccagggauaagaagucagucagucaaagggccgggagugagaauuccaagcagaacuaccagcuccaagguauuuugaguugcaugugcaaaauuuugcuaacaaugugaguuuuaaaguugacuuacuuuuuuccacaguuuugcauucuguuggcacuuuaauuccagucguuacgagaaauagaacuuuuagguuuauauggcacguuacaccguauauccacauauauuuaagcccuuuggcagaacccauuucugccaaacccauuucaaaacgcaauuaucauagcagguuuucaucuuuuacugaaguuucaguugcuuccuguaagaauaaagaaaugcauuuucucugacuuugggugugagguagaguacauaggguaccuggacuuuccauggaaugguuuauaccaaacuuauagacacacuggagacauuucugacuuuagguuuaguguuggcugacggcuuuuaaaugacauuauuaaggcucacacagauuucauguggauauguaaauacuggcuuguccuaaaggggcuacuuuaaaucuugacauaagccagcaacuguguucucuaaacuacucaagaauuaaauuuuagucuaauccaugggaggaaagaauuaagauauguggaauuacuggaauuuucuuuuaugcuuggaauauugccguucuuaaaugucacauugacaguaugugguucauuuccagaagcuuguuuuuuuccccagagaagagcacaugguugguaaaggaagaucaagauuccuuuuauaauacaacaugauaugaugugauauuuuauaauaugauaugauagcccuuuguaucuacuaucauguggcuauaguuucuuuggggcuuaaugcugucaaacuccugucaacugaaugugaggugacaucccacuagaaaauaauaauuacccauuguagcaccuuucucugguacuugcugugugaugcagaaaguauuucacaccagugaagugaauggauguucauuaaauguaucuauaauggcaagaaauucagugcccguuucuuucagagcaaugagaaacucaagaaauaagccauaugucucauuuuauucccuccuuagucaauaaagguaggucuaacuuggacuuuagcagccagaguugucaccugggcuauauacauagguuaaucagggguuccuggacugagcuuuuuagauaggcuuuuuaguuccuggaauuacaugcagaauucugagggugccagagagcaucuuccuaaaaagaagaugccuugcuuucaucauauuuucaauagcacgaaauggucugaaggucaauuuuaacggccaccuauuuuugcaaauaaguuuucuuggagcacagccaugaucauuuguuaagguauugucuauggcuucuuuggagauagaauuacagaguugaguaguugcugcagggagcagauggcccauaaagccuaaaauauuuauuuucuggccagaucauaaaauuucuuuacagagaaauuaugccggccccugugcaaaagauuuauaaacuaaagauuauugcauuugacuucuauuucugggauuaccauuaauaucugggccacuaaguuauauuacaaauguaaagggcauacuaaauaugaaaacuuuaaaauaguugaacaugcuauuuucauuuuugggugcaggcacagagagaauccugggcuuauaugugaauuucaugggaaauuuacaaauacaaccaaaaacgugaaggaaggguguuuauguucccuuaaauacaccucagcauuugauuaauuuauaugagguugguacaaaaguaguugccauuaaaaguaaugacaaaaaccaccauuacuuuuguaccaaucuaauauuuuagaaugucuugauuugggugaaaaaauuaaaauuaaaggcaaaagcuguuguuccauaaagacuaauauggaaaauaccugucuaccuuuagaaauguuaaaauuaagcuucuucagagauaaaguuuuccccagagauaaagcuuucaugucugaguaaaucaccuccugaaaucaagguggaggaagaaaaguguaauaaccaaucccaauuugauaaaaccuuauuugauagaacccacauuucaaauucccagccgucgcugguuacacagcuguaaaaacaggacaaggcaggugcuugcucugacauccacugcacauauaaucccuauuuaguuuccuugagucucugccuuuuucccuagguucccuauccauuccugcaacuaucuaggcaacuaucaggaaguuaucaaaaugaauaagaauauuuuuccucucuccucuaaagcaggugauaaacacuagauacaccauaaauguuuuuugaauaaaugaaugauucacaaucucucccagcagaaguaaccacuaauauuuuauauauagcccuuucuacuuuuuccaaaguaauucuaaaccaugaaaaaaagaggcaauugaaacaaacuaguuacacugaguuacuacuucacagguauaaagcuaaugaaucuguaugugaaaaguugacuaguacagcuuuggcucggagaaggcugcauaguucacacacuucauaacacuggguauaagaugcauuaaaggacuucauuaguuuuuaauucauucauucauugacuuaucaaacauuuuuugaaauuucugaacgaggaaccaugguagaaaacaggaagugauaaagacaucaauuauuauuauuauuauuauuauuauuauuauuauuauuauuuugagacagagucucacucuguuacccaggcuggagugcaauggcgcgaucucagcucacugcaaccuccgccucccagguucaagagauucuccugccucagccucccaaguagcugggacuacagacgugugccagcacaccuggcuaauuuuuuuuuauguauuuuuaguagagacggggguuucaccauauuggccaggcuggucuuaaacuccugaccucaggugauccacuuuggccucccaaagugcugggauuauaggcgugagccacugugcccggccaagacaucaauucuugaggagcacauauacuggugauagaaacagacauggaauggugucuaaguagcaagacaccauuauauguuacaaacaaagcaggaaaggaaauaaggaacugaaaugucaaacaaugacauaagcauaaggacugguguuaugccaguccuguauugaggcuaguaguggguaguuuugaaaacaaaaucuugccauucacaaugacccucaagcuacccgauggguguauguacucaguaggucgauucagauguggagacuagaaaauuagaacaaguacaacaguuagcccuuuuuuguuauaaaccucauauuuguaauuggagacuuacucgcagguggacauauuucugaugacaaaggcaaucacucugucagaaauuuaauugcuucuaaauagccagacacaauacuuacauaaaugaaagagaaaauaaucggaguuagguuuuuuacuucuggaugccuuguauuuauuaaaagagagcucagauuacucagaauaccaguuuucucuucuuuuuagccaucucuguagguaauuguuuaccaagaugcugcaguucgguauuaacuacaggcccagauuggcuuuuggcuauauucaagcccauauuuguuucucaaugucuugagaauagaauacuuuuauucuccuccuccuaaagaggagaugggcccucccuuuaaaugagaaacacacuuauauauuuguaaucuuuuaauuggcagggaaacaaaaaaaaagaaaccacaaucccacaagcacagcauaccacauuaugauuuuaauuuguaaagcguguguccucucccagguuuuuuuccagaccaacaucauagucauauuggauggauuuucuauacuuuguuuuccccucuaucauaugacuucguuauacuccaauuucgaggcagcgacaguguccccacaaagcugucacucucuaugauagcaaagcauaaaacauacgcaguacgauuuaccagcacugaacuugaauuugccuaauucucagucuugagcauccaacccagagccuuccuucagaaucgcugcccacaggaagaaggcugcccuagcuuagcacguguuuucgugccagcccuccauuuugaaauccugcagcaucuuugucauuuuuuuuuccacguggaagugcuauaucucugaguccugaaaccauuuaguuuucugcuccauuucuucucuguuuagacacugccgugccccguccuacauacuaauuacugacuuuuugcuucuguggugcuugauucauugugucacauuuucccaugugaaaguggaccaggaaccuuggcaaggagguuaauggauuucagagucacucuuauuuaacccuggaagucacagcaaaagaagaaccaaugacugacccauuugauaaaccaagcccuggucagcuucagcugcagacuaguaauggauuucacuaugguggcaagcauuacagaauuaaaacagggcugaagauagcucacugccaccuccauguuugccuucucaaacuggcugaaauuuuuccuuuuguuaucauuauaccuuuagugaggaacacaugguggaauaaaaauaacuccaaauggcagauaguacuuuuggauuucagucaaauucugucacuaauuagauugcaugaacuuucaguauuauuagauuuacuuuccagaucucagcuuccucgucuuuaaaauaaggguauuuguccaaaugauuuuaacauccuauguagcucuuagagucggugauuuuauguacuucauuuauucaaaaagcauucauuugucauuauauuccaguuaccaugcuaaaaacuguaaaugcaguuuugaaaucuaaacaagaaagaaauuuguauuuucucucugaggacuuaugugaaguaaucuucccuuuaauacaaauuuuacaauacuuuugugaaauguuuuaaagguuugcauuuuucuaaguuucacaggauggggagcugaucuuaaugcuuaaagagguuguugguaauuaguccugaggggaguuugggaaguccugcuuaccuuguuaaaauaaagucuucaauaagugggauaaagagaaaaggagagugaauuacccuuauuaaauguuaccacuaaaaaauaauuggccauuaaucacugcaagcuauguaauaaauauugaauaugauuucuuauuuauagguuaccucuuccaauucuaucucgacagccauuuugaacaguauguuucauugugguagacuagguaaagcucauccaaguucaugcaagccuccuguuaacuuucuuuuccugagaaacuuguacuaauuuccugcaaaguagccaucucaauuacauuagaaguaguauagauaacagugaucuagaaaccucaaauuuuucuuaaaacucauuuugcucaucucuuggaagacugaaaugggaaagaaauagcuuuccaacugucaaacugaguagcuaugucucguuugaguguggcagcuaccuuuuaagccuuuggaacugguucagaccaagaaaauucccucucccuucucccagccugauucuuccacuugaaagcaguuugugucacaauuuuuuugcccuauuaagaccaaucauggccgggcaugguggcucacaccuguaaucccagcacuuugggaggccaagguaggccgaucacuugaaaucaggaguucaagacuggccuggccaacauggccaaacuccgccaaagauagcaggugugguggcacacaccuguauuuucagcuacuugggaggcugaggcaugauaaucgcuugaaccugggaggugaaaguugcagugagcugagaucacaccacugcacuccagccugggugacagagcgagacuccaucacacacacacacacacacacacacacacacacacaaaucuacaucaagaaacaagaguuucaucaugaucuauagucuuauuuuuuauuauuaauauuauuuuuuaaccaaccaguauguugucgguaaucaguuguucuguuucauaacaaccacugccaucacccauauuucagaaacucuuugauguugcugggaaugcacgaguuaaagggcaggaggaggggucugggagccuugaacaaaaccccugccaucucgccacagcuguaucuucaacaucucugcaaccgcguuaaaccaguucguacuaauuacccauaaacagcuuaacccuccgcugccauguugaacugcagaggcacauuucuacaguucuguuaauuuuauuugcuauugaugacaugcuguacuuaggaauuauaauuuaccuucagaagugguauauaacuauuaauuuaucagagucucacaacggcccugggaacuagaaucacuuucauuuuuuuagaugauaagauggaacagauaaauuaugauauuuuucugccacuucauagggaaagccugggcuuggagcccauuugcuggagaguugcuucacaucucaaagugacaaccgaugccuuguuuguuugcgugggaaagagaaugacacucacguaacagccuucuauuauauuguucuuuuaaaagaucuuuuaugcuggcuugauuugcuuuuugcuuucuuugccaaguggguuugccuugcuuuggagagcugcagaaaauaauacaaacucugagagauuccaaaaggguauuucgguucuuggugugaugaugugguuuucuuucuccagguccaccaucugcuccccugaacuugauuucaaaugucaacgagacaucugugaacuuggaauggaguagcccucagaauacagguggccgccaggacauuuccuauaaugugguaugcaagaaauguggagcuggugaccccagcaagugccgacccuguggaagugggguccacuacaccccacagcagaauggcuugaagaccaccaaagucuccaucacugaccuccuagcucauaccaauuacaccuuugaaaucugggcugugaauggaguguccaaauauaacccuaacccagaccaaucaguuucugucacugugaccaccaaccaagcagguaggaauugaaucuacuuuauuguaugaucugaauguauacagagaaaaggcuuaaaauaaugaauuauaauaaauugcuauaauugaaauagaaucaaucaagccugggagcugcguuauaauguaaaagauacuuaggggcugggcacgguggcuuacacguguaaucccagcacuuugggaggccagggcagguggaucacuugagccugagaguuugaucaagaccagacugggcaacacgaugacaccccaucucuacaaaaaaaauacaaaaauuagcuaggcauggugguacaaaccuguagucccagcuacucaggaggcucaggugggaggauugcuugagcccagcagucagagguugcagugagcugagucacuccaugcuggaugggauucaucucagucauuugaauuaugauguccauggcuggacaucagagcacuuauagauuauguacaauuauaaaauugauuuuuaccaaugcagagugcucuuuugguauuuguuauauuuucuaacaaaagcauuagcagcaauaguuuugaucuuaugcuuuaauguaaaauauuauaaaugaucuagguggaccuauacuagaaccuccauguacaucuuugugucuauaguuaacgaaguuuacuuuaagacacuuaauaguuuugcagcuacuuuuuucuuuuuuucuuuuugagacagaguuucacucugucgcccaagcuggaaugcaguggcgugaucucggcucacugcaaccuccaucucuggaguucaaccaauucuucugccucagccucccgaguagcugggacuacaggcgggugccaccauaccuggcuaauuuuuauuuguauuuuuaguagaaaugggguuucaccauauugaccaggcuggucucgaacuccugaccucgugauccgcccaccuuggccucccaaagggcugggauuacaggcgugauugcagcuacuuuuauaguugauuucuugauugacgugggggcugggaggguggggcggaggguggggcggccagucuccuccaauuccuacaucacuuucugcuaauacagaugacuagaaaacauuuccuguucaugaaguguuucuacugaguuaaucgcagaacugucaugaaaucuugaauaucaaauauuuugaaaaucuagguuucuaggcuuucgcuucugacuuacucaucuguacuccuucccugaaaaaguuaccaccccuccaggaguuuuacauugccggcuuuuuuauuucuggagaguuagagaggagaagggaaacagaguuagaguggcuuauucuuugugaggcucuugggauagaaaacauagccagaaaaggauuauaaauugccaacaauccuaucgccucuaacugcacuuuucuuuuaaaugaauguuucaguaagugcacucaauaguuuaguaaaauaucuguacuaauugauccuauaagugaaaacuauuccagugucccaauccaaagccauuauuuuuccauuuugcccugaacucuuuggaauaaauaaaaaguuaagacuuggggaagguuuugagcaggggcuagaauggcaagucuuaccggaauguaucuucagcucugcaaaugugaacagucuuuuaaaauaucuaaugugaacgggucauccagcuaggccuuugucuuuuaauucugaauuuuuagguugugaacacuguucgcagucauuaguuuuauuuuucuacaaagacuaguaugauuuaggaguuuuugauagaaacaugaguacucugugauugccaacaguuuauuaguucucuuuuggaagaaugcaauggaaauauuacauacagauccugggaacacgcaucggugcugcuggucucucugaauuaggagcugaugcaaugcagaacgauuucugcaccaucuggagaaucugguugaugauccaaucaguauucuuacaugcagcccccuucuaccuuuuuggcuauucauucgcaagcacuacaucauuuucuuaaccgaauuauaaguagggauggacuuuuggagccucaucuguaaaaggugaagucauucuccuuggcagagaaaagccugugggagaugcgcugaggacaggcuuggcucccacagauuuugggggagacuucuaugacccccuguacacguagggauuugagccaagaaguuaugucaacaccuacuggggcaaaagguccagagagcacaaagaagacacacuaaaauccuccaaaagaagaaaaugcaaaaacauuuccggggguggggugggguggggugggaugaaguuuuauuuuaaauguagguauaauucuucuagauuuaggagaaaagcagacagagaauuacucugacacaauaagguuuucuuugccauggcauguaguccugccaaggagguuugcugaacaggacaaaauuccagcuccuuauuuuaauuuucaugaaggguaaugcugggaagcuguucaaaauuaaaaauaaaucuuucaauaaggagaccuccuauguggccagccagaaagcuuucacuuaguagagaauuguauaugugcagagcacugcuucauuauccuaucauaauuugaaguucucuaauucaagucaucaggauaguuuaucuuugauuaacaaacccuuucuucauaguagugcaaauuaauaauguaggccaaaauucgggugaauguagcaaccguaaacucuaucgaagcuccccuaagcauauuuacauacacacaauuauguucuaauugcaauugcuccuaucauuucauuaaauuaaauuccuugaggaccacuauaggcaauggugucucacucuauaaggaauacauagaauuaaugaacguuagcauuuagcaccuggaggcuacaaaaguuagugguucuccaucuuugcucuguuuucacaggguucuuucucucaucaguaauauguuagaaaugauaaaucaaaucaaucacgcaaaaccugcuagaauucuuggguccuauguucaccaccuuugagacuuuaagaguugaggagcagcuccaugaaggugaggugacucacccaugcuaaugucagagccaguacuaaaaagcagggagaauccuacuccugaaaguagaaaguugcuuuccuuuaaaauuaggagauaaugaauggcauucauguauucagcuuggcauucuccccauuuaugagaccagauuaugugaguaucugggcauggacauggagauugaacugggcuuugaucauuuaauuguagaauguggugugaaugggccuguguucucacaagguuauuuaaacaauccuaacccaaaucuuacuccuggggucuuaggggguuaauaaacacccuuuugcuccccuucuggguugaaaaccaguugacacagaagacaaaggaaaucugaaugucugucagcuuuuugcugauaagcugauggaaggaugugagcuuuauaucuguggccaaaagggcuugcuucagugacacuugcagcccagcuggcuaccugcagccucuccgccugcccugcuaagguuguuggaaggacacucugugcaggcagacagguaggcagauaggcagauaggcagauagacaggucugagaguggguggagcugaggacagaguacuuuucccaaauucucuaaugagaugagucacucccagccucacccccaugccagaaacaaugaagggaagaggugggaaaagaguaaggguggggguguuacuuuuccagcugaagucguacccaguaaaauuggagaagaggaagcucuuggagcucccccaauaguuacuuuucuacauuacaggccaaaaggaggaaaaugagauuccaguuuccuucaucuuucauccuguagcgacuguuuugucuuuuguuuagaagcagguaguccugauguuuaugaaaaauggauaagcaaacugcugggugauuuguuuucuggauggcuuuccuuugguuuacuuucacuuaaguggaccaucucaggcaaaugaauacaggaugugucacuaggagggagaaauacuguauaaaugaaacaagguuuucuggccaagcaacagaccugugaauauuuuuuuuuuguuaaaaaggcugugauggcagccagcaguagcuuaauaucucugaacgguuuuuugccguucaucucccaucgccuuugcuugguuuucuagcugugaggcuggaccauauucuggcguuuuaaaucauuauggucccaacccccaugaaugguguucccuccucaccccaaauugcacccagggccgguguuguccauuuuuuauuuuuacuuugcaugugaugcuauucuagauacuucauaauggaaagaucuggucaucucucucuagcacagcuaugguguccuagugacaaacaaacaucuguagcaugcuuaguuuggaggaguuaaaauauuugaugcauuacguaauuauuuaaaccagcuaaucucuaagaucuuuuccguuucaaaauucuaugauucuaaguauguaacccugagcugugggcuaugaaccugaagaaguaaggcuuauucuucuaacauguuuagaaauggucucucaaugcaauucuaagagugggaaaacauucuccaaaugcuucagcagaauuaucaccugaauucugccugcccuccuucucucuaauuccuugccuugccaagggauuuacguugcggggggaaaacaguaagauagugaacaguuguucuaaauugggggugauuucugcuccuaccccuaaugggcaauguuuagaggcaauuuuuggugcaguugcaucuaguggguagaagccaggcaggcugauaaacaucuuauaauucacaacacagcauccccaauccuccgcaaugaagaauuuucugguccaaaauguccauagggcuaaggcugaaaaacucuguucuagcaauaguuuuuaagaacagacuucauagcagugcccaccauuucaggguuccauagccauguggccuuugcuugagcuggccuguggcugaacacauagggaagauuccacauuucucuggcuccauugccccaugcugaaagcaugaugcucccguuacuguucucagagaacaggcaguuguaaagggccuuucaaggccccucaugaauccuguuguagcuguuuugccaucagaugaacgggcgcugcuuguuaggcugaccuuguucucuaggguuggacaauuaagcauuaacugcaaaauaauaauaauaauaauaauaauaauaaaauaaaguggcauuacaccucauuauaaugccacugugccacauguagucauuguacaguuccaucuguuuguugauuaacauuuauuuacaguaaaaucaaaucaguuaacucucuuugucaaguaaugauaaauuuaauaaaaccaaaauaaugaauaaagaaaagaaauaacuaaguguaagaggcacacugucuuuuauuauucaacugguaaguucccauucuuucucucucugccaucuuuuaauuagacauauuauguuauuugagugggauaauggagaacagugggaauucucauccccacuggguauaauugcuaccugucuucuagauaguaagaggaaagcuucaagaaaauggugggagaaaggggaaaaucuuacagcaaucaauuuagguaauaugcuguaggcauggcagagccagacuuuguggaguuuaaagcuuaaacaacuauugugugauuaagggugaaaacauaaaacccuacaaaauuacaaaugucagacuaguaacagagcuucagaaaggguccauacaaacuucuuuagcuucgguaaauaaaaaucugccucugacuauguugagauaaaugcaauugucagacaacaagacuauugcauaaucaucccuaaaaacagaaaggacaagggagaaagaugagauguugggaaguccaguuuggccugaaaugaagguguugaaagacagguugugacagugagugguucuggcccacaguuagguaugaggggcaccucuggaguggaccugaguuguggucugagaucaaagggacaagcagaaagcacauuccugcugauucugagaauuguuuuggaauacuaaaccuaaaugagaugaugugaucucgguucaugcaaccacugccucccagguuccagcgauucucaugccucagcuuccugaguagcugggauuacaggcgggcgccaccacauccagcuaaguuuucuauuuuuuaguagagaugggguuuuccauguugcccaggcuggucucaaauaccuggccucaagugcauccaucugcuucagccucccaaaguucugggauuacaggugugagccaccucaccuggccaaaugaugauauuuuuaagacacaaauguuugcuuccuuuagugcccuaaagcaggggucagcaagcuauggcccaagggccaaaucgaauccuccagauugggacaacccacgaauauuggcuuuuauauuucuaauggguucaacauaauaaaaaacagaauaauauuuugugacauuuggaaauuauauaaaauucaaguauuggcauucauaaauaaaguuuuacuggaacaaauucccacucauguguuuauauauuguguaagaguguuuucacgugacaauggcauaguugaguagcugcaacagagggcaaauguccggcaaagcgaacaugggcacuaucucacugcugacacaaaauguuugcugaucugcucuggaguacuaaaucaagaaaggagaccaguaagaacaagguugagaagcuauugaaauacugguaucauuuguggaauauuguuuuggcaaaggaugugauggguaacauuuagguaaaucucacauuugaaacaaucuucaagacaccuuauuuuguaaagguuuugacucagaaaaaaaauuaacuaaaauaauuaggauuucagucauaacuuugcuuucuugaaccacaaauuuuuucccauuggcacucagauuuaaauggauuaugugagacaugcuucacugauauucugguucucuuuaaaguaugcauucuucacacuauugccuagguccuauaguugcugacagcaauuuucuuuuuaaauaauucuauguuagccuggugcagcggcucacgccuguaaucccaguacuuugggaggcuagggcgaguggaucacuugagcccaagaguucaagaccagccuacccaacauggcaaaaacccaucucuacuaaaaauaccaaaauuagacggguguuguggugcacgccuguaaucccagcuacucaggagacugaggcacacgagaauugcuugaacccaggagguggaggcugcagugagccaagaucuugccacugcauucuagccuggaugacagagugagacucgaucucaaaauaauaauaauucuaugcucugcuccugugccuuaucuucucuccgagaugaugucaugcuugccuuugaucuccaguaaaucguguuauuuuuccuuaccccuaagaaauuuaaaggaaaaacaaaugaugguacuagugaaaucgagaaaaugaagaacuccuucuagagauucauuuuaaaauccuucaaacagacaacaaagcaauuccacugagagauuuugcugaaacguuguuugcgcauccucaguuguuaguagggaaucgguagcugguuggagaguccuuucugugccugguaauuauaggcccaagcaagcacacaaugagcuucagaggagccaggcugugguuuucucauuaauagcucuggucuagccaugggauccugguuuacuucauaaggccuaugaaaugcacauuuaaaaacaacaugcgguacuuuuuuuuuuuuuuuuaagaaacagucucuugauucuaaccuuauacugagaagaauuucauuuccagaauacuguugcuaccacuauaauuaauaagcauacucacuaauuaugaucguaauuaaaaauaaaauaaaccagcagauauacaauggcgcagccucuuguguguggcaccagugucugugaauuuguauucggggugggugccacaaguccuggugaggagaaaaaaaaauaaaagccugccaaaagagccuacuaaauuauccaacuuuucaagguugacugaauagcacagacaaauaguaugucuauagaacguagugguaauuauugcauauaagcaaaaguuagauugcauuuuuuuaaaaaagaugugaauauuccacucuaagaaaaugaagucuuuauuuauacacccaggacugagaacacuauuuuuccugaguccuuuccuuuugcuccuacagaaagauauaugcauguucauuuguaagaagagaaauucauucaccaguaaucacuugacagccuaauucugguuuguuucucaucucucaguguugugcuuguuccaucgaacacuaaccaccaacuuuuacacccucuggagaagccaucaagagauuuaaaaaauaagugccuggcugagaugagaaaugggcagggcagggcuagcaaggguuuccaaugggcuucuaaauuaucuaguugucacuccaacuggcucaauuaauuacugucuccccagaggagccagaugggucuccagaaaccagucugcaauugaacaucaaugaaaagauccagagaaacuuuaucaaagcuuccauuaacccccugcugaugucuuuaaauaguuuuuuuuuuuuuuuuuuuuuuccuuuaaacaccuugaaaacccaaaagccaugcacaggacuuaucuugcauuaagagaucuuaaaucuacagggacuaauugaaaugccuguccaugucacucaaauacauagagaauucuucugagucucaacaucccuguggcauuuuugugauguggguauacaauaagaggguauccuguauauuuucuucagguaaagacuggugaggauguuuuuuaggguuuacauguuaaucugucaagauaagcaaaccuuuggucuaucugucaguauuaaaaauaucucucuuauuuaaugaaccuucuucugguguccaccuuuccacccgccacccccacaaccuguacucaugcuuucucauucuuugcuucugccaaaauuagaaaugaaagagguuccccaggcuccccugaaacggcaaugauaaaaacgagagauggugccagucaguguggucgcuugccuagugaaccccuuggcuuccucauugggaaaugucacuaaugauugguuccauaggugagggcuggcacccagagcacugugggaaucuggcugaauggucaucaaaauguccgccuauauagacacagaguugaagaaaucacucuuagauuccauuucuucuuucucuauucugacaaauugguaggccugaucuaaacgaacuguacugugguucuccucugaccaucuuuuggguuuuguuuuguuaugaaaaaguacagggaccacucccugaaaucuaucuaaaauacuuuauguguaaaauuauagagacacgaaauauuuuuucuauuacuauucuauucuugcuguuacucuugggaggggcaaggggagaaaagauaaagaacuaugguccaucccuuuuugauucauaucuuccaguacacaauuuuuucaggcaguuuguuuaucacuuucaaaaaaauccuuuuaauaaaggcugugggacagauaaguuuuuuaaaaauucuugucuaggaaccuuuugucugugacaugugcauacaaacaagacuuaaauauguagcuucaacuucucagugggugcuaaauagugaccugccaccaauagacucacaguguguuccaagcuuggguaagauccauccauuagcacaaacacugaaaaggggguagcuuacaacggcucccuggagaauuuguguuuuucuagauaacauacugcaagcuggaaaucugccucuugaaucaacccuaauuuuuuuuuuuuuuuuuuuguaaaauaagugcguauuuugagcauaaaccugaaguuaaauaggagcacaguuucguucauguuucuuuuucaaagcuaggaccacacauauaaacaagccagggauuuuuaauauguaaccagcagaaagcuugaucaaguguucucuauacucucaaguguaauuaaagacuucuuuuuaucuaaagauaaagaaauaagauaaccaaagacuuuuauuuuaucugaaaauuauugaugaggcucauguugaaacccaaugaaucuaaucccaauccuauaggguucccaggagggugugguuuuaggaaacuucuuaggagacuuggaaauccuuggagcuaacaucaucucauuucucuccauuuacaguaggaguaggguuauuauuaagguuugugauaaagguucuuauuguuuuguuuuauauuagaagcaaggagaacaacuagcagagccuuacccccucugaaaguauccuuuuguagccaugaacaguggacagaaaauuuaagaagcauacacuguguuuacagccuucauuguacacuccaauacagaacagucaacuaauucaggugcggcuccaaggggcugguaauauauuuaagaaacccuuauauuauguaaagauguauuguuuggggagaaauaucaaugagagcccuuucuaucucacuguaaacucuucaaggauucaccuuaacuguacguguuuguuggaggguagcauuuucucuuucccuccacuucuuuuuccucuaccuauuucagaaaacacaaaaauaauuuccauuaacuuccaauaacuuccuccauagugugcaggagcuuuccuccagugucuuucuuagauaucaugcuguggaacuauuucuagguaagaugcaauucuaauaaacuccuccaguauuuaggaauggacuaaauacugacuucuuuggguggagccaguuaugcugaauuucacacuucagcaaauugaguucaugagagaggccccugugacaugcugugaacccccugguuuucuuucuuucuuccuuuuuuuaaaaaaauaaaaacaaaaacaaaaaacaaguccuaaaacaguaauagcuuucguaauacauucuuuauuauuucuuaugacuacaaaagucaucucaauucucaauucucaaacacagauccaguugaagauaucuacugaccuuaauaacauuuuaaaauuuaauagcucaguuguuucugccccauucuuauaaugccuauagaaauuuaaacuaucuagcacauagaacuuaguuucuagcugauacucuaaaaauaaaaaauaaaauaaaaauacaauucuaggguuacagauuuccaagcuuaaaaccucuucuccuaaaugauuauccuguuccuaaccuguaccauagcuuuugagaaaauugucaaaaagacagauuuucaaauaugaggucugcaagaacauaauugcauggccacauuuucagagagcguagcauguggugaccauuuguguaagaugcauucucaaaauguucugacuguaauuuaacccaaaggucucuaucccacuucuuuccacucaccaggugcuuccuuacacuugucuacauagcaagcaagaaacagggcaggaaagauuucuucuuuauaaaaaagguucccuaaagugauacuuuagggaaaagcagguucccuaaagugauacuuuagggaaaagcagagguucccuaaagugauacuuuagggaaaagcagagguucccuaaagugauacuaaaacccaccuucucagcauucuaugggucaugaauauuguccucagaauauuuugauccccuguguuuggaacuucccuagacuuccauccaguagaaccaaacuggcaauaagaaacaugaggagucucagaacuucaccccaauggccuucuuccuguuucucucucucucucucucucucccccccgcccuuucucucucugucucucuccccuauuuguaacauucuaguuuauacuguccgugaucaucacuucucaguccuuagacauugugcuuuaagccaagcaacacuuggacuuggaaaaauuccaaauagcacagaacacauugauuuacaacugaauuuuuaccaccauguuuccucugacucucuggccuugucaggaaucauugguagccuaugauuucaugcuauaauuuauacuuugucaauaugugucauuuuuuccucuguucugccuguguguuuuaagugcaacaagagaaagaaauagaaguugcuaaaaaauaauuucauagaucuaaaggacaguggcugguaacaaugcuaaagagcaucuaucuucaauuuauggucaccaugacauguuuuggagcagcucacgugaucuuuuuaaaugacgauuaaaaaacuagguaucccauuccaacaguauaucugauggagaauuggauggcuuggaagaugacuaaugggauucuggaccuuucugucuuuaggucaccuccuugaauggggacuauaucauaagugguccaaggcccggccauuuggcagccguagaaugacuauguuaauggaauuggucucaguccaggucuuagucgacaggugcucauaucauaagugacguuuauugacucccaacucuuucaacuuggaagacaguggaccaucacugagauagugaugaagacggaguaauuuauaauauauucaggcuccauugaaagccaaggaauucagccccuugagcuggcaccuugcaaauauuguacuugucucauggguucuguuaguuugagaaauaaaaaauagaaaucuaauuuaaaaggauuucuaauaacucagaauagcuaauguugguuuccucugaggucauaugagccucucguguuggugcuuuucucuucauuguguauuauagugauuagauauuggcuaugaaaauuauuacuuuucauuuguuuguguguuuggagguugauuaccuagucacuuguuuauaacaaaagcuguaaaugauacucuuugacagaguuaaauaaggcuaucuucaugcccuugugaaauggaaauugaugaaaauguaacacugaguaccuuuuaucaacauaaauuucaaaacauggaauucagaaggauucauccaacacauacucuuuucuauuaucuggauuaauauaccucacuucauucauucacucuaaucagguucaugaccugaagaugauuuggccccuguuggaagagaucguuaguauuacuaguauauuaauguuuugcccauugauguuuucuggguucauccacugacuuuuucuuuaacuucacagaugauuuggauuucccuauagcaaguggcaaagccacaacacuucugaauuaguuaucacacuuaaaaagucaagaugacaacaaccauaguggaucuauuuauugaagcagacaggcucuuuuagcggaaugaucaaugucuuaccucuuucugaaaggcuuuucagagguaggaaaucaucaagcaucugauauaaaguaaugaacaaggcuuuugauuggucaaguuucuggagcaggcuuuuaaguauuucugccuguaaauguagaaaucugagugugaaaaguaaaggcaacagcaaagauuuacugggugcaucuaucacccuggcuuuuagagucuuugugauuaauaccuguuuaauuggggacugaucuagaugcuuuggacgucagaaagcuaaauguuacagcauugucucauggguuccuaacacagcaggacgauuagcagcugucugaguaacaaagagaaccugaagccuacaagcuuagcuuuuuauuuuccagauuuggaaugcuugaagcucccugguggaguuaacagcaaaaggaauagaagccuugaugcauagcagcuaauccuuuccuuucucuuuucuguauucugcucaguaaaaaugaaccuuuuccuuacauuguucuccauauuccaaauuaauuuuggagagcauuuuuuuuguugguuauuuguuuaaaaaauaauuuuggggggccuuuuuuuuuuccucugaucuucccuaggaagugauuggagggcauuguaggucauggagacccccauuuggugaagguucaccauccugucuaaccaaguuacacauaaaauaauuucaacuaagaguggaaacacuagauaacugucaacacuacuuuuaggcccagugagaagauucaucucacuagaagcauucagagaaaaaaauguauauuuauuuuuuguuguuguugcuaguuucaccccauuuucuuaccuuaaaacaaucaucuugcucaggcaaauucuucuaaacugccuuccaguggaaagacuuguuuuccuguuugccucaaacuggcauucuuacuuauaacaggaaacacacacauugaauccugccauguuucuguuggcaaguguugagcuauccuugucagaaccugccaacaaauuucuuaguaagcaaguagaaaguaaaacaagcagcucccagacgaaacacaggacacacuugaacugcagcaaagacacuugggugccccugagguuaguucccugcuaauucugguggacaugggccuugguuuccaguugagcuguuacccacuuauaauuuuauaaccgauccuaugacuguaccuguaauaaugcuaauucaagauacuagcuaacuuguaaaacagacauuaaaguaaugcauuuuauuuacuacaaagaguaaggauugcuguauguuucaguauaaugauuaaaaaguugcaaaagcucuaauuugcaaaaccuuacaucuuucaugacaucuuuagggcuuaacccaggagguauacuaaauauuguguuuggaucuuucuaguaauaaguaugauacuuccuuuuuaauacuccuaacauuuguguuuguuuuauaaccuuuuuauugugaaauauacacguauggaaaagugggcaagauucgaauguauagucauugaauuauagcaaaguaaacaccuaugugaccgucacccaggccaaggaacagaacaauagaacauugccagucuuccagaggcuugucuuguauccuuaccccuucucuaauuccaaagacuaauuauuuuauuugguaauugaauuuguuuuguuuuauucuugucuuagcucuuuagauuaguucaaaugugaguucauucugcaccaaaaguuuuaagguuugucugugagcagggaucauaucgaacuuaccccuggguuucugacagccgacaauguacacagauaccccuguaccuaacagagcagacuuuagaaagauuuacguuguugcugcugccgcuacugcugugggaaaacagucacuuaaaccuucaagucuccuauuucuuaccauggaaaggaggggcagagaucagccgcuuucuguagaucagugguugagaaugagggcucuaggaccagauuuuugaauuaugaccacauauaagcuauaacuuggagcaaguuauucaaacucucuguaccuuaucuucuugaucuauaaaaaugaggauaauaauaguaccugucucauagaguuuuugugagguuuacaugaauuaaguccugcaagagauuuagaacaaugcucagcacaucauaauuacucaauaaaugcuaguuucguguguauguuguuacagacauguggcauagagggaggaucacauacuuuugagccagguggacuugaguuuuaaaucucauuuuauggcuuuggucaaauuauuuaauuucuuuguaccugaguuuccaagucugaaauguaagggugaucauuauaacuacuucagagaguuauagggaugaaaugaugucaggugugcguguaugugcaagugccuugcccaggaguuuacuggcaucugauuugcuccuuuccccauucuuuguuuuguggcaauucacagggccucaguuuucaucugcuuaagcaguuaauaauucagugaaaacuaaauuaacucuuuucuacaaagaaaacucaaccaaaccauuuugagaaccccaauguguuuucccauuuagcauuagcauaagaucagcugaaucuuuuggcucaguguuuugcgauucugccgauuucauucacuguuagaagacuaguggccgugauuguggccgugauuuuguccgugggaagccacgcggccucugucacuggcuuugcugaccucagggcagcgcauuccaguuucucacaaauggguggauaucugcucaucgugcaugaccagcuggaguuuccgggagggaacccaaaggccuuucaggaagcugcaaaaccacagaccaaucuucugugggccacaguacuucuacaguuuaucugaguuaguugugauaugcaaauaccucuuuuuugccagaaggcuccacuucacuugaaugaguaccuguuuuaaccccaaaugccaguucaauggguuauugcaauagaaauuuauuuucuugcugaaaucgcauccaguugguggugauggggguuguuggguguggggcuuccaagaugggccugggucauuaaccucccucuggcuuguggguucaagaaaauggagagucacagggagcuauuuaugggccagaucuagaagaggggaaaucacuucaacccacauuccauuacccaaaacucagucacaugaacuaccguagauacaaaggaaucuaggaagguagucuuuggcugggcagcucuaucuagaagggaagggaucucacaguuuuggaugccuuagccaaagaggccaacccaacaccuucaacuucccuaugcaaacaauuaacgugaaggcuaagaauagcaucacauucuaucauuuaaaauuuaaccaauagcucucuguaaaggauuuguugaaaauaauccguugcccaucucucuggcauaaagaaaaugacgugcccucccaucuaucugggaaauaaaaaaggcuuauaaaauuuucgucuucuauuaaaccaaaaguaaaaaccaaaucacagacuuugcaaagucuuacucuggaaucauuuaguucaaguauuuauaguguuccaaaaucagacucuuaaaaucauuggcagcaugagucaauuguauccuucaguaaauauugcugaaggauaauguggcugugcacugcuuuauuuuauaguauguguuuaaaauagacucuggucugaccuuggaaaucacuuuauggaaaaaaaaaaugcaucucucauacauucuaaauuuaagcuuaauaaauaugaauacuuacauaucuaaauauaaaugaacuucauuuaauucacagucuucugaagauuuuggcugagaauuugguucuauguuuuugugucaaauaaggagaaaaaucaaugucaauuucagaauaaucaaguuguuuuucuguaccuuuugccgguuuguuuuaaaaaguuucacuuuuugacuaugagaaacugugcuuguguggaugcaugauguagcaacuaaaagcuguuggggguggagcugacuuuuuacuuugaugaugaguccagcgagggugguuggggauuuuaaugauuuuaccuaaaagauggcagaggaguugaccuggcuggucgaauguaccgcaaacaaaaucauguguaugugaaagcacuuuauaaacucuuguacuauaaaauacuguaaugaugauaguaagaaaaaggacguauaaauauugcuaagugauguuugaugccauagguauugccuagcuugagaggaggaauccuucucuccaucuggaauguagaagaaaacaauuaauauuagcaccagagcucuuagcaucucagagacgcgaaacccuuaaucacaaggauaucauuagugcucugaagcauuuaauucugaugcuugacagcauuuuaaaaugcacaaaccuuugauaagaagcaaaucagagcugggguauugaauugagaaagaaaugggaacaaaaaccaccuuaagcuccaaguaauuaaauuuaaauaugcuauuugcauuaagcagagauauguauaaaugguggguuuauauuuuucuaucaaugaaagaccccuugaguaaauaucaucuguuuaaauccagauccuggggaggggaaagguaacccugcugugguuaagaagccaucucuccugcaaacacuggccauuguguaccacugacauccauggcuucaggugucuugacuuucauaaagggcuguuuucacuccuccuugcccacaggcuggagaccuuucauugcaucuguuuauuuccuagcucaccuccuccacccucuaauuugaaccaguaaugaaaugcagucagccuacuucagcuguuuucuuuuuccuccaaaguuccccccaaacuguuuuuaauucacugcuugugauacuggacucaagaaaacaauuuucuagcucaggaaccaugugaagcuuuccucucuuucuuuucuccguaucuccucuucucuucuccaucccauuugggugucacaaggaccaaacugcugcaguaaaaugacuuguagguguuuaauggcaagucauugaggaagugaauaaaagaaaauugcagcauucacgucaguggggagcaaggagaacugcugagcuuugaaccaaagaaaguuaaauuuaccauuuucuuaaagggagccaccucuguuugacaucaaagcaucuccuguaauuucuccuugugaaaugcaccacuguuagagagucaugauagagcccccuaaucugugcuguuucuguuuaucaaaaacacacacagagagaaaacccacauguaccuucucagugcauuguggucugcucucaaaccaaauguaaccacagguacauagcaaauggggauucuauuucgaaagcauucucaguuucucagggauuuguagaacugggaauacaacauucuuugggagugaaauuuaucuuggaccucuauuggaaagcucagaucauucaacuggaaagcuuuggugaauuuuuuccuuuccuccucuuuugguuuuugcuucaucguuuuuuaaaaaugguauuuugcuacaauuucacuuguguccauuugguauguggaaaaacagagucuguuccuaauaaugcugcucgcccacacuaugacugcaaagggcucuccacccuauuacccccauguuucaaguuuauguccauugguggcuguugcauauguaguaacuaauggcuucugcuggcagugacuggcuuugcccuaguccaucuuuggaggcuuaggauccuuucuggauuuaucauuaugacuugggagucucaccaucacuccaccuuggcaguuaagaagucaggagaacuauuugcauaugcccuacagauacagaggagaaaugcagagcaaauugucaacaccuucaucagccuaaagagcagaagcucaaaaugcugucuguaacaggugcagugaugccuaguuuuaauguuaacuuacauuugaaugacauuuuacagccuguguuugaaaaauguucagaagcaucacacagaccuuagaaacagagacuccauuuauaauuagaguugucauuugcuucaccccaauugucaauaucucaguuaaccuaaauaguaaaaccaaccccacaaaagguccuuugaaacaggugcagauggaaaguuguuuuaaggauggcuuacuucugguacuuuauguuuagaaaauguuugauaucuacaguaaagauuuuuuagauaaauuuuaauauguaaaaacuuuuauucauuugacauaauuauugagcaccacugaaugcaugugucaccaugauuuguagguuaaaaagaagaagaaaugagagacaaguuuuggguuaaaaacugcugaaaucuccuuagggguaauaaaaaaugauggucucggggauaggcaccuuagaccaggaaaauugacaucuaugagucauuggagauuuugcuguaaagguuugaaaauuaaggacuccauugaauuaaaucacacaucuuuuuuaaagagcuacccuuuaggagugcuugccuuaugauuuuuacauagucaucuuucuuuaaccaugcuacugucaacuagcaugaccagcucucauugcuaugugucaugucugaauucuagccauuaaagaaugccugcauuugucuggaggcacaaaacuguccuuaaaacaaguaucuccucuaugaaagaaguccguggguagauaggaaugcuuuucaaucuaugaugcaucucuuucuuguaguaagaauguaaaaaaaaaaaaaaaagaauguguucaucagccccccagcuucuuccuggcuuugcuucugacacucagcagguguauugagugucuacagauagaaugugugagaaagugcccucuacuuacuccuccccaucacccaugagagaacuugaauuagaagaggggcaguaggaaucgucuccucuuaaauucuagaaaaaugggcccucugacuugacauuagaaaguguuuuuucuuuaagacuacuauaaaaauuucccaauaguucuuuuaguuaagaagaggcuaaaguauuuggugguacuuagucugauaccaacaauuauuuucuaucuggccaugcuuacccauucccccucucggccuuguuccauaggugcucauuaaguaugugucuaguggccgaguugauguugaggaagaaccuugucucuaugagauuucagaauguaaaucaaagaacugagcagccacugagaaucuuuuuuuccacuuggucuuuuuaugcugaccaaauuuucuacuaugauuagaaacucucuuuugaacuuaggcauugauuggucagagcucuuauugaaccauauauuuaagggugggauguacaaucuuuuuaaaaaaauucuauuaucuccucuucuaauucuguaagcaaaaggcagagcccuggaauauugcaaaucaggauucaagacauuuggguuaggcauuguuuaccaaaguguggaaacauaccaaugguggcaucagagaugauuuuagggaacacaccgaugagauauuauguaauauugaauugcccuguguacaguauaguucauuuucaauucuuucucaguaauucugaguacuccaaggucagaaucucaagcgggugcccauauauccuuuguuucucuagcacuggcuaaucuccauuuuuaacaauccuuggagaaguaagaguguccagcaaacauugauaacauuguuuuauuuacaugcaauguucauuuaauuucaaguaauuauaggguuucauugauaccaguaaaugggaaauuucuuucaaauacaacuguugaaguuaaagauacugcauuuauuaaagaaaauauuacuuaaaucaucuuacaagcugcagagggauguggcagcaaauguguggcauggaagucugaugcuugggaaacacugcgguagggggaaaauugcaaaaugucauuggcaaaugccucaucuagggaaaugacccauaggcaggcacacacaguagggugaugccuucuagauguaaaguugaaggcuguuuuggaaaugggguagaaagggugagggaaaagcccauauguggcuuaugauguggagaacauccagguugccuccuuuccaaaguggcaguauggcaaagcccagauuuucucaaacuccuucuuacuagagaagguaagcucuccacauacaaugcaguuguauguuuuagguacauuucccaaccucacuuggucauggauugcuugugucauugugcccugauaacaugcucuucugaagaacaucugaucaauaaagaauuuagacuuugcagccauacaacacaauacuuuuugugaauuagaucuauguauucuacuuuuccuugguugaauugaucucuccaguagguaugaaagacaaaugucaacucagcaguuuucugacuguccucagccuagcauucuauuuucauuuaauccuucguucuugcuugcauuucucuuucagucucuccuuauucuccauuuuuaugacagcugugucaagguacacucuguugguuuauuuucacauuuaugcauaucagcuucccaaguagggcugcauuagaaauacucuaugaguuaacgugauuauauugcuaacucccugcuugagauuuuuugagcaccuuaguugaguucauauucccuuuaaauggucacaggaacacagcuacucaaacuucuaaaauagaaaucaagcucauuucccauaugcagcaguuuaaugauaacccaaccagagagaagcugucuuaguucaucagugcacuccaagggcaggcaggcaauucuuucucaaggaaucugucgauuaucaggaucugaccaagaccauuuccgagagaaaguucauuuuauaauuuuaugauuuuucucccuccugcuuucuuucuaaugaccucacuuuucuguuucauuucucaauccugaacaucagaauuuaaagagcuccuuuuuauggaguguaugcuaaguggucuguuaggcaauauauuuauuaccuggagugaaaugacuuuccacagccaggcaguuuucuuagccuccuugcuaccucuauauuuuacaaagucacuuuuugcauuuuguuggacaauggcuuugugucaaccaggaaagaaagaguaaaugugaguguguguguaugugugugugugccuguguguguguugggagaagggggccuuaaugaauguaaugagcacauuuccguuuuucauuuuccucagauguucaguggcuuccauaugucugccgcaugcagcuuuguucacugggguugguauuacuaaccuugggauugccuuugauggaggacauguguaucuacuguaucuuucccuuguguuuuugccugagauccaaucuggaauagcuuugggacugagagagaggaaaaaaaaauagaggggugugugugugugugugugugcgccuguuaccaucccuaacagagaugcugggcugucaaauaacccccuccaggagacagucucuaccguacuggauuuagcuggaagacucccuugugugacuauggugugucugcuuggcuucccugccaucaguauacucgucagacauggucaagcagguuugaagcuuuucccauaccauuuucagugacaauguauuucacuuuuuaucuuuguuccuuggaguuagggguuggcauucauacgcauguauugcaaaagggcaggaggaugacccagcacuaauuuauccuuccucaguggccaguuuuugacauuuguuuccccaguuugggaauaaaagaauauauacauuggaguuaggaagcucccuaaucucugguucuccagggcagcuuuguuagauaagauuaaggauuucaugaaugcuuucucuucucccuggagauugugcauggguaccagccauugucagugucagcagagccugauaacagcuggcuggagaugcgaccacugcagcggagaagugagcaucgggcagccuggguguauaaaucuaaagugugcccuccuuccacccccauaacacacccacuagagggcugccuuuguguccuucgcaguggaaagagcaggcaaaggcaacaugucagcucuuguaaaauagcugcaaaaugccacgcauguucagagagaccagcacugcuugauuuguauucacuauuuacaugguuguguucagacugaacucuuacugugauuaagcaguacuuuuauuuauauuggaaaguauguaaauuguuucccuuuuggcauucccuacaguacuuauugaagacuuguacauucucuugcuugcaugaaauuaaaguccaguaagauggcacucauaauacugggagguaggauuagauguagcuuuacugagcuuaaaaugaggucuuccaaaggcuguuauggcuuacaaaagguuaaaaaccagacagccuucucuguaccuacagccuuuuaugagaaaugucucuacgugcuguggaaaugguacuacaggccugugagcccacuaggcuuuuacuucagagauucucuuuuuaagacaaacacaugcaaaaauauacuggagagaaggaugaaaaugauaugcuucuauacugaagaguaaaauggucaagggggagacaagacaaucuuucacacuuuucuuaaauaagaugaaauuauuucuggcuaccaccaaaaccauuuauuuuccuaaagaaaauaucuuuugucuuuuguuuuuuucuaacagcaccaucauccauugcuuugguccaggcuaaagaagucacaagauacaguguggcacuggcuuggcuggaaccagaucggcccaaugggguaauccuggaauaugaagucaaguauuaugagaagguauuacuugagugaacaacacuccuuuccuuucuuccuuccuuccuuccuucuuuguuuucuucuuuccuuucuccuucccucccucccucccucucuucuuuucuuccuucuuuccucgacuccuucccauccuccuuugcucccucccuucuguuuaaggguuagccaguuguaagucauggaauaccagugaauccucaaaucaaaugcauuuugcuucccaauuaaguaugauuaugaaauuuaucauuuacuuaguuauccugaaaaguagaaaauaacaauaaugauaauacauuguauuguaauauaacuauaucuuuacuuucuaguaauggaaaucaagauagcuaagaaguucuaaucuaugaaccuucuaucagggagagugacucauaacaguugaaauaaugaucuguuuaaguagaucacugcuauucagaauaaagauguggguuuugaugacuuuuaauagaaagucagggaaggaaaaucacauucuucagccucuuaaaguuauagaaaggcauuauuuuuacaaauaacuugucucucuuacaggacagaauuuugaagagagcuauuugcauucaagguugucuagaaaaugaacaguugucuucuuuuucuuuuuaaagauaaucacuuauuggcuuccuuauuaaaaguagaaaagggacaggauuuucccauugaaaccauguuacaacacauuuuacauuuucuagacagaaaauagaaaaagauaagggaccuucucacaguuauuucuuuuaaauugcuggguguggaacuagaaaagccaccaaccaucauuuaauguuccuuucaaaaaaaaagaguaggaggaaagaucuggauauggucagcgucaauaacaaucauaccugaauuugcauuucuuucaacaaguaagaaguaacaauaguacuuauaacauccaagagaauacaggcuccagagaguuuauucaucuccauuuacuuucaguuucugaguugacuggcuugacuccuuuaauauugcaccuaguaaguaagcaggagauuuauuuugccaccuuccccaauuuuaucuugccaugauguaggaucagaaugagcgaagcuaucguauaguucggacagcugccaggaacacagauaucaaaggccugaacccucucacuuccuauguuuuccacgugcgagccaggacagcagcuggcuauggagacuucagugagcccuuggagguuacaaccaacacagguaacaaggaccacccagacucagucacuucugaggcuauuuuuauaauacagcugaaucccauuacagugaaaucuaaggaguugucuguaauuuuugguucagcagacauuuugcugcaaugaauaugucuugaaauaaguuagccaaugucuguaacuuagaaaacuucaugugauuuagagaaaagcauuuucgaaauacugauuugucuuuuccuaugaaugaaaaauguugccuauuuuucucuuguuuugagccuucuagaaagcaugaaaaaugggauuacuaaacugacaaauugaggguuacauagcuacccuacauuaauauagggaauuuucucccugagaagauuaaagaaggcgccaaaaauauuuuuuaccuacuuauuuuuaagaaucauuuaaaucaaguuacauaagcuuuuuuuuuuuuuuaaagacccuuuggacaaacauaucaaaucuuuaagcauugcgaguuggauugacugguugacuaaauuuaaagugcuuaagaggggucuacccaugaacaagcauuagugucagauaccuccaucccgguaaucaaugaacccaaauugggcauguuugauaaaaagaugauagauuuuugacuucaagaaagaaauuuuguucacaaauuauuaaauaagaauaaaaggaaaagcagaagagaaaguagaguugaaucugaaggggauugacauccuuugaaauuauccagcaaggguacaaggaggaaguggcuuuugaacuaggcaaaaauaggcagguuuuugauagcucucggggaaggagguacauucaaaacugcugcccuuucugaaauguucaagugucuuucucucuccaaguggcuucagaacacugaaaacugugacccauucagaaguucuaccuccuaagacuuucccaaaggugacccuuaugcaauugucauucccagugccuucccggaucauuggagauggggcuaacuccacaguccuucuggucucugucucgggcaguguggugcuggugguaauucucauugcagcuuuugucaucagccggagguaagcacugaagccacucacugugcagcccccgaccuucccaguguuuaugaugguuuuuuucucuuccacacaaagcuaaggcuuuugauugcgucauaaacuuggcaucugcaucccaaguuuccuccuuguugcuuugaucuucccacaccccuaccaaagcugcuagcuguacccugguggcaggcugagagguccggaaggacccagcuaauuguaggaaacaaagcugaagagcaagccagugggagauuucuagaugcuuuaagcugccagguguuacguuuaucccucucuuaagccuggacucacugccaaaggcaagaaaaagcccuauaaaacuugggccccaauuuugagcucugccauuugccagcuacuacuacauaaaccuuuuugagucuuuauuucuauucuguaaaauagagauaauuauuaucugccucaaaggguuauugacaggagaauuuugauacacaaaauagauaauacagcacacaggaggugcuucagcaugauuuugguuaacaguaauggucacuaaagcaaagaaauggguacuucacacucagucuucccccaggaaaagccaucagcauuuccagacaaucaagggauuucuagagauuaucccuugagcaaaucucgggcauggcauugucuuggaaaugaaccugaaacaucugagcccuuauccucuaaguacuuacaaucugacuugauacuuaaaaaauaaccuaaaaaggagagagaaauaacaacagauuggcagcaucuucuuuugaaccaguuuuucuuacuguuuuugucuccauuuacucacucccaucgucugcccagaggcuccagaggaguagucauugauaugugccccacaucugggccuucuuugucuuugauguguaagaaucugccucuucccugaucggcauccccauauaccaucaacuguuucacaagauggggcuguuggugaaaaaaagggcuaagccuggggaugucaaaaggauccucuuaaauguaaagcuuuucauucucuagaagagggaaguaguccuaggaaagaaguaauucuugcccaaguuugucgcauugccauagugguaggcugagcugcuucuggccccaccaguagcugugcuuggcccucaggccagugucuguugcauugucccucucugccuacugaugaucucaccaaugucauagcaaugccuuuggcuauuuccacuggccugggcaagccacuaugcuuuuacuuuccucugauauacauuauaauuagaguggugaccauauaaucuaguuugccuggauggucccaguugguacauguauuuauuuaauuuauuaauuuuuuucugagacggagucuugcucugucgcccaggcuggaaguacaguggcaugaucucgggucacuacaacgucugccuccuggguucaagcaauucuccugucucacccuccugaguagcugggauuacaggcacacgccaccacaccuggcagcuaauuuuuguauuuuuaguagagacacgguuucaccauguuggccaggcuggucucaaacuccugaccucaagugauccgccugccucggccucccaaagugcugggauuacaggcaugagccaccauguccggccauguauuucuuaauaucaugcucccauccucacucucuaaaguguccugguauacagggaccaauuauguucacucuaacauaacacaguauagaaaaacacguucuguacaggcaucuguuuuacaccguguucauugcuuuucaugcacaaucuaugaauagguauguuugauuagagugaugagucaaaucuugagauguuaaauccacaauaaauucucauuucuguuucuuuaauacacacacauacaaaaacauauagacauuggcaugcccucuauauucuaaacagcagaauaucucaaccuuuggaaacuuaagguugaccugcauagauuuugaauucccacuguucuuuccuucccugguauuugauuuugaaagccaaucaagauggcccucuuucuuguacauugccauuuaguuuuguauauguacgcaugcugugcauauaaccaccgggaacuguaauauccaucugauggugggaagcaaggagcaugugggggaguguauaggaauuauaugugcuuuuuugauuuuauaauuacauauuucuaugucugaaauguucacaguauacagaaauaaucuugguuguuagaaaauaaagauguuuaaagguuuaaaaacagauacaauucaugaaauaccuccaccucuaaaaauauuugauaaaaauucagcacccuaggaugcucagagcacuucucugcagaaaguaggccuugccuugugucuugaccaucucuuugacuugacuggaaacauucucuaguuguaguccagcuuugcuuuagauuuacuuugcuuuuuuguuuuuugguauaaguggcccuaaauacagcagucaaacuggaguaaugagaaauaaguuaccucauuguaaguuuccuuuggauguucugcuuaaaacauuggcuuugaugaaaagaaaggaaaaacacaugaaaauguaaugcggggagacaaguuuauuaaaagccgugacuacggaaaauagcauccuuaagcuugaugacuuaauuuccucucugcuuuuauugaucacuuuauuauauaaggcaggauugauagcaggaugcaucggauuuccaauuaugaguccccaccuuagagaauugagccugucgaguuaccuagcgaugauuccugucccuucucccccauuaaaaaaaaaaugucacuucccaaggcugauaaacagugcuuggugauugguccucaauggaucacuuuuuagaaaaugaaaugucaaccccuugcccucauauugauucuucuuuagugucggccguaaagcugucaugggaaaggccgcccggagccagguagcugacaggcuugcagcggcucaugcacacucagccaauucuucuccucacgcagguugucugcucuguuaucuuggacuauaaauguuuaaaugggacaagaacaggugaacagagaggagacagguaguggggaugaaagccuggcuggcccaggcuuuucgugagaggacaaaugaaaggugguacaugguacuggcgaaauaaucuugccagacuucagccaguaguaugagaaagcaacagauuaaacacccuagccuaugaaaucugagucauguccuuugacgauggggcugcuuugugcuucuuagaaucacuaaauguuuaugcuggaauggaugcuacagauagaucccuuauggggguccccuugaacugacucccacucugcugauggcaugcaagauuccuaaggaagucaauggacagaaacucacguagugagaaaguuucaguccuucugaugaccucagagagaaaauugucuuggugcuaauuugucauuuaagaaagaggaagcagccucaggcucacaguugguaucuugcuagauuuuuuuuauagcaauuguuucauuuauuucauuguacacaugcagcuuauagggagaagccugagccuaaggcaagccagaauaaucuacacuuuuuucagcgagaucuacuuuuuucuuuuggccaaauggaacauguaagcauuuagggaucgcggugaaagaaucaaacuacuaaauuuauaaaauaccuaaaaugagauguuauacuaggcacauugauuuagcuauauuguauauuuuuaccacccacauuuauguuaagcaacuuaauuuuauauuuucuguaggcaucuuugaucugugucuuucucaucacucaagauauaauuucagaauucuuucagcuuuccagagcacauaauuguacuuguuaucuagguuaguuuaaggcagaacacuucuuguaccuauaugaugcugucccuauaaauuuuauuucaaaccacaaacaaaucucuauuuguacauucucuccagcaaaucaacauuuccacauguauauauuuauauauuugugaucuccacaacauaaccacuuuucuauauuguuuuuuuaaaaugaucuuuaaaaggacuguucacagugacauccuaaaauacaauuauaaggucauaaccuccaagacuaaugacugaaucuaugcuaauuuucucugacacccucuucccuuuuauaguaaugauuucaucagguuaucuccaaaagcaucacaaacuaguauuaauucagauuauuuuagggcaguguuuuuuccaaaacaguauuaccguauugauugauugauugagacagagucucacucuguugcccaggcuggcaugcaauaacucagucucagcucacugagaccuccgccucauggguucaagugauucucaugccucagccucacaaguagcugggauuacaggcauguacuaccacacccagcuaauuuuuguauguguaguagagacaggguuucaccauguuggccaggcuggucucaaaccccugaccucaagugaacugcccaccucggccucccagagugcugggauuacaggcgugagcuaccacacccggccccaaaacaguauuuuauuauucaaaugugaaaaacaauuuuaagaaaagucuagaauacaagaauagccccuauuucuuaaaggauaacuugguagugagggaaaguauuacugauaaccaggcacaugcuguuuuuauacgaaccuucuaaugauugcuagugacaguggguuuccauuuauguuaggguuauaaaguaccccuuuuaccuggauaaggaaaaagaagugaauugauuuuaagaaaaaaaugaagugguuauggcaaaauuuauauauauauauuagguacuggaggccuaaagagauuaaacaaauaaacgaaggucacauggugaguuaguugcugaucaggacaggaauucagcucuccugacuuccaauacugggauagauauauuauuuuaauaucuucuuaacugacaaaguugaccuacauaaaaaagcugacauuggcaguucuauggaaccaaagcuucaagacucugcuagugauguugguaagauuuguaaucugugaauuaauaugcaaaucuguugcacaauauaaagucagaguuugcaaguuaauuuucuccuccuauugaagguuaagauauuccacuuuggagcuaagaguucacacaaugcugaaacaguuaugguucagccugugcuaccacaccugguuaauuuuuguauuuuuaauagagaugggguuucaccauguuggccaggcuggucgcgaaccccugaccucaggugguccgccugggcccuaauuuccuucccuggaauauuacaaucaugugaaaaugaaaacacuuaaauguuagccuaauucagcucugaugaagucauguaaauucacacaagugggggcagaugauaccucgggaacauuucuaaacaacuugcgugcaaccauuucaacaugcuacucaugaacaccauuuagacaucauucggugcaagaauaaugacagcuuaaagaaggagaaaaagaauggcugcugugaaucuucaugggugaugccguucagugcuggaaagggaccuccuggagccaugcuaguuacguugcuuuauuuuuaauaugcacuuuagcugaauaaauuacuuaccuuuuacuaauuaguuuuggaacagugaaccacaucaaucaaaucuguccacuugaccagaaaaguuaguaauuuaguaaaagcaugguuuaugcugggccccugccuugcuccccgucucuauuuuguuuguuauauugaauagucaaggugccaggaacagcacguugguugagagggcucacgcuguucugcaacaaugucugcuaauacccuuauuaccaugucccuuggacugcaggagggcuuaguucacacucuuucaaaguuucaccugcaaugugggcucuuuucuccaacuccugcggcugaaaggguccauguuuccuucuggagcauucacuaacaaaacacuccacuccuucccaguuuuaaucagcuuguccacaucucuguaauuagaaaaccuucaacaaaguuuuccuucugucauucaagugaucagccugagaugucaguuuugaguuaggacuucuucaggcaguguggcuuccugcaggcuggcugccccaguggugaacuucaaugggcuuucuuuccugggaugauaaugggccacacuguccuacacugagccaaggcaaaagggccaucagguguuaaagguagaacaggacacaggcauuuuuguuuuccagguauuucuaaaaagcaaacagacuacuauuagccuuucaacaguaauccuugugguuuuuuuucagccauuuccugcagucuuaaggguccucuccuccaaauaacacuccacguaaaaaaaucucauuuaaaaacacaccuucaccacuaauuuaauuccuccuucuauguuuagaagucugaggaagggaugggcgugucaaccuuauaauuaaugaccccugucauuuuguauuuccucuggcuuugcacauauuuaaugaaugugcuugauguaaaacagauaaacgcuuucccgggcagcuucaggccauggguuucuaugguauauuccagguuuuuguuucauugacaauuuuaaguugguaccaaagcuuucucacucuaugcauuuguuuuuccuucuucaaaggaaagaaauucaaaucaguguucgagaucuuaagugguuuaaaagagauacuuguaauuuuagauaaugcuuuuaggagcucugauaagacacaauguuucaggcuggcaggacccuaucacucccuugggaccaaucgauggcauuuuccugacauaaaauguuauuuuaguagucccugaccuaacacucuuauauuccuuuaaaagaagggaaaggacggggguggagggagaggaagaagauuggaggagacuucaucuuuuauagaaaguuguuuggcuucaggguauuuaaaccuguuuaguuacuucaaugaagcaauggauuuuaagagcaauugaauucacuuuaagugaauguacugauauaaaacguaauacuacuuauaauuaacucucaccagguauccuuauguaacuaaucuccaguaagagaggcucuaugaagucgugggcuggaucagggcuuucacaaaguccuguacuugcuaggagagcacguggugauccucuugcuccccaccccccaccccaccccagcuccauguccucaucuacagggaaucugagcaugugugucugccugguugcuuucaaaggguugucaugaagaugcaauuaaauaauagauucuggcugggugcggugguucaugccuauaaucccagcacuuugggaggccuaugugggcggauuacuugaggucaagaguuugagaccagcuuggccaacauggugaaacccuggcucuacuaaaaauacaaaauuagccgagcauggguggcgggugccuauaaucccagcuacucaggaggcugaggcaggaggaucgcuugagcccuagagguggagguugcagugagcugagaucauagcacugcacuccggccugagcaacagagugacacucugucucaaaaaauaauaaauuaaauaaauaaauaaauaaauaaaaauagacccuuugaaaaguuaaaugcaaaggaaaaugcaagcuuaugauuugggacugaaauacuguacuucacaguuagcuguagucauuggggucucuguuuugcuaaguugguuccugcuuugcaaacaguuagggaaggagauaauauaugagaugagagcacuuugaaaaguuaaaugcaguguaaaagugcaagguuuuauuauuugccagggaauuauccccacggagaaacaucuguaggcucugagggucugauugcugagcugguucuugcgcugcugacaauuaggagaggaaugugggagggaagguuggagcaugugaccgggauccgcugccucucugguugcacugccuggcuccuuuagguucucuguuauucucucuuuuucguaaucaucugccuuucuaccuguucaaaguuuaagaguucaggguauaggauuuugacaggaccacacugccaagacaccuggcuuugcgggaauuuuuacuuaucucagaccguguuucuuuuucuguaagagucuugccuuaccuugucuuugaagcucuaagaaaacauagaauguaaauuccaguguaaauuguaccuuucugacagaaacauaaauguauacauuuuauuuacuaauuuggucucaacuucccaagcuuuagacagcugugauaucaacggaguugacuuucugauuccuuuaagugauauauauucuccugacucacuauguauauauauucaagauuuuugauuugcaaggcuugaguugauuuuccaguuuguauaagagagauauauacauuucugauugaauauuuauguguacugaagauuucuaauccacaaagcuuuauaacaaagccaaauuuaggcuauuaaaaguuguaggagcagaaugccagguuuaagacaaugcaccauuuuacugaaagugaauuaggcaaagcaaaacaaagcucauuuuuacccuugcucauuuuuuuacaaauuagggaacauaauucaguacaaagcaaauacuuacuuuuaaacauuuuguuaauaaguugggaauuuguaugcagcaacugaaaccagugaccgcaaaaguauuguuucaagaguaucauguaauaugauaaugaaguuuugugguaguaguuaucugguuauagcaauaauauuuacuauuaccuaucacauacugaacauuacugccauuugauuuacacagaauuacucauggaaauuuaauuuagaauguauauauacauauacacacauguacauauauauacacauguauauuuauauaaauggaaaaauagccaauaaacuuaucuucaauaagauaaauuuucucugagagauuuuaaauuauaauuauauuauaaaauauuugcuuuaaccuauuguaagacaccucaguuuaaaauugugguucagaggugucugugacugcuugagcuuaaaaccaugacucacuacccaggugacaaguauuucaucucuuguaagucucaguuuucucaucucugaaauguacauagcauaccugccugacuuacaguagcaaagaauuugucuuauggcauguguuaaagcuuagguguuugaggaaaauaauucucuuuuuuaaaaaaauuuuaauagacggaguaaauacaguaaagccaaacaagaagcggaugaagagaaacauuugaaucaagguacaaaaaauuggauuaaaaaauucuauuuuuagagcaugucacacguuuucuaguuuaaacauguucaaauaauauuuacguggcuauuaauguuauauaauauaauauauuuauuccuuaucccaauaauguacuuccuagguaucaaacugaaaugggugauuuggauggugagauuaaagaugugggaugagguagagaaguuucuuuagauuuuuacuuuuucuuauuuuauccucuacccuaagaaaguuaucagucuagcuggcucauuguuguagcuggguggcaaaauuaaauggguauuuuuuuuaaucuaagcuggaaauuugaggaggaggaaaagaauaagaaauguaacaguaauugcuacuucccagggaauggcuauaugugauauagaauuagugacugucaauaaauuuuuaguggauucuaauuuugauguuccaaagaggucaaagaagacauuaaaaguggcucuagagugacuuaagcaagguagaagacuuuuuuuuuuuuuuuuuuuucugacggagucuugcucugucggccaggcuggagugcacuggcaugaucuuggcucacugcaagcuccgccucccugguucacaccauucucccaccucagccuccugaguagcugggauuacaggcacccgccacgacccccggcuaauuuuuuuguacuuuuaguagagaugggauuucaccguguuagccaggauggucuccaucuccugaccucgugauccgcccgccucggccucccaaagcgcugggauuacaggugugagccaccgcacccagccaguagaagacuuuuaaauggacagugguuggugacuauccaggagagcuguccacuagaacuuucugagauaacauuguucuauaucugcacuguccaaaauguaagccaauagccacacaagcuauugaauacuugaaauguagcuaauaugacugagaaagugauuuuuaaauuuaacuuauuuauauuuagauagccucauguaacaagucacucacauauuagugcagaaagauagaagaaagauuggccgggcacaguggcuuaugccuguaauccuagcacuuugggaggccaaggagggcagaucacuugagaucuggaguucgagaccagccuagccaacauggcaaaacuccgucucuacaaaaaauaacuaaauuagccaggcaugauaaugcacgccuguaaucccagauacucaggaggcugaggcacgagaauugcuugaacccaggaggcggagguugcagugaaccaagauccuaccacuguacuccagccugagcgacacagccagacucugucuccagaaaaaaaaaaaaaaaaaaaaaaaaaaaagauagaaaaaaagagagggacugggaauaacaagacucaucuugaagauuuucuuggcuauagcauauaaagugaugagggauaugaagugucuaacaacuuuccauuuauucaccucguuuccuccuaaaaucauguuuuuuaaauuuuuacauggaauauauguuuuuuuaaaaagcugaucuauuaaaaagaaguagcaagaaauugccaauuuaaggagcuuauuccuaaccaauggugcugggaugaggacaagaccuacaggcuuggaaagucgaagggacugggccaacugguguccuucauacccucugugccccagugccccaacagcuccaggagggagaggugcaagugccaggacaaagcuuuuuacaaugacuucugccucuuggcccagauaucugucacugggcugccggcaaacacaucuaaauuuaguuuauggguaguaugagauauggcugaaucauacuuccugaugucuaggcuacaaugcuuaucuccagcugaaacuuucuggcaaacuugaauaucuuagcuuaugacaccuucuuuccaaaccagaaaagaagugagguccacuacagagucuguauucucaaaucaacuagcugauauuaaccuuauugucuacuuuaacuuagguuuaaucuaauuuuguuaauuguuggucacauauuuaauucauccagauauugggcaaaaugugacaccauguggaaagagcuguuugaaauuaaaaugcuucuauuuccuucccuaagggaggauaacugaaaguaguggguaggacuucaugcaaaggcaagggagcuaugagcaacugcuugggacaauaguauuuagcuaacacaauucaaauuuccuccaugggauggguuguuuuaaaaaucuuguccuugaagugugaagacauuccaggaagucaguaaagcugcagccucuuaaguagcuaacaauauuuuguuuacccacuaaugaaaaccagagcaagaauuuaaccauuuucauaugucaagaccguacagcuaacuugacuuuuccuauguuugguaauuuuagacccagacuauuuauguuuauuagugguuccuuagaaguauucagccaacuuaucauguuuaucacucagguguaagaacauauguggaccccuuuacguacgaagaucccaaccaagcagugcgagaguuugccaaagaaauugacgcauccugcauuaagauugaaaaaguuauaggaguugguaagugucugaguguccgucugcuaaugagucuguuuucuugguggauguuaaauauguguguggauuacauaaaugcuuuugugaguauauuauauguguguauauacaugaaauuuccuuuuuugaguauaaaauaucauguguuauaaagaacucuaguacaaauuuugauuuuauucuuagagagaaacuuaaugcaaucugaaaucagauugauugcauucaaaagauuuacucuguuucuuacuaacuaagauuuuguguagguuuuuugcauuaagccuuaguuuucucuaauaaaauggggcuaauaguagcaucuacuucaggguugcauggaggauuuugugaaauaaucuaugcaaagcacuagcaaacagccuggcguguaacaagcacucaaggaauguuagcuguuauucuuucaucuugaauguguuucugguccaucguagauucuuuuucucucucaaaggugaauuuggugagguaugcagugggcgucucaaagugccuggcaagagagagaucuguguggcuaucaagacucugaaagcugguuauacagacaaacagaggagagacuuccugagugaggccagcaucaugggacaguuugaccauccgaacaucauucacuuggaaggcguggucacuaaauguacgugggucacccccuuuacaaagccaagcuagaaguuacugggaaauuaaacacacauuuucuuuccagggaaaugacagauggcgcagacccacugauugcuaauaggaggaaaucagugcaggacaagucauuaaucuuguagucagcucuaaaugggucuuugguuuuggcuggauacccuaucuccaaggcagcuugugugagauuuuagagaaauuaauauugcagauuugugguaugccaugccauccuucagauauuugcuaggccaaacugauugucauagggugggcucaagcagaugguaagcaaaauaaaauuuaaguacuuuuccuauaaagcacaacaaaaccuggccacaccuugugcuggaaucuuugguuccagaugcagagagugaagcuugggaaucuugaauauauugcgggauuugcuugucugcucugccugauuuauggcuguugcaguucagcaccuauuuacaguaacaccugguugaacuuuccuuuuuuaguccauuagcauucgcugagccuaugaaccacgcuucaguuaaaaugcgacacagcucaacagaugcauuuugugaagcaaauccugaguaaaucuguaaggcuggcuaagaccaacuuauaaagugccacauagacagcacagcugaggcagucccuguuuaagguggcuguguuccaagagcccucauacacacuacaguuacuacaagucaaggaucucauaagccuggggcuguguccccuggaaagccaaggcuuuucuucuuugauucaaggugucuguggaaagcaucuucagucagcgugugcagaguaauggcaauauagccaccccagugugggggagcagucggaggaggguagguuaaagagaaaaacugaugcuggguguaaucacucauaccuguagucuuagcuacuuaggaggcugaggcaggaggaucacuugagcccaggaguuugaggcugcaguugagauggguaaguuuccuggaccccucgugggacuuguaauggggugugacuuguuuugcuuggccaccgagcucaaacuucuuguaggagggggagcacacaguuuagcaccugcaggagccugggcgagugguugccagugaccucuggagccccagguguauguuacaaauaaugcucuuuuagcaguugucauccacggauggcuaaguguuaaccagcucaguggagagucggggugacagccuuuuucacccucccgucuugguaccuggguuccugucugguguccaggaagaaucaggucacauggacuugaaggauggugaauguguagguuuuauugggugauggagguggcucucagcgggauggggagcuggaaaggggaaggaauaggaagauaaucuuccccuggaguuugacuauuccuaagguaaugcccacgguuuccaguguugaagguggggccuuugcagggaaccacccucuucuacccaguauuucccugccgccuguccauaucauuccuagugagcuacgauaguaccacugcaccccaguccaggugacagaggcaccuggacucuauuuuuuuaauagaaaccugucucuacuuaaaaaaaaaaaaaaaaagaaaagaaaagaaaaaaugagacauuaggccuggggcagguggcuaguaggacacaaaguacaaaaucuuuaggaagaagaaaugaggugguuacuaaaaugggagagaaaguacacacuauacaguucagggguccucaaacauaagaaucuucuggaaagcuuguuaggacaguuucuugggccuccugcucagagguuugauucagcagguggugugcggcccguaaguuuggagugcaagagagcucaccacaggugaagccaaugcugcugguaugggaaucacgcuuugagaaccauuggccuggggacaaacgaccgcauaccaccucugcugcuucuaaagcuugugaccuuggacuacuuguucaaucuuucucuuucaguuuucucaucuguaaaauggagguaaaaagagcauuugccuuauaagguuauuuuggggaugaaauagaauacuuagagugguuaccacaauagcaaauuuuuucagaaaaaaccucguacguguucaguggugcuauuaugucuuaagaaguagguacaucuuuccccaucuucagaaucuuucaaaaaaaaaaaaaaaggaaccuuggugagaaggauauauaauuuuccgcauaaggugaaggcuauaauuagcauagaauagcucuauuugcuuuuugagauuaguuuuacagacaggauauuuuucuguugccuguggccuucagggccgcccagagcccuucacuacuuuaauuaaaagauaacauucccuuuaaauacuuuugcagguccguuuucuaaaaaggaggcucuguucagcuuaggguguuuuuccugucgcagacagugauuuuccuagcaccucugcagaagagagaagaaacaggggaucuuuguauuaaagucccaccgcgccucuaaaacacguagcuauuacagcuguaacuguuauaaacgacuggaugcauuugcauaaugcaguugucacugaauuaaaaugauuuaaaauuucuauuggagaagcuauucccuucccccaccccuuuccuccccacugcaucccugccuacugcagggaaggagacuccucuauccaagagcccagcccaggccuauuuuauaagccccuuugcuuauggagacauucaucuuuguuucccuuguagagcucauaaaggaucugacaaauggauacuuuuaauaaacagaaaauggaaugcagaaaauuugugaagauggugccaagaguccgacuagggaggugugagggugaaaggguagaguggaagcgugugaauucauuaccagcaguuacuugaguaacuuuuuaaauuggcaggaggaccauaaauucuccgcaugacccucacuuuuggauccucuccugucgucuccacagcuccagagggaucuggugaaaugcaaggagguguuaaugcacagccaugagaggcugcccuuucucguuaguugacaaaguaucuuuugauugaggcagguugauuaaaacucauuuaggcacauuuguucugucagaagacuauggucacaagcugggcucgguggcuagugccuggaaucccagcuacucaagaggcugaggcaggaggaucccuugagcccaggaguucaaggcugcagugaguuaugaucaugucacuguacucuagcuugggccacagagccagacccugucucuuaaaaaaaaaaaagaaaagaaaagaaauucacccaggcuugagugcaguggcacgaucuuggcucacuguaaccuccgccuccugggcucaagugauucuccugucucagccucccgaguagcugggacuacaggugugcaccacugcauccggcaauuuuuuuuuuuuuuuuugaguagaaaacccuggucacauauguagaggguaaaugaaucugagaacuaagcauuuccuauuuguauugauagagaaugugcagacacaccccugccagcguagagaaaagacuuaaaagugguuuuaugcaccuuuggucugcaccaagauucccacuuuuucuaccagccuucuuuccucacuugaaaauaaaauguccaugguaccauuuucuaaugcaaaaguguuugccucugaguaauuucuuagacacaacaccaaaaacucaagcaaucaagaaauaucacaaauugauauauuggacuucauggaauuaaaaacccacucuucaacacuuuugccccuaaggugaaaaauuuccccaugcccuauaugccagaaauuauaagcugauggaaucacuggguggaaaauguauuucuuuagaauaauuaugggugcuuuucagcggugaaauaguucagcccauuuuucuagacugaagucuaaauaaucagccaaugcagcaauaaaaagugugauuuuuuuuauuuuuauuuuuuuagaaugacucucacucugucacccaggcuucagugcaguggcaugaucucggcucacugcaaccucugccuccugggcucaagugauucucuugucucagccucccgagaagcugggacugcaagugcguacugcacccggcaaauuuuuguauuuuuaguagacacgagguuucaccauguuggcuaggcuggucucaaaccccuugccucaagugacccaccugccucggccucccaaagugcuggaauugcaggugugagccaccgugcccugccagugugaauauuuuugguauaucaaacugacauuuuauuuucuuccaaaggaauauuuuagggaccuguuuuauccugcucuuagaaaaaacaaaacaaagcaaaaaaaaacaccucaugauucccacccuccacuugccaacaauaaauacccuuuagaaagaaggaauuucagaccuugagccuauugccugugaucaagaagguaaagaaugguucuuauguccuaaaguccucagaaagcggacuuuugugaaaaucuuauuuacaccucauucugcucagagcuuaaaaucauuuuuauuucuuugcagaaaaaaaaaauagguagggggaaugggggaaauaaggauguucuaguauugaauuuaaauuccugucucagaugaaauaauuuucugaaccuuuccugugacuguucugggguuuuuguuuguuuguuuuuugagguaggcaguuuaaggaaucagaccaaagcaaguuuauucauagcuagggaaagugaagagaaagacagaggcccugagcugagcaagacaguggagagaagucgcaugcuuguuuuuuuguuuguuuuuugagacggagucucuguaucgucgccccccaggcuggaguguaaugacgcaaucucggcucacuacaaccuuggccucccgaguucaagcaauucuccugccucagccuccugaguagcugggauuacaggcgccugccaccaugcuuggcaaauuuuuuuuuuuuuuuuguauuuuuaguagaaacgggguuucaccauguuggccaggcuugucucgaacuccugaccugaggcaauccgacugucuuggccucccaaagugcugagauuacaggcaugagccaccgaacccgccugcgugcuugguuuuaaggcuugucuggguaaggaaggauucaacauagcuacugcucccugaaacauggauuucucuaaauaaagaaguuuauugccuauugaccuccuuagcuucuuacaaguggcucuucugaggacaaaauaaauuaauuauccuaaagauuauuucugcauugaaacaggccuccccauuuaucauuuuccccuuuugcuugagagagcaauuauccauucauaugcucccuggauaccagaggccacuuuaguuaaagaccuugucaacaagccacccaaagguuuaacuauccagauggaauuuaaaccuacucguccuuuuaauauuucauuccuagcuccccacagcugaggcauaagcuuggcuuguuuuaauuaaauuagaucacacaagacagguaucuuggcaguaaaauugugcgcagcccauuuuuaucucauuaagugcagcgcucaucaaagguuuguguuuuucuuucugaaaacucuagguaaaccaguaaugaucauaacagaguacauggagaauggcuccuuggaugcauuccucaggguaugugacuacuuuauauuaaacccaagaauguugguauuuagaaaacuccuaacagaguccuuguguuuguuguguucggugguauucguggauuucuuuuaaugggcaaagaaagaagaggagaaauggagaaugaugugauuuuuaaggcuauuaaauaauccauguucaacgaggguaguuuuugauuuauuccuguaauguggagcuguuggagccguagauucauuacaguuggauaauuuccaucuaucacaggaagcaaacccagcuccuaggguacagucuacuagugaauuagcgacuuuggucagaaaggccuggaaauaauguugaguuucauugcauaccggauacagauacccaaaaagauucaaguaauaaaugcuuggugagaauuaacuuggccuaaugcuaaugagauuguuccucacuccuuuucuaugcagaaaaaugauggcagauuuacagucauucagcuggugggcaugcuucguggcauugggucugggaugaaguauuuaucugauaugagcuaugugcaucgugaucuggccgcacggaacauccuggugaacagcaacuuggucugcaaagugucugauuuuggcaugucccgagugcuugaggaugauccggaagcagcuuacaccaccaggguaagaaagaucggugacaucugggcuuucacucuggugaaacuguuccucucuucucacuuugagauugaagcccuuuguaauuuuuuuauuuuuuaaguuuucucaucccuugaagccuccucauauuccugcauccauuuuuaaaccauguuuccaauaaaagagggauuuugaagcugacuguagauguaugaccauauuaacagccacaaacuagaagcaaaaugaauuaucuuucccucuauguuuuuuuuugggagggcagggggaagaaagugcuaaugaacaauaagacggugucuuaaauaaaaaugagcugagaagcaagcauuaaggaucaguuuacacaacaaaugaucaauuacugagaaaaucaggagguagcuucacuuauuuauuuuuuugcacuuguauuugccugccugucuuccugccucuuucuuccuuuuuuuuuuuuuguuguuguuuuagguuuuguauuugccuuuuuucuauucuuuaaaaaaaauccuuauucuaaaugagacaaagcaauguuucuaguugguuggcuaccaaaucucagaauguauauacaggauuuauaaaacauuuauaccaugcaagguuuuccaguaucuaauggccuucauuuuaccacugguagauaagcggggauuaggacacagugaagaguuuuaaguacacaguuaauggcugugcuaucuuagcucgacuaucugaauauaaaauacuaauggaauaaacacagaaucauaaaacaguuauuggccauuaacacugacacuguuaaaaucaacacgaagcugacaguuaccagccauuuuccccuuuuaacacucuucauuuugcaucugcaaucccaagcaauggggguuuuuuguuguugguugguuggcugagcuuuuuuuggaggggggcagggggguauaguauucuauuucuuuggcuccaguuuugauucuuaugcuuguccucuuuugaauuccaaguccauucguuuagaaaagaauagaucuuugugaauguugaagaucuuuuauuuuuucccaguaguuggagaaagaaaaguuaaaggaggcuucuagaaugauacauuuacauagauaaaaccuuagccaaauauuuaagcaggggggaaugcaguacaaguguccuucugugcguaacaaggaugaaugcaauacacuggguuuucagaguuuacugcaauguaucaaagcaauuuccaguacaauuuauuguccuguuucguagcccuaccuaagaaagcaaagaaaccuuuuaaaugauagcccuggggauaccucaggggucugaauuagacuugaauuaauuuccccagguggaacccuaggacauugaaaaccugacugaaaauaccuuauaccuaagcauaaacaaacaagacauuugaggcagaaaaaaaaguguguuuugcaacuuuuccuggguaauauucacuugcuuuaccauuuuacaagucuuuuuuuuuuaauuuaauaacaacuaauauccugcccuuacuccauuaaagucauuaauagcucuaguaucugguauuauuuggcuuucucuaaaggccuauuuaucauaucauccccuagcuauuggacauauuucucaugcuguauaaggggagguagacuugugugauggauagaaauguucauauuuaaauuccuucauucaugauuuuugaagcaguguaagcauugccuuccuuugugcuccugggugagagaauccaacaaaaaaucaaacaaaugucagcuacauaucacugauaccccguagauaacacguauuuuguaaaaccugagauuucuuuuuuucuagaauauugccuuaagcagagcucagauaauagguaggcuuuaaaaacauaauuagauuacuuagucacuucccugugaguaaagaaaacauaagagaacuguguuaaccuggaagacuugcguuaaaaugaacaagugucuuauuguuuugagagcuaucucaagaaugcuguuguccugcuuggcuagcaggaacuacauucagaaucuaaaauggcacaucagugauguacuuaaggaauaacuuauggcucaaauguucacaggguggcaagauuccuauccgguggacugcgccagaagcaauugccuaucguaaauucacaucagcaagugauguauggagcuauggaaucguuaugugggaagugaugucguacggggagaggcccuauugggauauguccaaucaagauguaagucucuauguucugaaauauauuuuuucacauugagauucaggaaguucugcauuacuguaugauggagugggcacgggguuugaaaugauacauuaaacucaaauuucuuaauacagauauaucuagcaagcuaguucaacauuacaaccaaugacuauugauuucaaggacaagaauuaaauggccuacaugguacaguaugggagauagauacauacgcacauagauucauggauaaaaaauaugggauaguauuuuuacuuggugaacuuucaaaaccagaguaaaacaaaauuaaacuuugacuuuuaagaaaaugcaaagauuaugaaaaaauaaauuucacauaugauaaaacggacaugaaaggcuuauugaaagaaaacuagugaauauuuuaaagcuggcaucguuguaauuagagcucaccccuugaggacucuaaaauaaagcuucacucaaugacccuugguaaauuaugcacaucccuuuaaauguaccaucuggacuacuucguaagggaguauccacaaugacugcaauuucagaaaaggauucaauaaugacacuaauaagauuccagaguaauagaauuuaauuacaaacaucuccagugagaaagaaagaaaaaaaaauaaaagaaagcauugaucaaggggucuuccuagaacacguuuuagcuaauucuggaaaaguuuacauuaguucugguaagauugggaaucauauuaaaauuaaauggccaccuauacuuuucgaacuuuccuaauuuuuuauguaugugguaguccauuaucagagaguguuuacaaaugcaagguauucaguuuaucaguuauaauuauauuuuggaaacuucuuuucaaaaauucucucugugguggaauguuaccuauccaucugccuugucuuccuccaacaacaggcaguugcacagccuugacaguuagagccacgugcacuuaagaaaugggaugcagguugccuuaucaauuaaagaauguucaaugcaggccgggcccuguggcucacgccuguaaucccagcacuuugggaggccgaggcggguggaucacaaggucaggaguucgagaccagccugagcaacauggugaaaccccgucucuacuaaaaauacaaaaaauuagccgggcauaguggugggugccuggaaucccagcuacucaggaggcugaggcaggagaaucgcuagaaccuaagaggcagagauugcagugagcagagaucacgccacugcacuccagccugggcgaaagaguaagacuccgucucaaaaaaaaaaaaaaaaaaaaaaaauacaaagauuugcugggcgugguggugugcgccuguagucccagcuacucgggacgcugagguaggcuaaucgcuugaaccugggaggcggagguugcagugagccaagaugacaccacuguaauucagccugggccacagaaugagacucugucucaaaaaaaaaaaaaaauguucggugcaauagagaaaugcacuccaugucugguggggcaaaaagaauucucuaugcugaccaaccagauuaaggggaaugguaguguucacacuguauuaucuguggauuauaacagaagauucauagcagaugggaagaaagcagcuagccuaagugauaguaauuacagguuggaagaagacuauggaggggaauagcauguaaucuauuguuuaugugauuaugcugugcagacagcuucuaguagcuucuuguagccacauuuggauucagguuagagacucucacagggacaaagacaaaaaaccuaaaugagcaaauaguaaauguaguuacuguaauuauucgauacuuaagcuuucuuuuucuuccguugaaaucauggccaaauguucguaagagcagaguaucuaaagaugucaguuuuucuacccuaaauauguucagaucuguaauuuuggcaguuuauauauauguauuuuauauauauauacacacauauauauaaaaaaacaauauauauauauaaagaauucuguuguuuugaacuuucaguucucuggcuuuauccacgaaaaggcaucugaagccauuucuugcucacaaauaauauugaucuauuauuugucucuguguuggauucuauguagaacaggaaucaauaggaaauguaucuggggaauuacuuugaugcauagaauuaauuuggcauaugguaaauggagugaaaguaacuguugaaaauaugucaaacuuagcaaguuuuuuguuuaguuuaauccucugccccccaaaauauuuaguaguaaacugagaaaauaugcuuugcuaaccuaugagccaucuuccaagcuggcaguggauagggagcuuaugaaagagcauuaaucagucugagggguuauaacaauuuauguuccgcuggcaucagcccaguguugcuuucauucuccucaauucagugcaaaauguucucaucaagucuagagucaacacgaugcaccugggaagauaaaagaaacccaggugaucaaacugacguaguguaauugcuagaaacaaauagaauaagguucaauaagacagcauagagaagucugcuuuacaaagaaaaguaggugauacugauacaugauauuggcaaaauacauaggagaaaaaggaucagagggcuuaauaaaucacaagaugauuuguuaaacugaaacggugcucuuauuaaaaagaucacagucauacuaauccauggacccuggacccaacagacucuuuucuuucgaaggccaauuucugagcagucaauagacccaccacagggugaguccagugaagucauugggauggcucaaccacugcuuauuucucuggcagcuaucauguugauagaaagaaaaauaaauggagugauuuaaagcaaauaaaacuuuuagacucccaaacaaauaaaagcaccuccagaaucucagaggauauccauaaacaaagguaaugaguagccaaaaaacugugaaguaguucuccucuauaaauuuggcauguccuaccauauuauuuucuuggaauuuauaccccaaagcagggggaggauguuagagaaaaggcuauaagaaaauaauuuaaugccugugaagacagauuagaaaaauuagaauuagcaaagagacuguugaaugaguuauuuaugacuuacuaggcaaggagaccacucugggcacucuggauggucuuggccaauaagacaauuaucauguaccauuauaacuuccuucuuuagaugugcgagggucuccuuuaaaauguaaaugccccaaaagaaggaauuuuuuuaauuguuuuuuacuuuuuuaaaaaaaaucuacuuacuaacaccuuuaacagggucgacugacagccaacugagaccaagaaagaaauucagaguuggugucuagggguagaguaauccaaaagaaaaaauggcugggcgucuggacuuggacucugguguugacacacuggcugucuauguaagaggacagggccuuaaaaggaggcaaagaaaauuccauuuuggagacagcuauuaauugcuucccaagggaggucuuuggcacuaagucagagucucuuuugcgaagaguguuuaggugugcuaauagcagaauggagcggggcaggggacuggaggcagggggcagggggcagggccacaugaucucugagggccgucaccaaaacugacaccacauuguggauuugacugggcucuagccacuugagaacauugaugcaucuucccuuuagaguacaccucagugcaacagcuggcuucccucuccuguugccagugauacucaggucuagcuuuggcucaugugaaggaguuggagcuguucccaggcuccagcuugcuggcagcuucaugcacaagaaacaugccagucggaagggugaaccuugaacagcagcuugccuggcagcuuaacauaccauccuguugucuuccauaggugauuaaagccauugaggaaggcuaucgguuacccccuccaauggacugccccauugcgcuccaccagcugaugcuagacugcuggcagaaggagaggagcgacaggccuaaauuugggcagauugucaacauguuggacaaacucauccgcaaccccaacagcuugaagaggacagggacggagagcuccaggucagccaugcuuacuuaauagugauguaugaaagaacacauuagaggaggcaggcaaguggugacucacuuaaauuccugccuuuucaucagaggccacuucauggcucucugcaaccuggguggcuucuuucucaauuaguagaguauuucagguaguucuauucagcauuuugaauaacuaauaccugucaggcaucaaauaguuauaaggaaaaaacuuuaaaaaauaauaauaguaggaaagaaauaacugaagugccuauuuuaggaugccaggccugaaauuuaggaagaggggugaaauguacuuuuagaagacguucagaucaguaggugcuauauuuugaaauggggcaggaacacuggaauaguaagaaauaaagauuagaaaacaggucuuuaagcacggcaauuuuaaguugauuuauaaaguguuaauuguaagaaagagauucauuagguuucaguucuucugguuucccuuuucugagucuuucagaguaggaggaaacagggccaagauaggaaaugauugaguuauaaagcaugcagaugaauguuugggaaggauuuuaaagaccaaaaugauuggaccaccugaaagagguaguuauuuucuuggaaugagcaaaaugaagaaguauaucagucuguagagaacauaaagauacuauaaguccuacaaguucagugagaacuuucuacauggagaauggacuuuacugguauaagacucaggauaccuacauaucaguagucucaucugaaaggguguggaccaucuuuaucaguuaaauuauuuuagaauacaggcauaauagaccaggugacucaggccugcgagaggugagacacucacucaucuccaagucugagcuucucacaggcuucuguuucaucaugauccuguguuaaaaauaggaggacauuuucucccguaauauuuaagcccuuccagucuuugcaggcccugugguguucuccucucaucuuucuccugaaaacuuggacuaaagauucuagaaaagaaggaaaacacauuacaugaaaaaaaagagaacuguggaauagauaguagagauacccuauauucuccaccagguuuucaaaucccugucauuagccacuacacaaaaugcucaauggucuauccagcucuuuucaaauaacacugaaaagggcugaauuaacauuucaccucugccacuuggucacuaugugaacuaaaaaaaauuaaaagucuccuacuauugugaggcuauuucuuguucuucuguucuccaggagggugaaauagaugacuauaaggccuccuuuccagaucuagcugacuucucuuccaccuuuuagaucuucagcaccagagcccauguauuuugucugaggguccauucaaggccaguuuuuugguguuugguacuucuucuguuagcauaagucauucaaccacuacuaucacauagcaucugcuuugccccaagguacagaacaaguugagguauuagauacacuauuaucaguucuaaauucuuuuugcugaugguacuuaaauagcuuugaagcuuauuauggcuuaccuauaaugagauguaguauaacaugguaugugauucagcacaaaauuaggcuaacaucauggugugcuaccaagagcacagaggcuuccagaacaagcuuaagaaccacccuuaaaguuaauugacaucgagugaagauauuuucauuguaaggucauuuugaccuugucggugcucagagccuacaucuuccucauuaaugcuuuuggcuuaaagucagaaguaaaugcaaacuauuggcuuuugucuaauaacaaauauuauugcuauauauccacacucaauuaaauguccaaaauucuaugugguaacauuuguuguugacucaaaauugaaagaauaauuauaucuugauuauuuuugcuguaaacauuuacagaauuguacuuagaaaaucaaacuuauauugaaauaauggacacaaaagacagguuacaauggcaagguauuauuuggacacaaaacugacugauaaaacaaaucuuuguuaaaauauuuauauaaaaaagaaauaauacaagucaagucaauuuagauaaaaaugaaaauuuuaaaaaucgaauuggauuaauucugcuauguagaaaaguaaagcauuauaucgacuuaauuuuguuuuuacaaggaaagaguuuuuugguugaaaauuuaguaguaaugauauaauugugauuuaaauguuuguacuuaaacauaguaucacguugaaaaucaggucaaaauguuaagaucaaacacauucugugaguuuuaggaaaaacagaaguucaaaaacuaugacuuaacaaguagcaguauuuuucuacagguuauuauaaguaaagguaguauaaaauaaccccaugaaggccugcucuaugguuauucagcaauugggugaugaagauaacuaacuauaauucucuuaauaguuuuuauuaguaaaugauuuuuuauaugucaauaucauuaggaaaggcagaauuccagccuguaauugcuugugacagugaccuaauagaaaacaccuggccuaagaaaugaguaaacuaauaaauaaguuaauaagaagugcuuugaauuuguugaaaucauuauucaggaaccccagcaagggaauacgagaagcacauuccacaauccaaacagugaucaaaguggccguucuucugccagccuuggcacucgugcuggucaggcauggauugauuaaagaggggauuaacucccugcugucccaaguuuguuugaaugccccaagccugccuguagacuaggcuggaagcaugcuggacuugaauucuugcuguuuucucugcuuccauccagucuggcagguggcaagcucgcaguuuuccuuacucauccuucacuaggguuuccauaguugcugaacgaaagucuguaauauucaguacuggcagagacuggacucuuucugcaaagauugaacagguuucggccaugagggcucucccagucuucaccccaggcuaggguguuaaaagaccugcuaugagcaugaaugcccucagagggccacauaaaacaagcgcaggaaauagaauuaagaaaaaauaggaugauugauacaugcuuuagcagcuuugugaaguuaagagcaaaauauugcauaguuacauuuaacaacaauuguuccauuuaaaaccuucccuuagcuuuucaguucuccuugccuauuugaggcaaucagauuucugagucuucuugucucacugguagcuccguucugcuuauauuuucuuguucucuuucuagaccuaacacugccuuguuggauccaagcuccccugaauucucugcugugguaucagugggcgauuggcuccaggccauuaaaauggaccgguauaaggauaacuucacagcugcugguuauaccacacuagaggcuguggugcacgugaaccaggaguaaguacucaacgauguaacacgaaaggguaaaucuagauuuaauaguauuuucuuuuuuugcuuugagcugcguaaucauccuacucauuuaaaaaaaaucuggaaugccucucauuuugauugaguauaauuuuacacagccucuauaaaguaucuacauucuugcauuaaauugcuuaaugaaacauuuuaauacaccugccuuguugugcuguauuaauuguggcugauucaaacgugugucugcaugaagcccaagaaaagagauugucagucccugugacuucuucugucccuuuuuugucgcccuauguacagggaccuggcaagaauugguaucacagccaucacgcaccagaauaagauuuugagcaguguccaggcaaugcgaacccaaaugcagcagaugcacggcagaaugguucccgucugagccaguacugaauaaacucaaaacucuugaaauuaguuuaccucauccaugcacuuuaauugaagaacugcacuuuuuuuacuucgucuucgcccucugaaauuaaagaaaugaaaaaaaaaaacaauaucugcagcguugcuuggugcacagauugcugaaacuguggggcuuacagaaaugacugccggucauuugaaugagaccuggaacaaaucguuucucagaaguacuuuucuguucaucaccagucuguaaaauacauguaccuauagaaauagaacacugccucugaguuuugaugcuguauuugcugccagacacugagcuucugagacaucccugauucucucuccauuuggaauuacaaccauuguauuuuguuuguggcauaaauuacagucaucugucuuucacuggaaugaagaccaugccuaggaacauuuuuuaaggacucagcuguggcuuuuagggcuugguucauaccaugggggaaaaaaaaguccuaggagaaagcgacguggcucauuaguguugccucuucagugcucaagccgccugguggauuccuaugacacagggggccuggaaagaaagggaaaguggauuuaaaauauauauauacguaacccaagccccauaaccccuaacuggacaaaugaggucuguuucuuugggccugaggcugugccauauaaagucuuauuuugggacuuuacaaacuuguccuaacuaucuuguggauagugggcugugacaaucuggaauagagaacguucacacuucgcuccuuuaaagaagcgaccccagaucugcaagguaaguccaacaaccaagaaugauuuuuucuccagugaaaacuccuuuugugcuuuaaacuugaucucauucgaaauacugaaaacagaaaaauacucucucaugucucucagguuguguugauguuuuucaggauuucaguccuuuuuugacagcgaaagaggagaccaaacacagugugguuucccugcuauucuuccggggagaagugacauaugacccagaugaggucaggcucugagggaugguccuagaugcucacuggcuguuggcugugugcuuuccaucacgaagggcuccuccuguccuuuggugccauucauucaugguacacauauuuauuaucuucugggcaccaggcagcaagcacaggaggcuuucucucuaaccuuguuaggucaugggucccguccuuuggagaguuuaccucaauggagaaguacuggcgagacuuuuccauuagccucauuuucuguccugcuccaggaaacuccauccccaaacagggccaaagaggauucaccaagaugccaguggugagacuuggaacucgccucggcuuucucaugaucagaaaguugaacuacugaaaaaugcacugcucauccauaaaccuauuagcuuucaaugcuucuauuuuuauauaccagcauugaguuuguucauuccuagaaacaaaggacauaacuuuggacuggacacauuuuaacuuuucauucuuuuuuuuuuuuugaguuauuucauuuuuaucacuuuuaaacaagaguugcugauuuuaacgaccuuucuuuccccuugguuguauccugaaagcuauuucuuauagagcaaggaauguuaaauuugaugcugucaaaucaugacaguuuagugaaaaccuuuuuugcaacauaaguuguaaaagcuuuucuguucagaaggaaugugaaauuuguuuuuaaaacuacuccaacaauuuuuguuuuaucaccacuuuugcagaagucuaggaguucuggauauucacguuaaaagcugacaaauguaggacuuuuuuguuucuuuugcuugcuugguaaaaaaaaaaaauuauuauuauuauuauuauuacuauuugagacaaagucucacucuguugcccaggcuggagugcaguggugcaaucuuggcucacugcaaccuuggccuccugggcucaagcaauucugccucagccucccaaguagcugggauuacaggcacccaccacccaggccuggcuaauuuuuguauuuuuaguggagacgggguuucaccauguugaccaggcuggucucgaacucuugaucucagacaguccaccugccucagccucccaaaguguugggauuacaggcgucggucacugcgcccagguggcauuguauuuuaacuaacaacagaauguuaccuuguguacauugaauaauuaaaaguuuuuuuuuuuuuucuuaaagucuacaacuuaagacaagguauuuucuaaacacugaacauauuaaaagcagaccauuucaacagagaacauguccauucugaaauagccuaacaacauuauauacuaugcugguguuguuuuguuccugcucagcagguauuucuguaaaugaaguaaucagggaaggaucaaaggagaggugaaguaugaaaucuuauuuuauucaaaggucaccgucugaaucuucaaaauuucaacauaugcauauauuagagucaaggcugaugcaaaggccaaaaaaggacuuuccaagugccuaaaauaauauccagcaacaguaaaaguguuaacucucuccacuaccuccaugaaguuuuagaagagaaaugugagaacaauaggaaugaugcauuguuucccagggcgcagagccagacucuggcauccggacagcuauggauucuaaagccaacugaaauguugacacugggaaauucacuccacuuuucuuuauaacucaguuccuccaccuggaaauuagagagauaaugauaccuuaauaauaacaccuuuccuaaugcaugguguuguugcaaguguguaugaaauauucuuaaguaaaacacggugagcuccacagaagaaagguacgcuucuuccuccaacauuguccaaguauuauucaucugucuuucacuuguaaccccaauuguuuuauuacaacaugccagaguggggugaaaugaaguucagugguaggggggucacacagugaagcuucuucacuuaaauggauuuaugagaguuuggagguaaauacauauuuauacaauggugguagaccuuucaaguuaugcuggcaggauaaacaugcauuauuuagccuugacauuuauaaaauuauuguuuuguaauggggaagacagugauacaaaaguaaaauucuauugcaaugaaaagaacuggaugguaaagacauuuugaugucaucacgacugacucaaaggaacaagccuuuguuuauuuagucacaaugaauucuccuuaacucaugacccuacauagaccacaugcuuugucuggucucuguuuaagaaauuucccaugauaaaggaguugccugaauucaauggugaggagaaggcuuauuucacucaacucguauccuggcauuaaguagauacaagucuucacauucccuuacaucucaauucaaauguccaaucauuucugcauacacaccaaguccccaaauugcccacuuaauauuacaaauauauuuauguaauaucuauugauauccagauguuaaguggagaaggaauuggcagacugaaaggcaacacguguuuaugagaccauucuuucuccuuuaagaauuucuaguagcaaaagaaaccauuaccaaccuuguguguccgcaggacguggaauacacucuagcguuuuaagaucauauucauguucuccucauacuucacauaaauaccugcccaccugaugaaaucccuucacauucagguuucaaaaacuacauuugauggauuugaccgauuuccagagaggaaauaguuagaagguagauuugaugacuuuucugucauuuuuacguaauugucaacauaacauucauguucaugucgacccagggaccacaggugugcacaaccaugccuggcuaauuuuuuuuuuuuuuuuuaaagauggggucuugcucuuuugcccaggcuggucucaaacucuugggcucaagcagucuucccuccuugggcucccaaagugcuggaauuacagguaugagcuacaagaccuggccagaaaacgauuucucucucuuuaaauagacuaaaguguuuucuacaauuuuaaauauggucguuuacuacaaaaaauuaaauuuuauucucuacacgauaaauguacacauaugcaaaacagacaagugauuugauaaaauaggcaaaauaaucuauaaaagugcauuuuggucuuaauuacugcccuuugcuugaggccaccagcugcuaaacauggucaccguggugggaggcauaguccaauaaguaaucuggauaguugguuguuauaaaugaaagaagggaacuuacuuccuuugguuugaguugauuaugugacaaauauauggacaaugaggagccaugaggaguccauugcugugugccagccuuguucgauuccaggcugaugucuagaauuccagccugcggcugauuaguucuugauauguggaaggaggcuugaaccuagaagaccucugucguucauagagcaaguaucucccugugucccauguucccucucuccugccuguuuacauguagagaguauggcucuuucgccauguuagauuagauacuucuauuuaucaggaguuacucucuuguuaagaaaaaccaccacuuuuuuucacuucuuaguuugcauuuuucuuuuuuuucuuuucuuuuuuuuuugagacagagucucgcucugucacccaggcuggagagcaguggcgcugucucggcucacugcaagcuccgccucccagguucacgccauucuccuccugccucagccucccgaguagccgggacuacaggcgcccgccaccacgccuggcuaauuuuuuguauuuuuaguagagacgggguuucaccacguuagccaggauggucucaaucuccugaccucgugauccgcccaccucggcucccaaaacgcugggauuacaggcgugagccaccgcgcccggcccuuaguuugcauuuuucaaucauuauuguugacuauggguggauugugaacugaaacaagucaggauuuucauuucauagacaggcuguucaacacggugguuaaagcauaaauaucaauuagaacuuuguggggucuaaucccagccuugccacuccagaggguauggcauugggcaggguacuuagucuccuuaugcucaauuuccucauccauauaauggagauaagaauaguaccuaucucggaguuguaauuaagcuguuaguaaacagguuuuuuuugcucuuauaauugcuauuuuucagaaaaggaaaguauaauucgugaucucaccacugaacuacuuuuacugaaggauaccaacuucuacgaaccuauauauucuuucuuacaauagugguugacaguuggcucgcaauaugggucgacguuuugucuaaagucuugcucuuuuaucuacagggaguagauucugcuaucuuggccucacagcccuuccuguugauuacaaagcccguggaagaaaacagaacacacccuccucaguuccgucuaaauguguuucuucugcuucaauuacaccaguucuggggcaaagacacugaugaaacaacacccauaccugaaaagaauaaaugugugacuuucaaauccccuuucgcagugaaagaaacagcaaacacuuaagauucagcaucuguucuccaguugcacugaggaaugcacugucucgcagcaccagcucugcagagcccuugccccagacucuuugcgguuuuauuuauauguauuuccauauuucauuccugugugucacugcugcauugguguggcagcaagugaccaaaugcuacaggucuuacuauggacaccaggucaggugcaaccacacaaaacaaagccaguuccaugagcugccuaugauaugcauugcggaaguaacauuuuacccagggugugccauugcagugauauaaauauauuuuuuucuuagacuaaauaugagcugacuaucucuuuugauguguguacauaggugugagugugucuguaugcgugccugucugugugcggguguguguaugugcguagccucaugcuuaggacuacccaugaauguuguggaaugcuacaccuggagaguucugguuuuccaccaguuucaagaugaagaacuacaugauacaguggaccuggagaccauccccuuggaaagacaacccagagauguucagcauccuguaucuacacgcauccuguaucuacacguguauuuuguagcugucacacuaaccuuaauaagaauucuacagcuuuggacagaggcauuuucaccuuaauggugaaguaauuuaaaauauaaauccauucaggugacaacccaucaucaaaauuacaaauuuucugauugaacucaucugaaucaucaguuccuugauggagagagagaaggagauggaaugugucugguaaccccaaauggaguacaaguagccuuuguuuuccugcauaaauggacuuguugaaugcgaacgaauauaugcaauucauauacuuuuggagaugaacguagauaugugugucagcuuugagaugguguguccuggauuaauacuuugucucccaauaucacagaaaaauacaugccagugacucuugagguuaagguaguugggaugaaauggccucaggcaauuucacauucccuaauuaccuggaaaguucuacaguaauuaauaugcagcuaacuccuguugcccucacaagagcaucagccuucuagaaucggagcuccggagugugaagauucaguauugauaugauauguauaccaaacuccagccaacuuacugccauuuuucauaaucugaguggcugccuugcuuauccuaagcugugguugcagaaaccguggccauuuauauaagcuauaacaucaaaucagggaaaaaugaggaaaaaaaauagauucugaaccauuuauuguugaauaaguagagaaaaucaucaauaaauauuuauuacauucugacaggguguguggcauuguguucuaugccagagugacaaaguugauucaccccuuuuuggggaccuuaauauauuuuuuaagggaugugccuaugcauugaugccugaaaaauauguauaaagaaaugagguugacucuucugagcaguucaucuuuuccagagguaaggguaggaggccaacuucagggucugggucugagcccgugggcaagcccuggccgagugagcuccaaugcuaacucaugugccgaucucuagagcagugggaaacuaccccgcugcaccaaaucaaguagcuucaccuuguguaugcaggccccaaguuauuuuuuagcaaucuuacgagugaaauguucugguggguugaaaaacguucuuauuuuaaagaaagguugugcucgcuacacugcuggugugugcauucugagaccucuuguauucaaucugugaaggauauguguauuaauccguacacccguauagccucaauauuugucugaagacacuuaaauucugacccauaaaggaaaguucuagaagcaauauuuucacuuauuuaacauucuccaaacaacaucaagcauugauacacacugaagagugcguuuauuuuuuguaucacucuaaguauguuggaauaugcaaggacugugguucaaauuagaauguauaaggcauauuauaauuuaguucauacugaauaagaaauuaacagaacauuguucgguucacacguuccaaacuuugagugauuucuggaguuagacauagauuuucuauuuuguuuuaauuugucaagguauuuuucuucccuucaugaacuuuagguacacauaacuuaugucauuuauuuauggucuuuuauaccuaguuuguaaaauuguaaaauagcaaacuaaaugcaaagaguuugcauuugaaaauaauaaaguaguugccguauacaacccugcaaucugguugucucuuucaauaacuuuu

SEQ ID NO: 12764 - RNA, 3599 nt, Homo sapiens
cuuuucacagcugcaaaguucagggaguugaacugcagugcuuucaguucacugcucacucugccacgaucaaucucuguuguaaauuuuccucccagagcacgugacgaugcacuucuugacuauauaucccaacugcagcagcggaguugucagagcgcagagccggacagagcagaagaacccucuuggacuggacgauuugggaauucaaaacuugggacaaacugucagccuugguaagucagcaaggcuacacuuugcuuucagaaacauuugaaagagggacauuuuugccaauuaauagaugaauuuuuuuccuuuauuuucuuccugcuuuucuuuguucuaaggaaacauuguuuugaauuuaaaauaguuugguuuuggaaacacaauguaaacuuuguuucugcucaguuaaaauacguuucccaguuuuaaagauacuauuuacuguaugcuccugucuuacauugauuuuuuuuuuaaucaaaguaauacugcucacuacaaacaggacaaauguguacacuaaaaaaaaaaaaaaaaguccuucuuacuuuucccagugaaccuucccgggcuucucucccgugcacuccaagcccucauagcucacucuugucagcuguuuggcgaacccucuuaugcuauuucuuucaugcacuuuuaagcuuuuuugguauugcaguuccacaaaccucgugcucccccaccucccugugcccaggaccugggggagaguucuaaccugcggcuuuuuccccagccccugcuguggaggcagccucaaugcugaaaauggagccucugaacagcacgcaccccggcaccgccgccuccagcagcccccuggagucccgugcggccggcggcggcagcggcaauggcaacgaguacuucuacauucugguugucauguccuucuacggcauuuucuugaucggaaucaugcugggcuacaugaaauccaagaggcgggagaagaaguccagccuccugcugcuguacaaagacgaggagcggcucuggggggaggccaugaagccgcugccuguggugucgggccugaggucggugcaggugccccugaugcugaacaugcugcaggagagcguggcgcccgcgcuguccugcacccucuguuccauggaaggggacagcgugagcuccgaguccuccuccccggacgugcaccucaccauucaggaggagggggcagacgaugagcuggaggagaccucggagacgccccucaacgagagcagcgaaggguccucggagaacauccaucagaauuccuagcacccccgggaccccugccgguggcuccaucagccagcaaccuuagagagaggaaagacaguuuucaagugucugguuucacuuucacagugcggcugccacuuugaagagacccuugguaaaccccugauucgggguggggugggggacuaggcucagccggaaccagcaccuccaaggaguccgggaggugccugugguuugcacccaccacugaaaaagccgcggagaugcgcagcgcguacacugacuuuggggccuggguguugggguucugaucagaauuuggcgggaugauauguuugccauuuucucacuggaugcccuggguagcuccugcagggucugccuguucccagggcugccgaaugcuuaggacacgcugagagacuaguugugauuugcuauuuugccuagagcuuuguccuucuagaucugauuggcuguaaguaucucuacuguguaccuguggcauuccuucacaguggguuacaagcuucuuuuggauuagagggggauuuuugaugggagaaagcuggagaucugaacccagcccauuugcacacuauaagaaaaaaaaguaacuuuuaaaccuguuaacauuggccgggguuauaagagaugaucuucuauuuugaccuuuugucuaacuuaugaccuugaacucugaccugugaccaugcagcaucacaugauggcaugacguucuuuggaucagaagagcuuccccagaaucuaaccugcacucccgauggugguucaggagacucuuccugaucuuucuagaagggguaaagugggguugaacaaggccaagccguuagcucugcugcugcucaguuucccagccuaguuuucugagcugggagaggacauaaugugguauuucgucacguagcugagaccuagaagggcauacucaggcggagauugcacaaagcugggcuccaaguucugugcuuccugaucccgagcccugacacucauuugcuguguggucccgggcaugucaucaagaagcucgcugucugcaugaggcucccgacgaucuccauccccaggggguugggaggaugucuuuagauuuuaggacucugugauaaauauuccacagccuggugugaggaagcuuggaccaaaugcuuccccuuuggccgguuagucugaacaaggaucugcugauuuaaaggagcaguuggagauucagaacacauauaacuggggaauucagggcaagcuaccaacccagcccugcuguaguuuucccaggacugaaggaaagaggcagacaccacauucuccucugcaaaguucucuggagaaugugugauguuaacacucccagcuaagggaaagcaaagucuaaaggaaaacacacaggaaugcuuccaaugucuccaaguauuccuguggucaacaguuucgcagauccguuaggcccuuaaagacaaggaggaaguaaaaggucaaauuuaaaucuauuuaaaaaaacuuuuaaaaaaauuauuuauuuauuauuauuuuuuauuuuuaagacagaaucucgcucuguugcccaggcuggagugcaguggugcaaucuuggcucacugcaaccuccaccuccuggguuucagcgauucuccugccucagccuccugaguagcugggauuacaggcgccugccaccacgcccagcuaauuuuuugauuuuuaguagagaugggguuucgccauuuuggccaggcuggucucaaacuccuggccuuaaaugauccucccaccucggccucccaaagugcugggauuacaggcaugagccacugcacccggccacuuuuuuuuuuuuuaaagaaaaaugcucugcauggauuggagacacagcaauaacuacuguugccauggaaggguuaacaguguaggagcugguuuaucaguccgcuuugacauacagcuaaaggaaauuuauguuugggggaaaaaggcccucuguucacuuuaaaauucaguguggacuuaugccaaagggggcuguuuaaguugaaagaagccaaguuaaguuuggccucuugccuggaaucacuugaauucugaaauuucacugcgacggacaugugccuugucacauuuuccauugcuuaauccugaaguuuggugcaagucucucugcaccuauuaaaaagugauguauauacuuccuucuuauucuguugaguuguauagaauugucuuuuguauuuaacacuuuguaauuuucacaauauuuuuuaauuuaaauaaauaaacacauuuuuucccuccugggaagucau

SEQ ID NO: 12765 - RNA, 3599 nt, Homo sapiens
augacuucccaggagggaaaaaauguguuuauuuauuuaaauuaaaaaauauugugaaaauuacaaaguguuaaauacaaaagacaauucuauacaacucaacagaauaagaaggaaguauauacaucacuuuuuaauaggugcagagagacuugcaccaaacuucaggauuaagcaauggaaaaugugacaaggcacauguccgucgcagugaaauuucagaauucaagugauuccaggcaagaggccaaacuuaacuuggcuucuuucaacuuaaacagcccccuuuggcauaaguccacacugaauuuuaaagugaacagagggccuuuuucccccaaacauaaauuuccuuuagcuguaugucaaagcggacugauaaaccagcuccuacacuguuaacccuuccauggcaacaguaguuauugcugugucuccaauccaugcagagcauuuuucuuuaaaaaaaaaaaaaguggccgggugcaguggcucaugccuguaaucccagcacuuugggaggccgaggugggaggaucauuuaaggccaggaguuugagaccagccuggccaaaauggcgaaaccccaucucuacuaaaaaucaaaaaauuagcugggcgugguggcaggcgccuguaaucccagcuacucaggaggcugaggcaggagaaucgcugaaacccaggagguggagguugcagugagccaagauugcaccacugcacuccagccugggcaacagagcgagauucugucuuaaaaauaaaaaauaauaauaaauaaauaauuuuuuuaaaaguuuuuuuaaauagauuuaaauuugaccuuuuacuuccuccuugucuuuaagggccuaacggaucugcgaaacuguugaccacaggaauacuuggagacauuggaagcauuccuguguguuuuccuuuagacuuugcuuucccuuagcugggaguguuaacaucacacauucuccagagaacuuugcagaggagaauguggugucugccucuuuccuucaguccugggaaaacuacagcagggcuggguugguagcuugcccugaauuccccaguuauauguguucugaaucuccaacugcuccuuuaaaucagcagauccuuguucagacuaaccggccaaaggggaagcauuugguccaagcuuccucacaccaggcuguggaauauuuaucacagaguccuaaaaucuaaagacauccucccaacccccuggggauggagaucgucgggagccucaugcagacagcgagcuucuugaugacaugcccgggaccacacagcaaaugagugucagggcucgggaucaggaagcacagaacuuggagcccagcuuugugcaaucuccgccugaguaugcccuucuaggucucagcuacgugacgaaauaccacauuauguccucucccagcucagaaaacuaggcugggaaacugagcagcagcagagcuaacggcuuggccuuguucaaccccacuuuaccccuucuagaaagaucaggaagagucuccugaaccaccaucgggagugcagguuagauucuggggaagcucuucugauccaaagaacgucaugccaucaugugaugcugcauggucacaggucagaguucaaggucauaaguuagacaaaaggucaaaauagaagaucaucucuuauaaccccggccaauguuaacagguuuaaaaguuacuuuuuuuucuuauagugugcaaaugggcuggguucagaucuccagcuuucucccaucaaaaaucccccucuaauccaaaagaagcuuguaacccacugugaaggaaugccacagguacacaguagagauacuuacagccaaucagaucuagaaggacaaagcucuaggcaaaauagcaaaucacaacuagucucucagcguguccuaagcauucggcagcccugggaacaggcagacccugcaggagcuacccagggcauccagugagaaaauggcaaacauaucaucccgccaaauucugaucagaaccccaacacccaggccccaaagucaguguacgcgcugcgcaucuccgcggcuuuuucaguggugggugcaaaccacaggcaccucccggacuccuuggaggugcugguuccggcugagccuagucccccaccccaccccgaaucagggguuuaccaagggucucuucaaaguggcagccgcacugugaaagugaaaccagacacuugaaaacugucuuuccucucucuaagguugcuggcugauggagccaccggcaggggucccgggggugcuaggaauucugauggauguucuccgaggacccuucgcugcucucguugaggggcgucuccgaggucuccuccagcucaucgucugcccccuccuccugaauggugaggugcacguccggggaggaggacucggagcucacgcuguccccuuccauggaacagagggugcaggacagcgcgggcgccacgcucuccugcagcauguucagcaucaggggcaccugcaccgaccucaggcccgacaccacaggcagcggcuucauggccuccccccagagccgcuccucgucuuuguacagcagcaggaggcuggacuucuucucccgccucuuggauuucauguagcccagcaugauuccgaucaagaaaaugccguagaaggacaugacaaccagaauguagaaguacucguugccauugccgcugccgccgccggccgcacgggacuccagggggcugcuggaggcggcggugccggggugcgugcuguucagaggcuccauuuucagcauugaggcugccuccacagcaggggcuggggaaaaagccgcagguuagaacucucccccagguccugggcacagggaggugggggagcacgagguuuguggaacugcaauaccaaaaaagcuuaaaagugcaugaaagaaauagcauaagaggguucgccaaacagcugacaagagugagcuaugagggcuuggagugcacgggagagaagcccgggaagguucacugggaaaaguaagaaggacuuuuuuuuuuuuuuuuaguguacacauuuguccuguuuguagugagcaguauuacuuugauuaaaaaaaaaaucaauguaagacaggagcauacaguaaauaguaucuuuaaaacugggaaacguauuuuaacugagcagaaacaaaguuuacauuguguuuccaaaaccaaacuauuuuaaauucaaaacaauguuuccuuagaacaaagaaaagcaggaagaaaauaaaggaaaaaaauucaucuauuaauuggcaaaaaugucccucuuucaaauguuucugaaagcaaaguguagccuugcugacuuaccaaggcugacaguuugucccaaguuuugaauucccaaaucguccaguccaagaggguucuucugcucuguccggcucugcgcucugacaacuccgcugcugcaguugggauauauagucaagaagugcaucgucacgugcucugggaggaaaauuuacaacagagauugaucguggcagagugagcagugaacugaaagcacugcaguucaacucccugaacuuugcagcugugaaaag

SEQ ID NO: 12766 - RNA, 2831 nt, Homo sapiens
gagugacugaaauaaaaaauacaauugagucccaucaucaucaucauggaaauggcuuuaagagaaaacuggucagaugaauauuauugcuucccauuuucaaccaguaaauaguugccacugagaaacugacagccaggagucugucaagaaugcucaagauauguuauauaauacaacaugccuguucacagggggaaaaauccuaggaaauaacuuauguguacuucuugauuucaucauacaagacaagcacaaaagcaccacccaugccucugagaacauuggaccaugcacccuugaaaaaagcuuugccuccuucaucacgagcaaucuuccgccagcagucaagcgugccuguguacaugaugucagcugcaaagaauaaagacauggaguuagugacugaaggccgaugaaaaauccuaagauucacuaggcuaaauaaagcagagccccaccucuaagaacgucagcuuuaaauccaacauucacacauuagcaugggcaacacugaaauauuaaugcuaugaccacaggaauacagacuacccauuggucuuaaccucuaacaccauuuaagcacccucauucauaggcaucugaagggccagcucaaaggcaguuguggaacagacacagaugcuaucaaccccaucccuugacuuggacagacagccauuuuaaagguauguaucaccaguuuguggcagcagauugccccacgacuacaacuuuaucuucugcucaaguggaacuuacuuccuuugcgcccugacugcaucaucaugcggcggcgaacagugucaaauggauaggaagucaacccggcaacagcagugacagucugugcgaucauccagcugaugacgaugugaguguucuugggauccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauaccgaaguaggcggcucgguagaugauaauacccugcacagacacguuaaagccuugguacaggcccuuaaucccaucagauuuguagaucuuaaccaggcagucaccgaggccucggaauucccuuucagcuccagcuuuacccacaucagcugcuagacggguacgggcaaaaucaagaggguacacaaaacacagggauguggccccugcggcaccacccgaugccagauucccugcaaaguagagccaaaacuggguucucuuguccacaccacccaggaagaucugcuuguauuuaucuuugaaggcgaaguuaagagccuggguggggaaguaucugaugacauuggccagguuaccgcgccagaaggacagaacucccugcuccuugggaauacggaccacgcagucuauaaugccuuuguauugcuuaucugcagugaucugcuugcuggcaugcugcaccuaacagacaggaaggaagccaacagggacaguuauaaccauggggaagggaaagagaagagcuuaugccaucucgaucaaugcccuuuaagguaggcuccccucucucaaaucuagucuucguauaucauacuggcuggacccucccaacccucugaggcugucacaggggaagaggugaucugcaccaguagcauuaagccuccaccccucugaguggagagggggcauccuccagcggacccgugaccuucagaccuaggagaaaggucauuaccucaaacccagguucagaggcauuagggcgagucccacauagggcgcggucaccuuggggaccgcagccuacgccucaagucuccugagcugcuuccgucucgcuccgcccccacuccgcucccagaggugacccgagcgccgccgccgccagcccuacacgcuagcccaggagcgcccucuagagccggcacuggagagcgcgcggcgcagggaggcaggcggagacgcggcggcagcggccgcggcugcgcgggggcggacguaaaaggcacacgcgcuucccggcgccggcuuccggcccggcgagguuugagcgcguccgcgggcugggaggccgcuggacccgggcgcauggccucccccgggcaguuaucuccuugccgcgaccuugaggucuucgguaagaacuggcguuccucuuucuaacgccggcuuucggccuucgcccuugacgcccaggcccggggaggccgucacucagaaacugcuccauccgaguccgccgccucggagaugccgagagccugguccugcccucugcccccggccccuuccuagacucacuacuucaggucacuaaaggcgccucccaccaguuugacuucuguucugccucugcgccccgcucuggccucuccuaagccgcuucccuggccaugucuuuagaguucgcuccccgccaccccucgggcgcccgccuucugugcgacccuuccccccacuuccugguugggcuccuggaucccaggacguaccugcagcagcagcuugacccgcucgaugggcgcuaccgccgucuuggagauggcugcggccacuccaccugccaggaaguccuuggcgaaggacacagcggcaucugucauguugaaagaggaggcagacugcugcaggacgggacugggccgggaaccggcuuugacuccggcgcugcggg

SEQ ID NO: 12767 - RNA, 3829 nt, Homo sapiens
aggucgacaaagaugcugaauuaguggcccaauggaacuauuguacucuaagucaggaaauauuaagacgaccaauaguugccugugaacuuggcagguaugguuuuuacacuuaaucaagaugaguuuguuaagugauuuugagaauuuugauguguaaaugcaguuuuccauucaucaagcguggauuaucccaagcaaauuugugaggcauaggcugucguucccugucucugaacauaguucuguacucuucuagucaguuugguuuauuuaauccaugguuugaaaacugaggggcugggcugagcgcaguggcucacaccuguaaucccaccacuuugggaggcugaggaggaagggucacuuaagucuaggaguucaagaccagucugggcaauguggugaaaccccaccucuacaaaaaaauuaaauuagccaggcaccugguggcuggcaugauccuguagucccagcuguucaggaggcugaggcaggaggauccugugagucugggagguugaagcuguaguaagcuauaauuccaccacugcaccccagccugugcaaaaaaaauagcaaacucaggggccaauagaagcuaaauuauaagcauaaacacaugaaggagccaugugaggaacaggagagaauggcagggaauggagaauacuggaggguccaugugcuguccaaagcgggagcugccacucaguuccagccaguuuuuacagcucaaugguguuggccuagugauuccacaccuucugguuuuaauuuuuuuaaaaaaagaagaaauacguacuuauacguuaaauuucccaauuaaaaaaagccuuguucagguuacauucagccuucugacugccaguuugccaccuuugauuuaaacuaauuucuggcuggacccauuggcucaugccugugaucccagcacuuugggaggcugagguggguggaucaccugaggucaggaguuugagaccagccuggccaauauggugaaacccugucucuacuaaaaauaugaaaauuagccaggcaugguggcaggcgccuguaaucccagcugcucgggaggcugaggcaggagaauugcuugaauccgggaggcggagguugcagugagcugagauugcaccauugcacuccagccggggugacaagagugaaacucucucucaaauaaauaaauaaauaauuuccuucuuuguaugcucuggaaauaguugaaacaggguuaaauuuacuuuuuaauaauucaggguauuucucuuaucaaauguaaacgacuuuuggauuguguucaguuuauucuuccuucuuugguuauuugaaagucgcuuguugacauaauauucuaauacuuacuauugcagacuuuauaacaaagaugccgucauugaauuucucuuggacaaaucugcagaaaaggcucuugggaaggcagcaucucacauuaaaagcauuaagguaacacgagugauucugaagugcugugagggucugaacaguggcugagguuuauuuuauagaauuuauacgccuuaaagacugaacucagaaauuugggauuccauucccacauggccaucuaauacagguaugaucuugagaggucacuuaaaucucaagccacgaguuccaccaugcauacuuccuacauuauaaaucuguuguaauuucaccuguguguugugcuuugaaaauuuugauguucucuauuaauguuaggaggcauuauuuuuguaauuaagauucaccuacuuggauuuuggauuuggaagauacuuuugugaauuagauaauuuuauggaucacuguuaaaucacguggcuaccaucuggugauuagagguucugauuggcaguuaaaguucuuucauaaaaguugaaaaaacaaguuuuuuuaauaagggaaauuucuugagaggacacaacuuuuuaaauauggucaguggggaaaaaaacuuggaaagguaaugaagaauuugagaaccaucaggcuagucaaacccuucaucucacuguaaaugacucacuugaggccccauggcuagcgaaguacuuaaaccagaaccagauccccuaacucccagucuaaggcucuagguuuugccuucuuuuucuuucuuucuuucguauuauuaggcuuuuuguucaaaugcuugggguugauuauaggauauguucauuucaggcaaauucauaauucugaaauguagcuaaugauagugcucuagaaauuauucugauuuuaguggucuuuuaccuuguggaagagaauuuauuccugaaaaaccugugguaguaugaaucaucuuacaucaaaaaugugauaaacgauucuuuaguaguucauaaugcuaugauuggguuuccaugugcacauguaagaugugccucucucaagccuuguugugacaucagcacauuacccaucugaugagaaaaaaaaacaguuauugaaauuaauucauacaguucuauacuuaaaauacuuguaauauucaguuuuaugugguugaauauuuaauggaaaaaaacuccaagaaauuagaacaguaaagaaaaaaagcauacaaauaaaacaaugcuaauacauaagauugucauuaccgucaauugauaguccacaaauacucggagcagagaacucagugagacgugcucauucucgaccaggaagcugaucguaugaauggugauuugccuuucaagacacucaccugcucucuagaguauugaagucaaaauggucucauuaaauaugaagaaaugccucgaaugcaaaaguagaguuacuguaucaaauuccuuauaaaguugggaauucuugaaaaccugaauagcugugucuuggagugugacaguauuuucuggcuaauauucugccuuagcucguuagaccguggccucagauuuuacugucuauucaaugauuuuauauauauauuuuuuuguuuuugcuuuuuucaacgauuaaauaaauguagauagucaguaacaugaagcagccucagagaggauucaucacagggagaaagcauucccuucuggguggaacucaugcagagcuuucuguuaguggaguaauuuuuuauguaagaggguacuuuuccuuaaguuaaaaagauguggauaguagaaauaacugauuuacuugcuagucagugaauugaaaaaaaucuuguuuucuguuuucuuuuuuuuuuuuuugagacggaguuuugcucuuguuguccaggcuggagugcaguggcacgaucucagcucacugcaaccuccuccucccggguucaagcgauucuccugccucagccucccgaguagcugggauuacaggcauguuccaccacacccagcuaauuuuguauuuuuaguagagacgggguuucuccauguuggucaggcuggucuugaacuccugaccucaggugauccgccugccucggccucccaaagugcugggauuacaggcaugagccaccacacccggccuuguuuucuguuuucuauauaugguuuaauauuauauccauguuucuuauggaccagaggaaaguaacugugagggagagguuuugaugggaagggcuggaauaacaauuuguugacuuacgugguuaaggcaaaggaugaucuguuuaucaaaugaauuguuaaaauauuaaugguuuuucccagaaugugacagagcugaagcuuucugauaauccugccugggaaggggauaaaggaaacacuaaaggugacaagcacgaugaccuccagcgggcgcguuucaucugccccguugugggccuggagaugaacggccgacacagguu

SEQ ID NO: 12768 - RNA, 633 nt, Homo sapiens
gcuauuguugccauugaaaacccugcugaugucaguguuauauccuccaggaauacuggccagagggcugugcugaaguuugcugcugccacuggagccacuccaauugcuggccgcuucacuccuggaaccuucacuaaccagauccaggcagccuucugggagccacggcuucuugugguuacugaccccagggcugaccaccagccucucacggaggcaucuuauguuaaccuaccuaccauugcgcuguguaacacagauucuccucugcgcuauguggacauugccaucccaugcaacaacaagggagcucacucaguggguuugaugugguggaugcuggcucgggaaguucugcgcaugcguggcaccauuucccgugaacacccaugggaggucaugccugaucuguacuucuacagagauccugaagagauugaaaaagaagagcaggcugcugcugagaaggcagugaccaaggaggaauuucagggugaauggacugcucccucuccugaguucacugcuacucagccugagguugcagacuggucugaagguguacaggugcccucugugccuauucagcaauucccuacugaagacuggagcgcucagccugccacggaa

SEQ ID NO: 12769 - RNA, 1480 nt, Homo sapiens
cauggguugcugugguuguggagguugugguggcugugguggcugcggugguggcuguggugguggcuguggcagaugcaccaccugcaggugcuaccgggugggcugcugcuccagcugcugccccugcugccguggcugcuguggaggcugcugcagcacucccgugaucugcugcugccgccgcaccugcagcucguguggcuacagcugugggaagggcuguugccagcagaagugcugcugccagaagcaaugcuguugcuaggagggaccccagccucugggcaggugcccuuucuugggcuuggauuuguagacuuuguauacuuucaucuccucugguucaccuaaauauugaguagugguggccaggcgccguggcucacgccuguaauuccagcguucuaggaggccgaggcagguggaucauuugagaucaggaguucgagaccagccuggacaacaugaugaaacccugucucuacuaaaaauacuaaaauuggccaggccugguggugaaugccuguagucccagcuacucuggaggcugaggcaggagaaucacuugaacccaggaagcggagguugcaaugagcugagaucucaccauugcacuccagccugggcaacaagagugaaacuccaucucaaagaaaaaaauacauauauauaauaaauauauauuuuauauauauauauauauauauauauauauagagagagagagagagagagagagagagagagagagagcaagagagagcagcaugugauuucauauaaauacaccugauuagaagucacaagcccaaauucaaguccaugcucugccacagcagucagccacaaacaagucagucagccucccagagucuugcuuauucaccuauaaacuaauaaguuugaacuaagaauuaguaaggagcuuuucaguuuuaacaacauguaaaucuauugagaucuauugaguucgcagaacuaaacucacaggcucuccagccucacgcucugaagauuucucuuauguaucuuaugcuuuuacauauauauaccuuugcuauagugggcauuaaaauuuguuaacacgaaaaaucaccuuuaaucucauaugauucaucaguuauaaucugcacugcaacaaaaacaggccguagcuuaccugaugaaaguucaaaaguuuacauucaugagcucaguggaaugaaauaacgauuacuaauauauuccauucuuucaaaacauuuacuaaauguggaaauucugugcuuauuuaccugcuuauauucguuguauacuauauauuggcuacagcuucuaguguucccuuaucuuccuaaauauaauuuaauaaaacacuagaaaaauauuguauuucacuguguuuguuuugauuuguuuuugucuuuuuugagggaggggugagagugaugaagcugauguuuggcaacacuuauugcaaacuuuaggaagguuguaa

SEQ ID NO: 12770 - RNA, 4206 nt, Homo sapiens
uguuaaguccaagagaaaagauaauucacugacaugaaacacccaaaugucuucauuuuaaaaguaguuuagagauagcaucagguaggccaaacaacuguacugggccccuguagagauuaggguuuggucuauuaaaaaaaaucuuugcuugcuggaacugcaagcuuggcuucccugcaagcucaauagguucuggagcucauuuaccaugucgcucgcuggaucccagaaaguugcccauggucagcuaagugacggaagacuauacgacuaagccuccagcgccgcuucacaccacgcggacgggacgucauaacacaccgauuucugauucuaacaggacagcuaucccgggggagggcagcaauuucuucaucagccacauccuaagggaaaucacauuauuacacagaucacauuacauuguugcacauguauuuugcuccuucucacuugcagguaauuuucuuuucuuuuuuuuuuuuuuuugagacagagucucgcucugucacccaggcuguggguguuagauugugcaaugucacaaucucagcucacugcaaccuccgccuccuggguucaagugauucuccugccucagccucccgaguagcugagauuacaggugugcacuaccacacucagcuaauuuuuuguauuauuaguagaaacgggguuucaccacguugcccaggcuggucucaaacuccugagcucuggcaauccgcccaucucugccucccaaagugcuaggauuacaggugugagccacagcgccuggccacuggcagguaauguucauugcaugaguaccauaauucauuuauccauccuacauuugauggucaucuuacgauuugggcgaauauaaauagugcagcuacauacucuuguuuaacucauuuguaaaguaugugaauguauuucuguugccgccucauguuuuuugaaucacgaaagugaaaccucuggaaugaugaucaaauaggagggaauguggcuugagauaagacuagagaaggaggaaggagaguaucacauggagcccugaugucuaugguaaagauucugacagcuagagaaguaaaggggagagaucagaugagguuuauauuuaaaaaaaaucauuugcaagguagaggaugaaucagguaagggcaaagugguugaggggagaaaaguagggauuacagcaguagcuagggcucagguuuugucaguagagauuucuucuuauguauguguucaagagugugaguguucauaauauucacuuuaaucugauaagugugcuaacaaguagauggacccugugcuagacugcggugcaagcaaaauaacacauuaaaauaacacaaauuaaaugaaaguauauaaaagccaaaaauuaacaaaagcuuaugcauguguuaccauuaugaacuaacagaauuacauaaaacaacaugauugccaggcacaguggcucacgccuauaaucccagcacuuugggacgccgaggcaggcggaucaucugaggucaagaguucgcgaccagccugaccaacauagggaaaccccaucucuacuaaaaauacaaaauuagcugggugugguggcacaugccuguaaucccaucuggccgggaggcuaaggcagcagaaucgcuugaacccaggaggcagauguggugagcccagauugugccacugcacuccagccugggcaacaagagcaaaaccccaucucaaaaaaaaaaaaacaaaaaaaaaccaugauugagccauugaguaguaaacaauaaaugcuauacaaggaacuggagaggagaaaugacugggcaagaagauugaagccaaguuucauggagguggaccuuaaagaauggcuagaaauuauggauugauugauugauacauaccccuuccuucuuguuccccgaaagauuuaaggcaguuuacaaaugaggaaacuggggcaaagagaaaugagaguaggaaagauaaaagccucaggacacaaaagugcaugcugugaaauuagaacugggacauaaauuugacuuguaagcuacuuggcaggcagcagagaaccaugaucaguuuacaugauucacagacucugcacaguuauugcugcuagucauaccagagacaugucuucuggguaucuucauaaagguacucaaacaacacacccccagcuguauuaauguauaguugacaaauaaaaauugcauauauuuaaggcauacaaugucaugauuugcuaaacauauacauugugaaaugauuaccacaaugaaguuaaugaaugcauccuucaccucacaaaauuaccguuuguguaugugugguaagaacacuucagaucuacucucuuaccaauuucaaguacacaauacaguacuauugacuauaguuacgguguugugcguuagcuccacagaauuuauucaucuuacaacaggaaguauacccuuugaccaguaucuccugauuucccccugcccgccauacccccuaguccuccuagcuccaagcaaccaucauccugcuucccugccucuaugaucaaugucuugagcucaguuucuugggggcccccugcccuuuuuuuuuuguuuugagacacagucuugcucugucaccuaggcuggagcguacuggcgugaucucgguucacuguaaccucugccucccgaguucaagcaauucuccugccucagccucccgaguagcugggauuacagggugugccacuugcacccaucuaaguuuuguauuuuuaguagagaugggguuuggccagguuggucuugaacuccugaccucaggugaucugccugccucggccucccaaagugcugggauuacaggcgugagccacugugccuggccugccacuucuuauuacucccuaaauguaggaaaguagcuuaaugccacuuuaguguaagccauaacccagugguccaaggcucucaguuuucugcucaucuggcuuaauccagacaagacuaaaaagaaaccauaguaauaaauaggauguauaucauucugccaacuucucuaaauguaguuuuuuaaaaaucugaguucucaauaacuugagaggccuugaguuuaauuuauaucucccugaugagccuuuugaacgcagauaugcuacaucaccacuuaggugcaggacuuuaugcuucagaaagccaagcagggugacaaggaaguaagccuuaauggaaaggcacuucagcacacagagggugggcaagggaguucaggaagacaggcucagaauggugcuagguaaggaacaguuuaggccgcguaccaggcacacagacuucaacaucagcaaugccucccaaugccuugccaguuaaaagauugggaugcggcuggacacaguggcucacaccuguaaucccagcacuuugggaggcccagauggguggaucacaagaucaggaguucgagaccagcccagccaacauggugaaacccugucucuacuaaaaauacaaaaauuagccaggcaugguggcaugugccuguaaucccaguuacucaggagacugaggcaggagaauugcuuuaaccugggaggcggagguuguggugagccgagacugagccauugcacuccagccuggggaacagagcgagacuccaucucaaaaaaaaaaaaauugggaugaagucagggagagaccuuaggugaaaauaaccacccaauuuaccaguacuuucuaaggcuggcauaaugaaacaguuguaaggcuaguuaggagugaauagucuuuaauuugaaacucaacaaaaucaguuucaagacuauuuguuuauauugauguggaucuuauucuccagaaauuauauugauaccaagucacaacaaacaguaucaaaagugaucugauguugaguuaaugaucuugugguacaaagggacucaucuuaauuagcuaaccugaagaauuuuuggcaaaaugguauucuuccugagugaauuaauacguagccucucaucugcguauucauaggccauuuuucgucucuucacaucgcgccacauucuccagucuacauagugacuucgaacuuggccugaagcugaugaaggaaccaucugaaagacagagacaagggacaagugaaggauagccaggacaacauucugaguguuccucaacccugcaauucucuuucugccacuauuua

SEQ ID NO: 12771 - RNA, 4206 nt, Homo sapiens
uaaauaguggcagaaagagaauugcaggguugaggaacacucagaauguuguccuggcuauccuucacuugucccuugucucugucuuucagaugguuccuucaucagcuucaggccaaguucgaagucacuauguagacuggagaauguggcgcgaugugaagagacgaaaaauggccuaugaauacgcagaugagaggcuacguauuaauucacucaggaagaauaccauuuugccaaaaauucuucagguuagcuaauuaagaugagucccuuuguaccacaagaucauuaacucaacaucagaucacuuuugauacuguuuguugugacuugguaucaauauaauuucuggagaauaagauccacaucaauauaaacaaauagucuugaaacugauuuuguugaguuucaaauuaaagacuauucacuccuaacuagccuuacaacuguuucauuaugccagccuuagaaaguacugguaaauugggugguuauuuucaccuaaggucucucccugacuucaucccaauuuuuuuuuuuuugagauggagucucgcucuguuccccaggcuggagugcaauggcucagucucggcucaccacaaccuccgccucccagguuaaagcaauucuccugccucagucuccugaguaacugggauuacaggcacaugccaccaugccuggcuaauuuuuguauuuuuaguagagacaggguuucaccauguuggcugggcuggucucgaacuccugaucuugugauccacccaucugggccucccaaagugcugggauuacaggugugagccacuguguccagccgcaucccaaucuuuuaacuggcaaggcauugggaggcauugcugauguugaagucugugugccugguacgcggccuaaacuguuccuuaccuagcaccauucugagccugucuuccugaacucccuugcccacccucugugugcugaagugccuuuccauuaaggcuuacuuccuugucacccugcuuggcuuucugaagcauaaaguccugcaccuaaguggugauguagcauaucugcguucaaaaggcucaucagggagauauaaauuaaacucaaggccucucaaguuauugagaacucagauuuuuaaaaaacuacauuuagagaaguuggcagaaugauauacauccuauuuauuacuaugguuucuuuuuagucuugucuggauuaagccagaugagcagaaaacugagagccuuggaccacuggguuauggcuuacacuaaaguggcauuaagcuacuuuccuacauuuagggaguaauaagaaguggcaggccaggcacaguggcucacgccuguaaucccagcacuuugggaggccgaggcaggcagaucaccugaggucaggaguucaagaccaaccuggccaaaccccaucucuacuaaaaauacaaaacuuagaugggugcaaguggcacacccuguaaucccagcuacucgggaggcugaggcaggagaauugcuugaacucgggaggcagagguuacagugaaccgagaucacgccaguacgcuccagccuaggugacagagcaagacugugucucaaaacaaaaaaaaaagggcagggggcccccaagaaacugagcucaagacauugaucauagaggcagggaagcaggaugaugguugcuuggagcuaggaggacuaggggguauggcgggcagggggaaaucaggagauacuggucaaaggguauacuuccuguuguaagaugaauaaauucuguggagcuaacgcacaacaccguaacuauagucaauaguacuguauuguguacuugaaauugguaagagaguagaucugaaguguucuuaccacacauacacaaacgguaauuuugugaggugaaggaugcauucauuaacuucauugugguaaucauuucacaauguauauguuuagcaaaucaugacauuguaugccuuaaauauaugcaauuuuuauuugucaacuauacauuaauacagcuggggguguguuguuugaguaccuuuaugaagauacccagaagacaugucucugguaugacuagcagcaauaacugugcagagucugugaaucauguaaacugaucaugguucucugcugccugccaaguagcuuacaagucaaauuuaugucccaguucuaauuucacagcaugcacuuuuguguccugaggcuuuuaucuuuccuacucucauuucucuuugccccaguuuccucauuuguaaacugccuuaaaucuuucggggaacaagaaggaagggguauguaucaaucaaucaauccauaauuucuagccauucuuuaagguccaccuccaugaaacuuggcuucaaucuucuugcccagucauuucuccucuccaguuccuuguauagcauuuauuguuuacuacucaauggcucaaucaugguuuuuuuuuguuuuuuuuuuuuugagaugggguuuugcucuuguugcccaggcuggagugcaguggcacaaucugggcucaccacaucugccuccuggguucaagcgauucugcugccuuagccucccggccagaugggauuacaggcaugugccaccacacccagcuaauuuuguauuuuuaguagagaugggguuucccuauguuggucaggcuggucgcgaacucuugaccucagaugauccgccugccucggcgucccaaagugcugggauuauaggcgugagccacugugccuggcaaucauguuguuuuauguaauucuguuaguucauaaugguaacacaugcauaagcuuuuguuaauuuuuggcuuuuauauacuuucauuuaauuuguguuauuuuaauguguuauuuugcuugcaccgcagucuagcacaggguccaucuacuuguuagcacacuuaucagauuaaagugaauauuaugaacacucacacucuugaacacauacauaagaagaaaucucuacugacaaaaccugagcccuagcuacugcuguaaucccuacuuuucuccccucaaccacuuugcccuuaccugauucauccucuaccuugcaaaugauuuuuuuuaaauauaaaccucaucugaucucuccccuuuacuucucuagcugucagaaucuuuaccauagacaucagggcuccaugugauacucuccuuccuccuucucuagucuuaucucaagccacauucccuccuauuugaucaucauuccagagguuucacuuucgugauucaaaaaacaugaggcggcaacagaaauacauucacauacuuuacaaaugaguuaaacaagaguauguagcugcacuauuuauauucgcccaaaucguaagaugaccaucaaauguaggauggauaaaugaauuaugguacucaugcaaugaacauuaccugccaguggccaggcgcuguggcucacaccuguaauccuagcacuuugggaggcagagaugggcggauugccagagcucaggaguuugagaccagccugggcaacguggugaaaccccguuucuacuaauaauacaaaaaauuagcugagugugguagugcacaccuguaaucucagcuacucgggaggcugaggcaggagaaucacuugaacccaggaggcggagguugcagugagcugagauugugacauugcacaaucuaacacccacagccugggugacagagcgagacucugucucaaaaaaaaaaaaaaaagaaaagaaaauuaccugcaagugagaaggagcaaaauacaugugcaacaauguaaugugaucuguguaauaaugugauuucccuuaggauguggcugaugaagaaauugcugcccucccccgggauagcuguccuguuagaaucagaaaucgguguguuaugacgucccguccgcguggugugaagcggcgcuggaggcuuagucguauagucuuccgucacuuagcugaccaugggcaacuuucugggauccagcgagcgacaugguaaaugagcuccagaaccuauugagcuugcagggaagccaagcuugcaguuccagcaagcaaagauuuuuuuuaauagaccaaacccuaaucucuacaggggcccaguacaguuguuuggccuaccugaugcuaucucuaaacuacuuuuaaaaugaagacauuuggguguuucaugucagugaauuaucuuuucucuuggacuuaaca

SEQ ID NO: 12772 - RNA, 859 nt, Homo sapiens
caucagaccuccucaccucuccugaguccuccucacuucaccugaguccucucuacugacaccauggguugcugugguuguggagguugugguggcugcgguggccgcugugguggcugcggugguggcuguggugguggcuguggugguggcugcggugguggcuguggugguggcuguggugguggcugcggugguggcugcggugguggcuguggugguagcuguggcagcugcaccaccugcaggugcuaccgggugggcugcugcuccagcugcugccccugcugccguggcugcuguggaggcugcugcagcacucccgugaucuguugcugccgccgcaccugccacucauguggcuguggcugugggaagggcuguugccagcagaaaugcugcugccagaagcaaugcugcugcuagguggccggccugguuccaccccugcccaggagcugugggaacccucacugucuccugcuggcaaggcucugcuuaaccccauucugucuaauccuuuuucuaaccuaucugucaccagcagauccccuuggcuucugccucaugugccuugugcuuuguccuucugggaucuuccuuugcccacacacggcaccaacuugcccagaccacacaaugugaaacaaacgggcaaccgagcagccggugauaaccagauaaagucagagccaaccaggaaacuuaguacuuuauuauuuuguaauguucaaucuuuccuaaauagucaguccuggauuucaccauuuuucuguucacugucugugugcaaucuuuuccauugcuuuugucuauauuugcucuuuaaaauuucccaguaaaaugacuugguauguca

SEQ ID NO: 12773 - RNA, 652 nt, Homo sapiens
cuugaaugacauuguaccaguugcccaugugacuaccuuaauaauaggaagaauuacuuaaacuacagagaugagaaccaagcagaaaagugccaugaagucugggugacagggagacagcagggagcacacgggaugggauggaggaaagccacagcaaggggagcaagcugccucccugcggcaccugcagacccgcagucuuaccaacagcaugaguggcuacagccccugcccagaggcuggguucccaccuagcagcagcauugcuucuggcagcagcacuucugcugacagcaucccuucugcuggcaacagcccuucccauagccacagccacacgagcugcaggugcggcggcagcagcagaucacgggagugcugcagcagccuccacagcagccacggcagcaggggcagcagcuggagcagcagcccacccgguagcaccugcagguggugcagcugccacagccaccaccgcagccaccaccgccgcagccaccaccgcagccaccaccacagccaccacugcagccaccacagccaccaccgcagccaccacacccacagcaacccauggugucaguagagaggacugaggagaagcgaggauagagggcucaggagagaugaagaggucugaugccgc

SEQ ID NO: 12774 - RNA, 1231 nt, Homo sapiens
cauuuuauuaugaaauuuuucaugaagaaugguugauuaaugaguacaaaaauacaguuaaaagaacaauaccuagugcucaauaaaucaguagagugacuauaguaaacaauaaacuauuacccauuucaaaacaguuaauagagaauaauuugaauguucccagcauaaaagaaaaagauuuaaggugauuaauaucccaauuacccugauuugauuauuacacauuauguaaauuuauuaaaauaucacauguaucccccccaaauaucuacaucuauuauguaucaauuuuuuuaaguaaaaaaauauagauggguuacuaccaaagggaaaaaagauuuuuuggugauauaaucaaaauuauagcacuaaaaugaagaccaugaauuaguaaaacaaaaaaagaaaauuuuaggagaacaccuagaaaagacucuauggcccagaaaagacagagcauauguggaacacacaagaagaccuaaugccuagagagaaaagaguucaaagaagaaagcauggucaaaaucaugauccugcuuugcugagcucaaaacucaaaauguccugcaucuuugugcuugaaugacauuguaccaguugcccaugugacuaccuuaauaauaggaagaauuacuuaaacuacagagaugagaaccaagcagaaaagugccaugaagucugggugacagggagacagcagggagcacacgggaugggauggaggaaagccacagcaaggggagcaagcugccucccugcggcaccugcagacccgcagucuuaccaacagcaugaguggcuacagccccugcccagaggcuggguucccaccuagcagcagcauugcuucuggcagcagcacuucugcugacagcaucccuucugcuggcaacagcccuucccauagccacagccacacgagcugcaggugcggcggcagcagcagaucacgggagugcugcagcagccuccacagcagccacggcagcaggggcagcagcuggagcagcagcccacccgguagcaccugcagguggugcagcugccacagccaccaccgcagccaccaccgccgcagccaccaccgcagccaccaccacagccaccacugcagccaccacagccaccaccgcagccaccacacccacagcaacccauggugucaguagagaggacugaggagaagcgaggauagagggcucaggagagaugaagaggucugaug

SEQ ID NO: 12775 - RNA, 1808 nt, Homo sapiens
aaggugucucacuaccaaguaaauguugagaacaaguacaagaguggaaaaugauagaaagagaguguuaagaccagaaagaagagaagucagcauuugcuggguagcuacuaugugcaauuuauucacaauauaacauaugacugccuacuaugcuccaggcauuacacaaaguucugaggauacacaggcuaauuaaaugcaaaaagaauacuuagaguucguacaaagcaguagacugugcuaugagagccgguaaugaggguccuaggugagaggggaaaggaagaccccagaggaugugauauccaagacaaggccugaugauaaacaggacuggccagguaaggaggggaagagagauccaggcagagaaaagagcaugugugaagaugacucacaggcaaaacuacugcucugggugcuucacauacagauccucagugaucaucaauccagaccaacucuuuucuuuccuuugugguuguuauuccuuccaauuuauuuagauuuuauuguuuagugaaaaugggccucuaguaaaguguccagucacaggugaaggccaauaucagcccaagcagaguuuuacaaugggaacagagccuaauuauuugaaaaggaggcuccuaagaugaggagcaggugguacuaagccugccaauguccucagucucuuggugacaucaagucaaagcaaaugccugaguaaaggcccuuugccagcagcaaguauuuucugagagccacccacaucagaaggcccagagcagaaggaggaagagaaugaacaagucugaguguuccacuggaaggcugggccucacaaagacagccuucugucagcauggugacagucuucuguguggaugggggagggagagaggucccaaugugccacccaugggauccagcagaaacugggcucugaaguauugcuggucuguaguggacuuucauccaaggaguucuuuggucuucacugccagaugccuguacaguucugccacugugucaucggccauuuggcugaucuguuucucuguuagccuaauggugcccuccgagacuguauccuuggauuucuucagcuuguucauugcguugguacaaaccuuccguaaagaguauguggccuuguugguguucuguuuggccaguuucaccagcauuucucugugcucucugauuacuuggggaauggguacccgaauuagugucccuuccacuucuggguucagauucauuccacuuucucuuauagccuugauagcugcaacugugaacucugggaagcuggccauauucaccaaaaucagcuguggcaacuucacggagaucugccuaaucugguuuaaagcaaguuuuccaucagcgguuaccacagcaaucuugucaagggauccuggugaggucccuauauugagagucuuauugaaauuauccuugcgugcuucuaucacagacuucauuucuucauucaccucuuccaaguugauuauauccucaacaaaggcagcacuaauauucacucugguuugggacuuuccuuucccuuuggcuuuggcuuucuugguagcaaaaugguggacugguacagcugaauaggccacguauugccuauggccauguugucuuucauacacuuucuucaguguaacuucugaaacgggucugauagaggcugcaagauaauugcgaaaggcaggguggaccaugcgggagcacuuuaaucccaaggccaugacugaagacaauccuuggaaacauccacagcuaucgcccagguuacuaaggaaagacuugug

SEQ ID NO: 12776 - RNA, 256 nt, Homo sapiens
gacuuccugcagcucucuacacagugaaucacagugagacacuggcagcaggcaccacggaagggacccucaaaucugaaggcucaagguccugggaaaagaugaaguggagcaugccucuuguuuccuccuauuagaugcugaguguuggaaguucuuccuaggauucacaaagaaacuccugcucuucuuccacauacuuuuuccugggaaagaaaacuuguuucacuggcagaaaagauccccacuguuaaag

SEQ ID NO: 12777 - RNA, 256 nt, Homo sapiens
cuuuaacaguggggaucuuuucugccagugaaacaaguuuucuuucccaggaaaaaguauguggaagaagagcaggaguuucuuugugaauccuaggaagaacuuccaacacucagcaucuaauaggaggaaacaagaggcaugcuccacuucaucuuuucccaggaccuugagccuucagauuugagggucccuuccguggugccugcugccagugucucacugugauucacuguguagagagcugcaggaaguc

SEQ ID NO: 12778 - RNA, 714 nt, Homo sapiens
uuuuuuuuuuuugcaagcagauaaaggcuuauuuuacuuuaauggcugaucuauguaaucacggaggccaguauguacacacaaaggggcagcuuuuauuucuuggucucuuccuccuuggacaaagucuugaugaucuccuccuucuuggccuggaggugcucuucauagcucuugugugcuuccuuggucuuagaucugcgggccucagccugaucagccaggagcuucuugcgggccuugucugccuucagcuuguggauguguuccaugagaaucugcuuguuuuuuaacacauuccucuucaccuucagguacaggcugugauacaugcggcgaucaaucuucuuagauucacgguaucuucugagcagccggugcagaauccucauucuccucauccacgugaccuucucuggcauucgggcauuggcuguacccuuccgcuuaccuaugcccauaugccugcccuuccggcaggccaagguguuuuuccggcaucaagcgggggaauggaccaucacaggcuugcggaugaucagcccaucuuugaucagcuuccggaucugcugacgggaguuggcauuggugauuucauuggucucauuggggucuaaccagauauucuucuugccacagcagaggacacuagaggcaagccucuucugaagccugagcauacucaaggcugcagccacagcagcgaaaggaaag

SEQ ID NO: 12779 - RNA, 108233 nt, Homo sapiens
caaagccgggcucgggccgcaagcggggcgagggguucggggagcggcgcggccugggagacacagagccuucaggcgccggggcgggggcacaggcgaagacuaaggcggcgccgggccccacagcagcagccgcagcccaagcgagcgcagcagcgcggcggcagccgcgggagccccugggcagccguccgcccgcgcagccgccgccgccgcgggagcccgucgccgggagcaggagcgggcggaagacaacggaggggccgagcguccgagccacuccgcggggaccgaacgagcagcccgaagcggcggcggccgaggacggggacagcgacgacgcggaggcagagaagggaacgcccggcccagccccgugagugacccccggccggcccugcucguggugcggacgccugcccggcuuccgccugccccgcugggcccucaccggccccggggcugccuccauuuuccuggguggcggcggccccggcccagcuuguccccggagcccccgggagcagccgggcccagccugcccucuccgcccggcucggcuccggucccucgcugagacgcucccuuugccuucgccggcguggggcgcccgggggccugcaguccaggcgcuccugccucuccccccgugguucucuggcggggcuggcggcgcguggugguccgggccggagucgggcgggcggggaagugcgggccgggucaacugucaccggcugcacccgggcuucagcgccucgcucccgccccugguaaacuuccuguugucgggaggcagauaccagcuuugugaccaauucaggaaaaugccuaacugauuucugguuaggaauugggcggucggagcguucuggaguucaauggaaccaccccaagcgcagacugcgugcaggcgccguagucggcccgcaccggagggauucaaaggugaagcgggccccgguccccucccccgaggagcuuaggcucuggugugagagauaagacgagaacacaaauaacugcgauaccgggaaggaggugauaaguccugugaaagaacgacggagugcuagaacggcacccggaaaaaccgaaccgaucacuucugccucgcagaaaccuggaaggcuuccugggcgggggaugcugagcagagucuugaaggccugaugggauuuaggagaggaggauugcagaagagguguguggaagggguagcaaaagcgagaagacaaagccuagaaaucauggauaauuccguuuguuggcauggugcagggggcgggggguauugggcuaaagagguauuuuggggccagauccuugaaugcuguagaggagcuauuugagcagcauucuaagagaaacuuagagcucauuucucagugacucaugagcccggaaauguaggcuaggggauauuaaaggcgcucuugugaaaggagagaggaggaggcccagucaggaguugacauucugugccuugaauguaaugcaguuucagaucgauuuugacagcuucccagauaaucaaguaaauccaugcccaggcuaagcaaaguaccuuugcagaaagcuucauuagauaucaggcucuuaagagguaauggaaaggugucuauaaaauaagcucaucugcacacagaagguguuucuauuugugcguucgcuacagugcauaaaaacuucuugcacuuuguauuaggcguauguacuuuggaauuacuaagcuaaaccuacauucuuugagguggcauuuguguaaaauaacauaaauugaugauuuuuaaaaaaugguuaguaauauucugcuguagaaagccagacguagaccuuuuacagaaagguaaaacuuuguuuuuauauuuuauuuuauuaugaaaucuuuauaguagagccagaagugaaaguguuuagcuuuauuuuguaguuuguucaaauuguuaggaaguaauuagcagcuguauucgaaaucuagaauauacgaucugugaaagcagcuuagggccuaaguuuuguaagcuugcacuuguuugcguguaugacaagugaaugccaccuuuuugcaguuuaaaaauuuucugcuuuucaaaauaauacaugaucuuugucaaagcuuccaaaauucagggagugcuagaaaaucuuuaaaacauuuucuauaaucuuaccacuuagauuugguuacugcuaacauuuuugcguauuuucuuuccagucuuuuucuguguauuuuuucuuugcauaaugaaauauauuguaugcauauguauacacacacacaucucuuauuaagcuuuucuugucauuaaauaucuucauauaaaaaauuuuuacucaacaauggaagucuucuaagcauguuauguuuuccugacaagguuguauuauuuaccucagaugaaaugcaguaguuaggcuuaauaacuacuaguguggacagaacuuuuucugaaaguuucuuguuugaaguauguuucuuucucuguaagacuuggauccucuugcuuguugaauaaaguuuuucuuggcaggauguguguugucaugagguguggaagaggaagaaagcacacagaucucugcuauaggagugaauggacuuuuaaagggauguugucaaaagauuacugucauggcugguauaccaucccccacagacggcgaugcagugucccuucccacuccccacuucgcuccugaaaaauagucucuacacuagggccauccauauagguuaacuauuuuuugaacaugacaucacgaagacucaggcuggauauaagcauagaauauuucaugaaaugguuugcuacuauaacaaaugggugguauuugccuuuuugguuuuguuuuguuuuuugagacagguucucacucggucgcucaggccggagugcaguggugcgaacauggcucacugcaaccucaaccuccugggcucaagccauccucucaccucagccuccuguagacgggaccacaggcucguaccaucacauccggcuaauuuuuguauuuuuauagagacagggucuugccauguuucccaggcuggucuugaacugcugggcucaaguaaucucgccuuguccucccaaagugcagggauuacaggcgugagccaccacgcuugccuggauaucuguuuuuuuauuucaaggcagcuuacuucccuucauuagcauuuucuacuucagguucuuguacuaagucaguuuuuucccauguauuuuacauucuaagguguauuaauaagaucucuguuucuguuucaucacguaugaaguaagaugcugaguaaggcuguauacguuuccuaaaguuaauguagaagaacugcuaagaaaguccaguauaaguaugggguuugguaacuugauuuuauuugaauguuuguauauugcaaauacguaugccacacagggucuuuauuaccuuggaauauuuacuaaaguuuucuguuuugaucaacuuuugugggauuacagauuucuuuaguuauugccauacuuucccaagagccuuuuuuccagauugaugacuaaucacucacaguuuagccaucugccaugaaaauacacaaauccaaccuccccaacccccaaaaauaaaauucaguaguaggacgaauuuuguuucagguauugucuuuuguuuaccuuucuggcauuguuucuauuccagcucuauuuuauuuuuuaauuuaaaaaauguuuuaauuaaaagagauggugucucauucuguugcccaggcuggucuugaacuccugggcuuaugccauccuccugccccagccucccaaagcacugggauuauaggccugaccacacuggccuccagcccuauuuuaaaaggucaggccgagcgggguagcucacuccuauaaucccagugcuuugggaggccaaggugggaggauugcuugagcccaagaguuggaggccgaucugagcaacauagcaagacccuauauccacaaaaauaaaaaauuagccgggcaugguggugugugugccuguuguccuagcuacucaagaggcugaggcaggagggauugccugagcccaggaauuugcagccucagugaauuuugaucacugcauugcagccugaggugacagagugauaccccaucucaaaaaauguauauauaaaauaaaaauaauaaaaauaaaaauucauuuuccucuuuuucauugcuucuuuuaauugggcauuugauuuuaugaacgucuuuacauguuacagaaaugggacuguggaagguggauuaauuuggauaacagaaaaacugguaaacauuuuuuuuuacacacuuugauaaaauuguggggaaaaaauaucaaaucugaaucucuggguuaaauuacuugugacuuguuauuacugagguguaaagaucuggcauuauuaugaagucagguaaucuaaauuugcauagcaauuuagucaucaguaucuuuuggccauuguaagaagacuuguauuagagccuucuuuaauuacagaaggaauugagcugugugagaguucguacguucugugcccuuagugacuuuccgaccggaucccaaccacuacuuuuuaaaaaauucuccugcaagggugucuugcagugagaaagagagacuggacucaacuccccucaucucuacaguccggaauaugggggcagagcaaagugaagcaaauacuucugccgucaccauuuguagaguagaacagucugugaauaaaaugaucaguguucugccucuguuucucaggcccuccgaggauuaugagaagaguuacuacaggccuagguggcagaucauagacugguggugaugaaaucagguuaacagcuaguugccaucugcauuuuugggggguguugugccauuucugucucacugagcuucccagucccacugugcuuuuaacuuuuaaaacagaaggggugaggggacagcagaauugugguuuauagcagcugugauguuaagccugcagaggaaggcaggauggcaugcagagaauugcgggaggucauucgggugugaaguggcuccaaaggagggagguaaauccugccuuggcccuucauguugaccauauccagugcauaccuauuuguaugaucuuuaauagcuuuugucuugguacucagaauauaguguuuaaguuauagauuguguuugcuuguuuauguguguauucauaugcauguuucaaagauggggaaaaucuagccauuauuuaguggcaguuuguuuuuauaugguaauuauucuuugggagcauuauccagcaaaaauuguugaggaccacggaaguaugauacuguuaaaagaucacacacuuuauuugguaauacauuugagaaacaaaacauacauuguguaucuugaucuuaauuaaguuccuacuuugugaucuugucucaugaacuguaacuugcucuuuacaguguacugacuauuaacaugcuagucacuguugucucccuccacaguagauuauauaucagcuguauugaggcacuaggaagaaauacuuggacagguuucuguuuacaugucuguaguuaaggcccgcuuuuagguuuauagaauuuggagagguaguguuagccagugguuaaaagcgcaggugcagccagacugccuagauuuugaacccucauuccucugcugugggcucuauaaccuuaaguuccuucugucuagcuugaauuccuuggaugguaauaguagaccauaucugagaggguuguaggacgauuaaaugaguugcuacaucugaugugcugccguguaucagaugccuagacauaaguuuugugaugcucaugauaggcuuuuccaggggggagaaacuuuagaacuucagaaacaaccuaggcagaaugguucuuucugcaggugggaacacugaggcccaccguaacuagagcagaguuugguucacuuugagcaguaacagguguagcuuucugcaaagugaagucucuuuucuaggguuuuauggcuuauuagccacaggacugaaucuggagccugguuuucuucauucuuuguccaguuuacuugaauuaaguaucauacuuuaugcaguaaugucuucuuuuggaccuuuucacuaacauuuacaaagguuguauucaaaauauauuaaauguucuuugucauauaauucuuuuuuaagguuuaauauacuaauauucauaauauuugugauguagcuggcaagugauuugggaggcguguaugaaguuagaagucgaaauagacaaagaaucaaggaaaauuaacaaaaauuaguuagcuugggggaacaaauuaccguuuagguccacuaaauguugggcaaaccucuuagguaguauuguccccaacaucauugaugggaaaccaaaguggaggguuuguccaggauaacacaaacauugcacaguugagccagaauuugaacucaggucugccucacuucaaaauaugugcucccugaaauaggguaugacucccucaugaaauaauuuuauuuuccuugcugagcaguuuugaauuaguauuuuagaauggagguuuauaaauagauccgaauuuggauuuuaauagguuuccaagcaguaaccacauuacaaucuaaaagagaugguuuauuauaaaugcuuucguuguauagucauaauuugauuaguggcuuauaguuuaguuaggccaguagauaguauuuaauuucuacauuauucuuguagagaagaugggaggccuguguuacagugggaaacacagaagccugggaaucgaaagaucugggcuggguccugacuccauggcuaauuauguugucacucuguacaaguaacuccaucucucugggcuucagucaucccauuauuauaccaagggccccagauugaaaaccccuuaaauucucuuacccuuauuuucagugauuuguauguaggcuucugacuugccuuuuucuccugcacugguucccuccccuuuugcugguggucuugcagucugaguacuuuauggcaugugacugugcuuuaaccuuuuuucucccaguuggucagaugguaguguuauuucacaguacugaaguucucugcuuaggguaaugagaauaacaucaaaauguguauuuucaaauguucuaccuuugugcuuaugaauaaauaguuaagaacuaaauguuuuaugguuguaaaguacaagcuuaguaagucagucuauuuauuaacaaguccucaagccucacaucaguuucguugucacaauuguguuguaaaguugggcgaguuguguguuuuaggggaaggaaaaacauuaacaaaaggcaaugagagugggaaagaaagaaccaaaaauguagaauuaaauuugggaauguaaagaacaugcuuuggcugugguugguauuaauccccuaccuauguaaagguggcauccuggcuuagaucacaggguucuuugcagcucgggauucuaucacugguaagagauaagggugauauucaccacccauuagcauucauacauccucaaaugucuauuauuaauuugguccacaaguuguuuguuuguuuguuucccaggauggagucucccucugucgcccaggcuggagugcaauggcgugaucucggcucacugcaaccuccgccucccggguucaagcgauucuccuaccucagcuucccgaguagcugggauuacaggugcgcgccaccaugcauggcuaauuuuagacgggguuucaccauguuggccaggcuggucuugaacuccugaccuugugauccgcccaccucggccucccaaagugcugggguuacaggcgugagccaccgcgccaggcuuaagcaguuuuuaaugccccuuaugcuagguacuaaaggccaggccucaaggagcucaguaaacaaguuuuuuccugcuuugauggcauaucaucagccagccaguucauuuacuuuuagauucuauagcagggagacagaaacucaggccguuaacaugacccauguagauacucuuuuggcucccaucucucuaguuacaguaugguuucaucgcuguucagcauuggugaguuauaaguuuuuccuauguauguaaguuucgugucucuagauuguaauuuauuuggauagaggauuuuuguuucuuaccuuuuaaaauuuaucuucccuccccucuuccccaccucauguuuucagaguauaauaauacguucuuucuauaaauauuaaaugauacagcugugugguaguauaagaaaacuuuugcagccagcaugguggcucgugccuguaaucccagcacuuugggagaccaaggugggcagaucacuuaaggucaggaguucaagaccugccuggccaacguggcgaaaccaugucucuacuaaaaauacaaaaauuagcugggcauggugucaggugccuguaaucccagcuacuuagaaggcugaggcaggagaaucgcuugagcccuggggguggagguugcagugagccaagauagugccacugcgcuccagccugggcaacagagggaaacuccaucucaaaagaaaaaagaaaaagcaaacuugcuuaacagagaugaaauacuuaaccaaaauacaauuuuuucuguuuaucuuuuuaucucagcuauauuugugcuuauuugaaagugauuuacauaccaugauaauugaagguuaugaggauccccuuuucgcagauaaguuccacguaaagccguguuucccaaauuguguuuuguagacugccagucuuagagagauuaguuguuuguaggagagguuccagggugagauuucaacuugggaaaacacuggguuaaacauaguuaaacagaguuuuauuuuugauggugauuguguuacuguuuuucugcagagcuugucagaguuuuuaguaguguguauuggcaaauugagaaauacugcacauuauauuuccuuccuucaaguuuauuuggucaaaagaacacacccucccccccaggaaauacccacaaacaucuugaagaaagguucuacuggaacacagguuaggaaacccucuuauuugcauacuuacuaguauggcauucaaagcauuuacuuacuaauucggaugauaauuuuuugucaguuggaauucaacuaagauuguaguggcuuucaccaagccuuuuuuuuuuuuuuuaauuucagccugcagugagaaauuauauuuuugaccagugacccaacacauacacacacucucaaaacugaaaaagaaauuucaugaaacaguacuuaggucuuacuacauagaaugcauucuaauacuuucuauuuuauuucuuaaugcuuuuuaugaacuacuaaaaucagcaugcaauuugagagacacuacaagguuacaugaauuuauaaacuuaguuagagugagaauauaccauacaaacuuucauuuuucuauuuaaaaaauauuuuuuguagagacggggucucacuauauugcccaggcuggccucaaacuccugggcucaagcgauccuccugccucagcaucccagaaugcugggauuacaggcuugagccaccuugcccagcuccaaacuguuuuauaagugagaaaacuaaagcucaguguagagaugagaugggagggacucuggccauaaauucuggauuuaaaccuugguuguguguuguugggcaggguguuuaaugccucuuuuuccucagcuuucucauuuguaacauagcaauaauagaaccuauacauaaaguaguugugaggauucaguaagaaugccaugcauagcgugucugauagugugcuguaaguguccaauacauuuuagcuuuuaugauggcugaagucucaaauucuuucugcuguacuauacguacuuugaaaaauauuuuaagacuuuagaaguguuuaagcaaccuccaaguaaagcuagacucuugaucucuaguuggauguaucauuuguugugaucucagcccucugaaauaguaaguuuuaaaaauagcgaaaaggagccacuuaaaguuguuuugucucaguugcaaauugacucucgguugccgagcuuuaugcuauauuauuauauaguuuuaaaacuauuccuuuuuaacuuucuuaauuuucaauuuuguuaaaagaaugaauacuuuagcagcuuuucaagccuuuuuuaaaaaucuuuauaagcauguaauuaaauacaaauauguucauaccuguaaccuauuaauuuagcuuucuuguaguuuuaauucauuaaaauaaaaaaauaaaaguuacuguuuccuguuuuauccacguuucugcagguuuggugaguuugcccauccucaauauuuuauauugccauuggggguuuaauuuuguguccugaccuaagaaaagggacauuuacaggggauuuacgauagugggagccugauuucccauuaucuuuuuuuuuuucuuucugguuuaaacacuucauuuuaauuucucugcugugggcuuccugaacccaccccacuuaaauguuaagguugaaccucccccaaacacaggaagacaagcaagucucugauucaacauucuugccacaucagagaaaucuugcugccccuucugcaguaggugugucuucaucucuacguuccuggaguguguugccuuugagcugauccuccaguugucucaccucccagacccuuuugcuccuuuuagugccccacacuguccuugaaggaccaugcugucaccauggcacccagaacccccugccuacugguugggcuuugguuggguuuagccaauggaagcccugggcagaagauuagagaggguaggaggagaaagaacucagcguaugucuugcccugcccucuccaugcccuggugcauuguuuggccaaggguucccauuaucucaaacauagcuggcuacuucauauauuaaugucacuacugaggcaauuugagguguuucucaguuuguuucuuuuauuccccaguuugucuucagugugaccugaaguugcugaaauaagagguuccaaucagcgucaccgccacauaccaauucaguaugcaaauagcauaaagagggucuggcgugguggcucgcaccuguaauuccaacacuuugggaggcugagguugguggaucccuugaggccuuuaggaguuugagaccagccugggcaacauggugaaacccugucucugcuaaaaauacaaaaauuagcugaguguggugacgcacaccuguaauccuagcuacuugggaggcugaggcauaagaauugcuugaacccgggagguggagguugcagcgcgccgagauugcgccacugcacuccagccugggugacagaccaagacugucucaaaaaaaaaaaaaaagaagauagcauaaaggcauaaagauucuguacuugugugaacaggaggcaugugguaaaaaguaaauaauugcuaacauagcacagguauguuuuagcacagguauguuagcugcugauacauuguuuaagaccucuaugggccgggcacgguggcucgccccuguaaucccagcacuuugggaggccgaggugggcggaucaccugaggucaggaguucgagaccagccugaccaacauggagaaaucccgccuccacuaaaaauacaaaauuagccgggcaugguggcacaugccuauaaucccagcuacuugggaggcugaggcaggagaaucacuugaacccuggaggcggagguugcggugagccaagaucgcgccauugcacuccagccugggcaacaaagagugaaacuccaucuaaaaaaaacacacacgcucaccaaaaaaaaaaaaaaaaaaaccucuaugaguaguuuaccucguuuaaucuuuuuuuuuuuuuuuuuugaaagccacugacuuuauugaucuaaaaaacuuuacaaggacagugacuguugugccaaaaaaggagccaaaugguaucaaacggauugaaagugagggugggggugagggauggggccgggaauccauucaggaaagcugguaacugucaccagggaacuggcaagggaaaaaggacgggggaggcaugcaagagcgagaauccaaaaaaaaguugaaaugguuaggggagaaaacucccaaaagaccccggaguacgucggaggugaguacaacaauagcaaucuuuuccuucguagaggacaggggaggagucccuacucggcugcaaacucugguugagggcuggggauugagagcuucccagagagcaucacaagaaggcgucgcaccacucucgaaggcagucccgggacugcuuggcgcuggcgccacaagugucuuucagccauucccgguagaggucuucaucuuucuuuagcaccagaaacuggccaaggacaacguaggccuugucaaagccccuuuccuccagcuucuugcccaggacuucaccaaucccagccaggcuccccacuggcuucucccccaugggcucugccacgaagucucggugcuuuugggagguugucaucuugaucaggcuuaauccgcaacuucaguucccguaacgguuccucccgccacccggccacuccugcggauaccucccguuuaaucuuuuaacagcccuuuuuaauaucaaauuuuguccucauauuuuuagguaaguaauggggaaaaccaagcaaauuguguaauuggcccgaaguuauacauguagaaagggguccuagauuugaaacccaggucacagagcuugaacuugcaaccuaccaugcugccucuaccacaugauacuggaauguagaaucauccuggaacauaggacauuucugauacagaaacagaugaggucaagucuccuggucaggauguuugaugucucaggacacaaagaacuuucauuucucuuuacugaguugcugucagugaucuuugaggagcugugaugaaauggagccaugcaagaaaauuaggaaaguuaaaaguacaguuuuuccauaaaaggaaaagauggaaucuacaaaucaucagacugcacuugauguugauugccagaauaccuagcuaaguguugauuucuagaagcuacauccauuuauuuauuaacuauuuccuuuuuuaguaggauucuauuaaaugucugagauaaggauggggcaggauaggauugcugaaagaaugcauaguucuuccauauuugagauuaucugaaaauauuaaauugcacaauuuaaauuggaauauuuucuaggacuugaaagucauuuugauguuuuugcuuuuuaauuuaauuaauuuuuuuuuuuagacggagucucucucuguuaccuaggcuggagugcaguggcaugaucucggcucacugcaaccucugccuccuggauucaagcaauucucgugccuuagccuccugaguagcugggauuacaggugcaugcuaccaugcccggcuaauuuuuuguauuuuuuuuuuuccaguagagaugggguuucgcuguguuggccaggcuggucuugaacuccuggccucaagugagcugcccacuucggacucccaaagugcugggauuacaggcaugagccacugcaccuggucucauuuugauguuuuuauaggauccuuuuacuuguguucauuauaguuaucuaauaugcuuuggcacauaagucacauauggcacauuagucacagguacaguggccugcaucccugugccuuaaccuucccauguaggcaggaaggaacuaggaacuguuagcaucuuccuguauguaaacagcaaaguguaaauaccuucuguuuuuauauuguuaaaaucauccauuucuguucuuuaagauuguugcuaaccuauucauuuacucaaaggcuagucuuggucuuguucacauagugauuggaaacugaguugauggaaagagggcaacccuucccuacagaagcugaaagggaggggcggggaauguuuuuucuuuuuuaaucuuauggaagcucccggacuuuuuaaauauagugaaaggaagacaggaaucagggugcuuagcauacgagauuguaugcugaugcccuuugguguuugaaaaggucaaaagacugucuuuuauggaggcuuuuguuaucauugagaagaggaaggaauaauaagaaauacggagagggaagaggaacaagacauaggaguauauccagaagaaagugaccaaguaacuguagacacugggucuaaauuugugugucaugcacaacuuuggaagagcuaaucaugaagguggaacugauugcuuuucagaauugucuuaagaaguagaacacuugaauagauuguuaaccauauuuaauaauauauguaaauauuuaaauauauauaaauuggaagcggguacccuuauggaagcuaaaagggaggggcgggggauauuuuaaauguguguaaauauuuaaauaaguauguauuuaagaaguagagcacuugaauagauuguuaaccguguguguguguguguguguguguguguguguguguauuuuuuuuucuuuuucuuuuuuuuuuuuuuuugagacagggucuugcucuaucacccacgcuggagugcgguggcgcagucuuggcucacuguagccucaaccuucugggcuugagugauccucccuccucagcuuccugaguggcugggacuacaggugugcaccaccauacccagcuaauuuuuuuguauuuuuuguagagaugggguuuugcuauguugccuaggcugguccagaacugggcuccagugauccauuugccuuggccucccuaaaguguugcgauuacagguguaagccucugugccuggccuuaacucauggaauauauuaaauauauauuaaaggccaugcccucgcaaccagcuaggggaaggagugcuccagacccaguuagcauagaaauuauauacucuuauauaaaugauauaccuaacauaaauacccauauauaaauuauauguucucuuuaaaaguuucaaaaaacauaaacuagauuuauucuagauccuagaauaccaaaagauaccaaauucauguuacaaaacuagcccaggccaggugugguggcucacgccuggaaucccagcacuuugggaggccgaggcaggaagaucaccugaggucaggaguucaagaccagccuggucaacauggugaaacccagucucuacuaaaaauacaaaaauuagcugggugugguggcgcacgccuguagucccagcuacucggcggcugagacaggagaauugcuugaaccugggaaguggagguugcagugagcugaaaucacaccacugcacuccagcaugggcgauagagugagacuccgucucaaaaauaaauaaauaaauaaauaaauaaaaacuagccuaaacucuuaaaaaccuaauaaaauacaaaauauaagaacagcaaccugguaagacauuacaaaggaugaaaacuauauuccaaauuuaucuuuuuuuuuuuuccugcucacugcaacucuuccacccaaguucaagugauucuccagccucagccucccaaguagcugggauuacaggggugagccaccaugcccagcuaauuuuuguagaaaucguguuuugccauguuguccaggcuggucuugaacgccugagcucagagcaauccaccugccucagcuucccaaagugcugggauuauaggcaugagccgucgcacccugccccaauuuaucuuuuauauguuuuuuugagacagggucuugcuuuaucacccauucuggagugcaguggcgcaaucauaguuuacuguagccccgaaccccuaggcuuaagcaauccuccugccuuggccuccugaguagcuagggcuacaggcaugugccaccacacccagcuauaauuuuuuaaauuuuuuguggagacgggaucucauuuuguuuccuagauuggucucgaacuccugggcucaagcaguccuccugccuuguccucccaaaaugcuggaauuacaggcaugaagcauugcacccggccccagaugcacauacagaagccaagaacauucuaaguaaaacaccagcaaaacuaauuaaauaugaaauugucaaagaagacaaaaccugguauuuacugugugccaaguaaguguuuuaagcacuuacauuaucucaauuaauccccucagccugaagaaagagauuaugcuuauuuuacacauuaugaaauauaggccaaaagguuaaauagucugcccaaagauuaguugcaaauuagccacagagccugguuuugaacccuugggcgguuugcaccagcuaguauuuaaccucuggcuauaucaucccaauaugugccaagauagcaguguuaaacaguucuucuuguuuuaugaacacuugaaaucagaaaacaaaacaaagaugcccaguaacacugauguuugauaaugucuuggccagugcaagaauacaucaaauaaaagacuuaacuauuggaaacugguggaauauagcaguauuugcagacagucacaauuuuaaaccugggaaaaccaagagaaucaaaucaagaguuaaaaauaagaguuuagugcccggcgugguggcucacgccuggaauccccagcacuuugggaggcugagguggguggaucaccugaggucaggaguucaaaccagccuggccaacauggugaaaccccaucccuacuaaaaauacaaaaaaaucagcugggcgugguggcaugugccuguaaucccagcuacucaggaggcugaggcaggagaacagcuugaacccgggagguggagguugcaguuagccaagaucuccagcuuggacaacaagaaugaaacugucuuaaggaaaaaaaaaaaaaaaguuuaguaagaugguuuuauaccacauaaagauauuuaauaauugguagcacuuggcuaugaaaaaucuugagcgaaaaccucauucauuauagcaauaaaaaaugaaaugcccagggugaggaaaucuauaaauauuugagauuuuuacaaagaaaacuauaaauuuaagugaaaaaagacuuaagaacaaaugagaaaauuuuuccagguugaaucaguguaguauuggccagagaauacugucagauauuuuaaaaaguugacuuauggaacacaguaaaagauacauaugagccugcuacauaagcaacaucacacauuaguggagaaaaaggauuauuuagaaaaaaauuuuuucuuauaauuuuagacagaaucuugcccugucacccaggcuagaguucagcggcacgaucaugguucacuucagccucgaccuccuaggcucaagugaucuuucaccucagccucucgaguagcugggacugcaggugcacaccaccacaccgaguuaauuuuuguaguuuuugcaggguuucaccauguugcccaggcuagagcaaaauauuuuuaaaugauugguuauucuuugggaaaaugaauugugauaauuaagcuacccuuuauaugaaaauauaucuguugggagaaugacuaaaaacuauacauuagaagaaaacuuuucuuuuuuuuuuuuuuuugagaccaagucucgcucuugugccccaggcuguagugcaguggugcgaccucggcucacugcaaccuccgccuccuggguucaagugauuuccugccucagccuccugaguagcugggauuauaggcaccugccaccacacccggcuaauuuuuguauuuuuaguagagacaggguuccaucauguuggccaggcaggucucgaacugcugaccucaggugauccaccugccucggccucccaaagugcugggauuacaggcaugagccacugcgcccggccaagaaaacuuauaugaauauccauuggaugaaaaagcagguuuauuuucauugcugucgagugauagaagaaaagaacuaagaaaaaugugugaaaaaaauuugugcgaugauggccgaaguguugacauuuaccucaguauaguaaaagcuuauacaaacugauaacugccauuuauuaguaagcuccuuuuauguuucaaaugcugcccuaggcauuuuauucauguuaaaauuuuaacagucauuuuauaacuaauugagauacaaaaggucaauguuuuauccccagauuuugguucauaccucuacuaaacagcagagcugggauuuaaacuggugucugauaagagauggucuuaauccuuaaagcaugcugccuuucaagcaaguuaaaggcuaaaacacuggccaagugaacagccagaucagauaguggcuaaauaaaguaaauguaaauaaaacaauggggggugcuauuagagauuuuaacaaguaguaaugcuuaaugcaaguaggguugcauugagaugcauaaggcaagacgaucucauauacugcugguagggccuuucugggaaagaguuuggucccguauauagccagguuguuaauauacucauguaaaccaggaaaaaaauaaaauuccuuuuucauucuuacuacaagugaucuucggugucuuaaaaaaucuagcuguuuuauugauugugguggugauugcuuaacucugaauauacugaaaauuauuggauuuuaugcuucaaaauacuuuuuuugagacaaagucucacugucaccgaggcugugagugcauuagugucaucauagcucacuguagccucaaacgucagggcucaaguaaucgucccuccucagccucucaaguagcuaggacuacagacgagcaccugcacaccuaauuuuuaaauuucuuguagacacggggucuugcuauguugcccagccuagucuugaacuggccuuaggcaauucuccugccuaggccucccaaagugcugggauuaugaugugagccaccaugcccagcugaauuguaugcugaauuguaugaugugugaauuuuaucucaauaaagcuaauauuuaaaacaucuagcuauuuuagcuauugaguggagaagaaaauaguuagcuuuuucgaacuucguguuguuaaaaauguuccaacaaguccaguuuauccugcacugauuuuauugguacaccccauuuaauggaguauccuaaaucuacagaaaguagaauuaguucuaagacugucuuagugaguggucaaaggagagagagcugagagcuuggugaaauuaucucucucuuuuuuuuuuuuggcgggggagggggacugucucacucucacccaagcuggagggcaguggcgcuaucuuggcucacugcaagcuccgccucccggguccacgccauucuccugccucagccucccaaguagcugggacuacaggcgccugccaccacgcgcggcuaauuuuuuguauuuuuuaguggagacgguguuucacuguguuagccaggauggucucaaucuccugaccucgugauccacccaccucggccucccaaagugcugggauuacuggcgugagccaccgcgcccggccgaaauuaucucuuaacaggagaacucaguuucagguuuaucagucaguuuuaagaccccuuacuuggguuuuaggaaacaucuucuaccucaucuuuguuuaaaacuaaugugugccuacagacauaaucuguuauuuucaguuguaucccaccuugugaggaguacaugaagauggcccuugcugucuagggucauguauguaaaugcauuuauuguuaauuuucaaauauaggggugcaugaaucaggguaaaaucgcucaaagauucaguagggagaaaaaacucguguuuagauucuugccgcugggggaaugagaucaguuagaucagccuguucugauuauucagcaaugagagcaggaugggauaaaugaugaugauaaugaagugugugccuguaggagaaauggcaacuaguugcccaccuggccugggucagugugguuagugggagguugaaaaguuauuuauuucaugacauaggcauaauccccaauaaaucuugagaauuguagauauuuacugauuugaaguauuaaauacugccaagagagacuucuuuacguuaucacugacaauuaaaaaaaauuuuaaauauggaauuuuuuucaaccaggacuaacaaauauuuaugugcagguuacccuguugcacccuacuuuaaguagagggugcucugucuuugcuagauugagaaauggacaugcacaggaaaguugacuagucauaggggagucaaaauagucacagauuaguagggguggccaaguguccugacuucccagacagcacacauuuaugccuguuguccugauguauuuauucaucgugccccccuucauucuccaauuugcccuaguuuggaugauaaauugucaucugaccauucagcaguugcaagacuagcuguuuuuugacccccuccucucauuuuuuugguguuaaagauguaaggcugucguaucagguccucggauguccccccacauacccccaagguaguuugauucucagguguugcuucuggagcuguagcauuccuuccuugaaacuaaaaggguuuucaguagauugccuugacuuuucuuccuucucaaugagagcuauaugcuguuagcacuucuggcucuaaaguauucgacuuuguuugaaaggagauucuaaauguaaacacuguuuuugcccagauucucucuuccuucacucucccauaaguagcuucucaggaacuauugaaagagaaauuggggaguugcagauuuuaaaugguuguuacuggaugccuuauaacucuaaaaaaggacuguuuaaggagacaguguagcaguauuccuauacuuacauauuuauauaauguuuaauucuuuauuuuccauaucccuuccaaguuuuagagcaaauguuuccaagggaaauaccaggaguuucacaagaucguuuugggaguugaguuuaggauagccaggggaaaaauuacauuuaauuugcauuugcuuauauaaucuugaacuuuguucucaauuugugaaaauagacauacuguuuuuacacuuuaauuuuuuucuuuguuucuuccccuguuaaugacacauuucagauauccauccccaaaaguagauaugcagaguauauggaagaauaagacauugccacucgcagcccgcacuaggccaguuuggcccucuaaaaggugaagaggagaaagaucugaccccugcccuuagagguggccccuuguauuaauuggaacucauuuuuuccaacaaaacagagauuuaguaaaauuuuauuuuggggaaaaggaagaggugcaucugggucucaaaagcuggaaccaagaauacaggcacuuuuaagacugucuguuuccuacugcauuuccuugcuuauucgccccuugaucucugugcagacuaguuuuuuccaccugauagaaaaucuggccaccugcauuuccuaaauauguaucauggaacuucagccuuuggauagacugacuuccuguucagugucuagcuugccccucccuaaccucucgguuagguuguugaggccagcagggauguggucagguaaggccauaguaccacccacuggagcuaugugagugguaugugugagugggggaguugccagaaagaaaugguucugggggugauauagaaugacccuaugacccuuccgaggauugguggagucugucgucuuccccucucauuuguuuagguguccaaaaucaaacauccauagacuucuugguuauuugacccagaccacaucuucauuccuguuauuuuguccuuuaguccucauguuagucuuaaauguaggcccugcuuuagggcuuuuggccacagguaucaugaaggccugagggagucuaaagagcuggcccacaggaucccagaggcauuccaccccgacgaaggagucacugcacuuacauucucucaacuguggagggaggaacuggaauaugugccccacccggguggaacacuguucugcauuauuagucugcuggucuaaaccaccaauauuugguggcgguggugggguuguguuuucuguugaaucauaggaaagcaucaagugaccaauacuuguugauuggguagcauuuuggcuuaucucaucggcuuguuuuucauuuacauugugcucuuugcuggucgccugcccugauaccccuugaauucuuguuguuuuccuuaauuuccuuagagaguuuggaguagaauguggaaucgcaguuuacaaguagagcucagccauuauuuuauuuauuuuuuuauuuuugagagagaguugucgcucugucacccaggcuggagugcaguggugcagucucggcucacugcaaccucugccucccggguucaagcaauucuccugccucagccuccugagcagcugggauuacaggcacuugccaccacgccuggcuuauuuuuguauuuuuaguagagaugggguuucaccauguuggccaggcuggucuugaacuccuggccucaagugauccguccgccucggccucccaaagugcugggauuauaggcaugagccacugcucccagcucagccauuauuuuaauuuaugaaugguuuguauaccuaguuaaaaaauaauuuggggggaugggggggacagagucuccuucugucacccaggcuggagugcaguggugcagucauggcucacugcagccuugaccucacuggcucaagcaguccuccuaccccaggcucccaaguagcuggaacccuaggugcgcaucaccacacucagcuaaguuuuaaauuuuuuuauagagaccaggucucacuguggugcccaggcuggucuugaacuccugugcuuaaccaguccaccuaccucagccucccaaagugcugggauuacaggcaugagcuaccaugcccaacaacaaaaaaaauauuuuuauauaaagaccauuuagacuuuaauaucuguaauggcuugcauguaauaggggcuugaaaaguauguugagaaacuuggaaguauuuucauucaucuuuacuuaccagaaaggagaacgacaccaacuaagcaguuauugcacacugcauaggggcucuuugagagauggaagaguuaugccgaccaucucucauguucacaugggcugguaugcuguuacucauggauagaaaguauuugacucucaagaaaaaugguggaagucuccucuuuugcugcacauuguacauguugauggcuuuaccacauuuucucuguuugacuuaauguaguaaucucuucccagacaggaugucccuguaacauuguuaccuauuucuacagcagugagaauauugacaugcuagaucuuacaguauuuaacaaauuuagcauggugguaaggauaaaagcuacacccucgugcuaaaauuagauuuuuucauguccuuugccugucauuuuagggaaauggagaaaauuagggauauguuuccuucucucuuuuuuucuucuccccuucugucucaucuuccacgucaccccagagaguuagauaaaaagcaauggaaaaaguggagagaugaaauuauucucaggacaagguuaguaucaaaugcaugucuuuuacacuagcuacacauuuggcuuugaguuuugaguagccagaacaaagaaagaaagagcaaauccaagacaguuuaugagauaaaaagaaagccaaccacuuaggagaagcauaauuuucuguaaucgagacccuguggauccuuuauuaaugcgagcucuggguccuuaauauacuucucaaaucguggucaggaggaggggaaggaggggagucaaaaaaucucaaaaacuugacccuucucugaucucaacagugucuguaaaaaugaaguaccugaguucaaguuuaagguaucuuaguacaagacguaaaagacauaguauuaggccagagugcaguuuaauuaaaucauuuuucugaugcucuggagcuguggaaguggcccuuuauaaugauucaugcugccaaccuuuuaauuaaaauugaguaccagagagguccaagguuagagugucugguagcugcucuggcuuuaacaguuggcucgaauggcaaccaacacuaauaucugccuuucaaaacuuaaccaggacuugauuucaaaucuaguuacauaaguugacuuggaguccagguuaguguuuuccucagaaacuaguucugcacccaacaugcagacauuuuuaauagacacaguuuuaaaguaauuuuuagaaaaaauuuuuuaaauugaugacacugaaacccaauauguaaaacugauaagagugagguguuugggcugaagagaagauagacccucaccugcugcagaucuuagaaugggcuuaaaagccacuaucagaaucauggcuacugucauuuuaguuugacaaaacuucagugccuggauugcuguucucccacuguuauggaacaagcucacccugucuccccgcuacccucucaggacaccugcagaaaaucuaauuuuaaacaauguaacuuccuuuucaagccacuaugagucugagagauuggccguaugguuaacaauaaccccagcauuuggggagauagaaaaauccaaaggauagauuuuugaggccugcacgaaaaugaucaucucuguuuguuagagauuacagagcgcugucacgaauauuuuguuuaguccucacauuaacuuguguuaguaauauucuucugccaaaauaguaaaggaaaaauaaaaugccauguucaaaauuuuuguagaggaaaauaaguuuuuaauguaaguaaauguauccauuguaccucuuccugaaugguuuuaggccucucacuaaaacuuaaauuuuuauguucccuuggauauaagaugcuuuuguugugcauuuuagauacugcuuugagauuaaaaagcaaguuuuccaguuugacuauauuaugaugucaacacuuaccuggaaagcaccacuccauaaaguguggaauguucuuugagcaauaaaagaagguaugugguuauucuguaaacagcacuuggguuuuucaccuucugccugcuuuuucacccgauacuuuauuacccaucagagcuugacgaaauuacaaagucauuuuucucgccuuaucaugcuucagacuguugcauaaagucuuccagugaaacauuuucugacccuuauccaaauuuuucauucuacacaacgcaguucaagaaacgucuccgcugaagucugggaccuucagcacacagugcccugucuguaccuauuagucuuccauggauuuaagucuucuguauuugugccuuucuccccagcuguauucuaaguccugaaacaccuagcgaauauguaccacuuaucauucaugccauuuaguucucaucuuuugguuuaugagcugaguuuaggcuguaugauugggaacuuuuuuccuccaaaaacacaagcaagagcuuuuauauuugaucauaccagucaguuggcaaaugagguuugguuacuuccucugaaguucaguguuguuuagccucauuauuucaucaggaucaaggcuucauaugccaguuaguguguugauguggaggaguggaguggaaagaauauguugauugguuaggaaaauucucagcagaaauuauccuuggguagaauguucuaugugaucaucuacagggcuguguacuugugcauucugugacucuaaauacugcugcuggaaaaagucuguuuacacuaaauaccaccauacgacagccuuugagcaguuuaaaaagaaaccuuccaaucuccuacuauggugguuuagcucaggcugguuuuguggcauguuugugcuuuugugggcauuuggccagaacagaaauagcaaugcuuagaccuugaaggagagugauuuuccagguuuacaucugaugcuguagaaauaaguuuaagguuauaaauuuugcaaauaaaacuuuuuuucagaauaguuauucauuggaaugacuaaaaggaaaaacuaaaaaucauuucaccacucucagguaugacuuuagaaccauagcauuuccaaucuaccuuaauucuuugacacaaaaauaauuuuauggaaggccuuuuccccauacuugaacuuucaaguuuucucauuuguuuagguauucuuuuaaaggaauuaucucuauaaaagagcaggauucacuguuugcuuuucuuauuuaccgaaaugugggugaggcugugauguuugcccaugaucauauggacuauguuuacacagccuuguagcaagugagaguaaauuuaaccagaaggaaaauagauauuuuuaaaauguggacauugauuaaccuuuuguauuuuaaaauacagugcuaauuugucuagaaauagcugaaguucccguuuucugaaacuaguucuaaagauaugauaauuuaacucuuaauuuguuaggguaucugugaauaaaucauuguagguaaaacuaaagauggcagaucuguauugauaaaagaccuuuaacauauucagagaaaucagucauguauuacagauguuucuaaauaaauaaugcuuuguaauaugaaacuauaauuugaagucuuuuuuuugagacagaguuucgcccuguugcccaggcuggaguggaauggcgcgaucucugcucaccacaaccuccgccucccggguucaagcgauucuccugcuucagccucccaaguggcuaggauuacaggcaugcgccaccacgcccagcuaauuuuguauuuuuaguagagacgggguuucugcauguuggucaggcuggucuugaacucccgaccucgggugauccgcccaccucggccucccaaagugcugggauuacagguaugagccaccaccuccagccucuaauuugaagucuuaaaucaugauaaagucuuugugcuuugccguaauuggagaaguucagcauugugaauaugguugcuaucauuaguauaaaagagcuauucagauugauuuuaaaucuucuacuaacugcaaguucgaucuuaucagugguuuauaaaauccccuuaguggguuaugacuaguauuuacaaggaagggaaggaguagggcuaggauagaacaaaauagaauaaagaaugucaguauaauuuuacauaguaaguauaagugcuauuuggugacucuuguuuucuuuuuaugaauaugugugcaucaugggucaugaggucaaaguagucuguacgccaccagugauacuauaaugcaguuagguggccugguggccucgugguuauuuaaugacuguacacaaaauacagauugaagagaggcuuuauuggaaagcuccaguacucucuucccugaccuauucauacuuuuaauaggaaguaaaggaaaaccugugugacuugcuaaucagauuuguaguugacaggaaucugguaggggaagcugauguauacuggauaacagcauuaagauccaaguaaaaaaauuuaaaugccauacuacauacugagucuaaaucagaaggaauugaauaggaauaauuguucaguccugcuggcacgucccaaaaugcaguaauacagcagaccccaaccuuuuuggcaugagggaccaguuucguggaagacaguuuuuccacggacuagggcuggugggacaugcagggcaggggaugguuucaggaugaaacugugccaccucagaccaucaagcauuagguucucauaaggaguggacaaccuagaucccucgaaugcacaguucgcaauaggguucacgcuccugugagauccagugcugcugcugaucugacaguaggcagagcucaggcaguaaugcucucucacccacugcucaccuccucuguuacuagcaggucacuggacccguaccacuccacagcccgggggcuggggaccccugcaguaguauacaaugguugaagauggggcuuccuaugcaacauguacaaaagacuugggucaauuaaauugcucaguagaaaguguuuuagcuguguggugugacuauuaaaacuuaacauaauuuaagaucacauuuaugaaauauauggaaagguagucugccugguuagcugacacauggggaguaugggauccaguuuggagcaccacacucugagaggagcagugacaaauaggaaugccuggagaauaauucaggcgguccccugauuaauucccccaagguuuaucucccucugacaaaaccacagcuggauaaauuuuauaggaauuugguugcugacuaugguaauuguggugcagauucaaugugaauauaugguucucauucccagacaccacacagguuaguguggagaugguuauuuacauauuaacaugucuuauuagacuguugaaaaugcuuucagcucuuucuucaugacaucucuuucauuuuaucccaauccuggaugccuccaugcuuaagacacaaggauacaggucuacuucagaauauuccuaccugauacccauggaaaugguugcucagauuugauacuucgucaguuuacuucuaguauuugccccuggcuuggcuuggacugggauaaggucuaggaaugggaauuuauuuucuccuuuuucuugaaagauggagucucacuuuuuuugccuaggcuggucucuaauuccuagccucaagcaguccuccugccucagccuccugaguagcugggauuacaggcacccaugcccaacucuaggaaugggaauuugaucacaucguaaguuggaauccaauucuaaaggcacguguauacauucaguuuuuaaaauauccucaaaucuuagagcuauaauuuugaacaauauaucaaauuuaaauaaguuuauguaauguuauacuuauucaacguguauuuagauauaguuaccauauaaagaauauauuaugcuucccccaaaauaacuuaguugcuggcuaacuggagaaaagucacaaauucuuacaguggauuuguugauuuauuuuuuugucuauaacuaagcagugcuauaaugaaagcagccauccuuucucaaacuggauaguagugagauucauuaaaugagaugcuacuagaauggcuuauuucagaaagauaccauugcuugaccauaaauguuagauaucuauaaauaugaaauuuuggauucauacucagcaugcaguuccaagccuagcaggaaauccaaaauuccuaaauaaaaagauuuacagauaagucuuuuuuguuuuguuuuguuuguuuguuuguuuguuuguuuguuuguuuuugagauggagucuugcucugucgcccaggcuggagugcaguggugcgaucuuggcucacugcaagcuccgucucccggguucacgccauucuccugccacagccucccgaguagcugggacugcaggcacccgccaccacgcccggcuaauuuuuuuguauuuuuaguagagacgggguuucaccguguuagccaggauggucucgaucuccugaccucgugauucgcccgccucggccucccacagugcugggauuacaggcgugagcccccacgccuggccaauaaaucuuguaagaaaaugaaaacuucuuauauuaagugacaaaguugaaaugcaaauggcaaacuaggagaacauauuugcaaaaaaaaaaaaaaaaaaaucuaaacagccaaagggauaauguucauaauuauucgauauccuacaagucaauaagaaaaggacuccaaagccagcuggcuaaugggcaauagagauguacaauuucaguaagaaaauacaaauggaaguauguucauugucauuaaugauuggcaauucaaauuaaaauaauugaucagagggguggaaagaagaggaaggcaagaagacagcauuuuuaaucuggcaaaucggaaagguuaauagguccuaguguugauuagcuggcaaagaaauggcugccuucauggacuuuugauucaagacuguguaaauuggccuaaguuuuugguaugaguuaagaaucuuuguguuuugacucucagacugccuuaucagagucacucagaaucuuccuuggcugcauuuuccucucauaugugguauacauaacugcacagaacaucguguggucucuuuguggccgggucagccauuuguuuagccguuccuuaugaauagcuuucuaaggugggcaggagaggucuaauuaccucaaguuuuauaaagaugaggaaacuggcauuaaagcucauugacuguccuaguucugguuaguagagaagaagacaaggaguugcaguuucuuucccuucacucacucuauaugacuuccacagacaacuaggcuggaacucuacgacaaaguaaggccggcuaugucugcacagaaaggaagggagagauagaguaacucauuaaaaauaagacccccaaagacgagucuuuuugcugaaauaguuaaaaagcaaucugugcauuggaaaaaugcugugaugacccccuacugacuccagaaagaguuguguuagucugacaguuucaagugugaagaaaauacguauuuacuuuuauaauuaaucuaaaggacauuauuaaagauaguuuuguguggaguuauugauaaaaauauugaaaguuuugccaagcuacauuaauauagaaaauuuaaacauaaggauguagaccuuaauuuuuaaacuugacuuuauuuaugauguuauuaagcuaauuuagaacuugauauucagucauaacuagaagaaacucauuuagaagaguacucgcuuugauggcagcuuguuucaguacugagcaaacuaccuuucuuguaaacaacaaaagacauuugaaaacugcugauuggggccaguauuaaauuagggcaaaaaacaaauauuaauauaaagaaagaaaccuuuugucugcagaaaucagguaaguauguguauguguguguauauauaugguuauuagaacuuagaagaauaaagucacagagcucugauacaugauacuuuuuuuuuuuuuuuuuuuuuaagauggagucucgcucugucaccccggcuggagugcaauggcacgaucucagcucacugcaaacuuugccuccuggguucaagugauucuccugccucagccucccuaguugcugggauuacaggcaucugccaccaugcgcggcuaauuuuuuaaauuuuuaguagaaacggguucaccauuuuggccaggcugcucuggaacuccugaccucaagugauccaccugccuuggccucccaaagugcugggauuacaggcgugagccaccgugcccagccccaugauacauucuuaacuucgaagagcuacuuaguuauggucaguuugguuaaaacacuuccagccauauauacauauuuuuucuuuuuuuggagacaaagucuuacucuguugcccaggcuggagugcaguggcacgaucucggcucacugcagccuccaccucccagguucaagcaguccuccugccucagccuccuggguaacugggaauacaagcacgugacaccaugcccagcuaauuuuuguauuuuuaguaaagacgggguuucaccguguuggccaggcuggucuugaucucuugaccucgugauccgcucaccuuggccucccaaagugcugggauuacaggcgugagccaccacgccuggccuccaaccauauuuugaaguauauucucuaacuguguuuagauguuacagugguuguuuauacauguccuaccuuguuccagaaagaauuuaagggagcuugaaauaaucuguuguguuuaucauaacuuuaguuuuugaaaucuauaacaacugcaugguacacugaaaucaccacaguaaaauuugacaauaguaguaugagucucucaauaaguauuugagguuuaacaugaaguuccuguuuguaaaauuaacacauagcuuucugcaagagcuguugcuacuuuguaaaaugacuuuucucuaaaaaaucagcuacuaaagcaaagcccacucuuuucucuaagcaaauauauuuuguugcuccaaugaagaaugaaccuuagcauuacagcauauuucauaaacauucauaauuugacauuucucauuuacuauaaagaaaauuuuuaaggauuaacagaaagccuuuuuuaagaggaacauaaguguuuuuaaacaauacauucacuaagcccauuucauuaaguacucauuguuuaauucauucauucauuaaagauagguuagcauaagaauuauuuaauacuuuagauuaccaaaauggaauuaauggucuacuugacauauauaauagguauaucuaguuuuaggaucguggagaauguuccgcuaacaauggucuaccuuuacccuugccucucuauucuggaaagguuaaaaaaauuugaagucuuugaaaaaucuuuuuuuguaaguguucugagaaaaauguagacaugugccuaaaggaaguuuguuuuaguuaagaugcuauuuucccaaaggaugaugaguccucagaggagcucaugguccucagaccuaugcuugcacuccggagacuugguugggacugggagguacucucuaugcagcauauaucugagauuuaauagaaaaggaacuuuaucaaugaugagcaauaauccucuuaaaagcagaugaagcugggguauggaccaagcuuuuuaaaauuuuuuucuuuuuucuuuuuuuugcaggggaggcggggccagaguuucgcgcuuguugcccaggcuggagugcaguggugccaucucagcucacggcaaccuccaccucccggguuaaagcgauucuccugccucagccuccagaguagcugggacuacaggcacauaccaccacgcccagcuaauuuuuguacuuuuaguagagacgggguuucaccauguuggccaagauguucuugauccccugaccuugugauccgccugcuucggccucccaaagugcugggauuacagcaugagccaccgcgccuggccaaaaucuuuaaauuaaaaaaaaaauuuuuuuaaggauggggcauucagggguauccuuuucauguuuauuugacucauaaucuuagaaauugcccuuugccuauuuggucgggauuuaacaaagucacucagcaaacauuuauuugugauuacuguguuuaaaauuacauuuuuauguuuuauauuuuuuuguaauacuugauuuauguguaagaugacagaacaaguaaguacaaaaaguagaaucuggaaucagaagacuugccuugaauccugacaccuacauucaguguguaaugucacggcuagccuuuuaugugacuuuaaagauauacaggaauuaguuaccaugggagcuagagaaagggugcagggugguuucauggauggaaaguguucgcagacauuggguuagggaguacacaucacaguauguaacacaccuuaaucaaugacucauuccaguuuaacacugauaaaaacagucaaucccaaaaagcugugacgcugcauaacaggauggcucuauaaauaguguugcacucuuaggaacccagaucaacccuuugaauauuccaucuuggguauuacgugaagccaucacacuuuagucacaauauugccagguuuauauucaugguauaaacaguauucagacagacaaauuaagaguugcucagcaaaggugugaguccagcuuuguguguagcaauagagaaauuauaggcacuuugcuagauuuccugcucacuuacccuccaagagcaucuugguucuggccucuggcuccuuucugcauggguuucaggugaaaauuuucuagucaacucuugguuauuuauguaucauuucuguaggauuuuuuuuguuggugugauuuuuguuuucagaaauguucuucagucccacuuggcaaauguaucuggggucucaugcaaagcagcaugccaaauguuauaagaauauaaaaugacuguuaauauacaacuuugcuaucaagaggccuccagauuaguugggagugauacauacauacauaauaacacauuauaaucaagauuuuaaaaaucuuacggguauaaggagggucuuacacuuuuacuguggagaucuuuauggagcagcugguguuugaaaguggucuagaggccuggagugguagcucaugccuguaaugccagcacuuuggggaggccgaggcaggugcaggagaaucgcuuaaaccugggaggcagaaguugcagugagcugagaucacaucacugcgcuccagccugggcaacagagugagacuccuucucaaaaagaaaaagaaaaaaguggucuagagaugggcagcauuuugacaaguagaggagugagggcauuucugaggagggguuacccccauuggcauugcuguaguuuccaaaaauuauuucacggagagaaggggagaggagcacuaugaaccacuuguugauggcauugcccauggaacuguuuccucuguagauauucuuccucuuaccugccaucaacaaggugaguuuaauugaauuacaguggacaaaaugaaaacacauguagauuggaacaguuaaguaagagaacuuugagacucuguagaaggaaaagguaguguuuaugucugaaacauggauuacaguggucacaguggucauuuugcaguuaugcauaaaucuaacuuuuaacuugcuggcaaauaagggggaaaauuagcgcaaaauauaauggauuauauaguucaccuuccagugauuugagacauaccaguucuucaaauagaaacuuuugccauauuacuauguuuuaaauuaugaaauauauaaguguauacacauaggcuguaguguaaugaauuuccagcuucaacaguuaauacuuugcuagcuauuucaucugucccccaccuuguucucugagagagguggaacuaaaguauuuuaaaggaaaucccauaucacucauacuuccacauguaugucuaacugaucaggauauuuuuuacauacgucauaauaccuaacagaauuaacaguaauuccuugucauacccaguauauaauuucccuugauugccaaaauaucuuuuuuucaguuguuuauuugaaucaggauccagagagggcccaugcauuguauuugacuauaugaggcucuuauuauuuaagucucugcugucuuuuuuuuuuuuccuuuuucuuauguuguuugguuuuuuggagaagccugacaucuguccugugaaguguccauuuucuggguuugauuuacugcuucccuauggugauguuaaacuuguuccucccucuuguugccuguagaccaaccgcuagaucuagaagcuugauuugauucagaauuguaguuggguggggugggcaagggagagucaaauuuugauagaugaugcuuuguacuuccuauuguguuguaucaugagucacacuggugugugguuguccuaauagauuaguguuguccauguaguuagccugcguauccucuaugaaauuccccaucagccuuucaccuaaugguuaaggccauuggugauuguugccuaguuccauuauuucauuaagaauuacaaaauggguugggugcgguggcucaugccuguaaucccagcacuuugggagaccaaggcgggucaaucacuugaggccaggaguucgagaccagccuggccagcauggugaaaccccaucucuacuaaaaauacaaaaauuagcuggcagugguggcacccaccuguagucccagcuacauagggaggcugaggcacaagaaugguuugaaccugggaggcagaguuugcagugagcugagaucaugccacugcacuccagccugggcaauagagugagauucuauuuccaaaaagaaaaaaaaaaaaaaaaaaauauauauauauauauauauauauauauauauauauaacaaaaugguaauuuuuuccuauccacacuuauuagcuaugaaucuccuauaaagaacuuucccuugucaucuauaugguuauccugaaauauagucuauacagaaaaaggcaggauaaaugugcgccccccgcccccguguuuuuuuuuuaaaccaauuguuggaguguugcauuguugccuucacaaccuccaagguaaccaaagaaaauuauuuuuaguauuauuauaauuuuaaugggcgcuaauguuuuacauauauucuuauauauacauauguuacuauuaaauauacaauacuuuaaugugugcagaugcuugauuuccauguuaaugcauuguaaucauuauuuuuuaugcucaaauucuaccaucuuaggccuuugcagcacuuuucaacuuagcuccugugccuuuuuuagcaugaccucauaaguacaguauuugcuuucuggaguaacacgucccuggcucaucuuggguauuuccuacucuuucaugaagucuugguuucuuuuaguaggaaaugaucauguauugauuuuuuuaaaauacacuuuuuauauuuagaaaaaaaguauuauauggacuuuguaaauacuuaaccuuagaaaaauauaaauaucaauucauguucucacuacccauuauuaaccuuugcuauuuuuucucuuagcaaaucgcucugcauguauagauaaagaugggauuauauguaugcaaacuuauauuuaaaguguuuucccuuaagaggaguuguagacauuuuuucauaucgguagaaauccucagaagcauugauuuuaaaugacuucugaauguucaguucuauuugcugagaauucugguugguuuuccuuuuccuacuguauuaaauaacuauucaguggccaucuuuguauguaaaucuuagagaagcaauagauuaugaggauacacucguagaaguguaauugcgggcuuagaaacauuuuuaaguuuacugauacauaugaauauauugauuguaguaugaaagauacuggacaaccuaauagacacugcauaagaguugcuaaaaaccugcuuugaagucccagcuuuuucgcuuuacuagcuaguuucaugauauuugaacaaacuagccaauaauuuugagccuuaguuuacucaucuauagaauagaaauaauagaacuucuuguaggaacgaacaaauggagaauccugcuguuacuuugaggaucaaaauaaauaauaguucauucuacaaauauucuacaaauaugugccaucuaugguuugaauguuguuuauuuccaucaaaacuuaugcugaggcuuggccccuaauguggcaguguugggaggagauaucuuuaagaggugauuaggucguuaagagggauuaaugccuuucucccaggauugaguucucacuguuuugggacuggauuaguuaaugccaaagcaggcuuuuauaaagugaggccaccucugcuguuuggucucuuuacauauguccaccuccucuucaccauguuaagauauagcacaaaacccucaccagaagcugaccagacgcugccaccugaucuuguaccucucagccuccagaaucgugagcuaaauaaaccucuucccuuuauaaauuaccccaaauuucaacugcuucuuaaagcuacucuugauuuauuuuaauggaaccuaaguuaccacaucuuuuauuuuuuuuuuacuucuccauauguaguucucaauuuuguuuuuauuuuaaaaauuuuuaguuaucacaacuuaguugcagcuaagaaaaucuugcuucccauucauccaaaagcugaaucaagacuuuagauguaggcuuaaauagaacaauaaggucauucauuuuauuccauuuuauauugcuauccaguuuauauaauagauaugcagauacagugcuaagcacuuuuuaauucuuauaccauaucgugaaguagcuauugcuuuucccauuuuagagauaaggaaaagagugcuuagaaaugucuaagucaguugaggcauaacaaagucaggauuugaacccaggcuaucuuuaaaacccguguaauuaacuauugugcuuuaaauaauuguucuguacuaccagacagauagucuagcacuuaacacaguaucuguaaauaguuauuguuuuaauuaaguaacauuaacacuggaagcaagggauuaagucuuagagccaguuaucuaaaaagaauguguucaugcauguacuacauuucacacuccaugacugcuuaagaaccuuaauaauccuuguaggcaacuaucuuaugaugugugggguuuuuucuuuguuugugcuuuuuguauuugaccacgaaguucgugagucagaucuaacacauauguuaguguagagucuugugagcucagcugucuaggaauguguugucauucagcaguuuuucauuauugucucuaaacacauacgcccacauccauacacaccagaauguugucuugagagcaggcacucuugaugccuuaaguuugugacauauaguaaacacaguuagaaauggagugaaugaauguucugcugacuggcuuauggaccuuuugacuuauggaccuuuugaguucuuuucaguauuugucaauacauaggugaagaggagugugucacauaacgcaaaagcagucagaucuccaaagaugggcaguaccuaacaggcuuaacuuaaauggugugggcuuuuauuuuccuaauggguauccuguauauucucuagcacuuucuugggauguugcuuuguacucuugaaaauauucuugagaauauuaauguaauagagcagugauuugaugucuuuguucuuuguaagauagaaguggccauuucuagugucaucuggucuccaucuguucuggagaagagaguagacuucaguaccaaaaccccccacaaauacaaagcaaguaauaaaaaggagaauauaugccaaacuacuaauaaugacugucucuuacaggcuuuucaggugacuuucacuuuucuaccuuauguaauccuuuaauguuugaauuuugcauaaugaacaguauaaccguuuuuuaaaagcucgaauuuuaacucucugugauggacuuagaugcaggaguagauggaaagaguuucauauucugaccaccccccccccccccacauacacacccccaaccucaaaggauauagaaacuagcagaaggauaugcuuaugugcuuuuaaaaagcaaugccuuuuuuaaagugaugauuuuggugcucgcuuuggcagcacauacccuaaaacuggaaugauacagagaagauaagcauggccccugcacaaggaugacacacaaacuugugaaauguuacauauuuacaaaaaaaaaaaaauauuucaauggucaguaaaugucccaaucauagacaaccagaucucacacaacaucucugucguaguccauuugugcugcuauaacgaaauauacgagucuggguaauuuauaaaaaacaaauuuauuucucacaguucugaagacuaagucccagaucaggugcuggcauucagagucugaggagggcugcaucucacauggugaaagguggaaggucaaaauagggacaaaugccaugucuucacaauggcagaagagagcaauccacuccuguagguccucguuauagugacaggagggcagaguccucaugaccuaaaaaccucccauuaguuuccacuucccaacacuugcauugggaauuaaauuuccaacccauggauuuuaagguauauucagaccauagaaauacccuagaggugauagugaccccauugacaacuccuggccuuuguggagaauggugagggucuacccuuaaugucuguaaagauagauuuagaaaacagaauugacugaaaucgugaacugaauauacauggaagaguugaguaaaguuugcugugacaaccaaguuuagugauggagugaacaauggauccauucacugggaaggggaacauugaaaaagaagcaggacuuagaugaaauuuggauugccuggaggacaucuauagggagcagcaguuggaaagguaggccauuggucgggcuagaaauggauuucagauuguugaaaccauagaugagaucacccagagggaauauagggugaggugacagccaagaguggaaccuugaaggacaucaacauuggaguagagucauugaauuaaaugcagaaaggaaaauaaauaaauaaauagaugcaggaaaggaaagggcauugggagagagaagaaaacaacuagcggagagcagugcaugaaugcgaaagggggaagcuaaauguccaugcggauucagcuugcaguguuguaacuguucauuuuauaugaaaguaauauguuaacagccccccacauaccaccacuuugggauucaaguauacaccaauaauuaccaucagaaggaagccuguccccauagcagguacggauugccacaacccacuuuagaauccugucacugucuggcuuugucccagucacauuaauacuuuuggcuuagcccaaggaauccugcugagguuuauuauaaaccauuuuuuggccagacgugguggcucacaccuguaaucccagcacuuugggaggcugagguggguagaucacgaggucaggaguucaagaccagccuggccaacauggugaaaccccgucucuacaacaaaaauuagccaggcauggugguacgugccucuagucccagcuacuggggaggcugaggcagaauugcuugaacccaggagguggagguuauagcaagcugagaucgcaccacugcacuccauccugagugacagagcaagacuccaucucaaaaaaaaaaaaaaaagaaaagaaaaaaccauuuuuuaauggacaagggaauuguauuugaaagccaaaugaauuauuuuauuaaaauaucuauuucuguucauuuucuucgugaacuucaguuauguccaaaacauaguuaaggcuguuuuaaaacaauauuaagaaaaacuuagaacauacagaaaaguuaacuaacagugaaaacccacacacccaccaaccaucuaaauuuuaaaauuacaauuuuaccauauuugcaaaugugauaaucugacuuagaaguaguuuggggagcagaaaggacaucagugugucuggaccucuaggaucaaggccagaggcugugcugugaguuggagauagguaaaaccuagagggccaugguaaggaauuuggauuuuauuuauuuuaaaauuuuuuucccauagguuauugggauacagguaguaucugguuacauaaguucuuuagugguuugugagguuuuggugcacccaucacccaggcaguauagacuguaccauauuuguaguauucuuuuuucuuucuucuuucuucuuucuuccuucuuccuucuuccuucuucuuccuuccucuucuuccuuccucuucuuccguccccuucugccuuccucuuccccuccuucuuccccuuccccuccuucuuccccuuucccuccuucuuccccuuccccuccuucuuccccuuucccuccuucuuccccuccuacuccuuccgcuccucuuccuccuccuccucaucccuccuucuccuccucuuccccccuccucuucuccgucuugcucuguugcucaggcuggagugcaguggcacgaucucagcucacugcaaccuccgccucccagguuuaagcaguccuccugccucagucccccuaguagcugggauuacaggcacgaaccaccaugcacagcuaauuuuuguauuuuuaguagagacaggguuuugccauguuggccaggcuggucucaaacuccugaucucaggugauacaccugccuuggccucccaaaauggugggauuacaggcaugagccacugcgcccggccuauuuguagucuucuaucgcucgcccgcuuccccacaaguccccaaaguccauuguaucauucuuaugccuuugcguccucaaagcuuagcucccacaugucagugagaacauuaugauguuugguuuuccauucuugaguuacuucacuuagaauaauagucuccagucucauacagguugcugcaaaugcuguucauuccuuuuuauggcugaguaguaguccaucauauauauacauacauacacacacacacacacucaacaguuucuuuauccacucguugauugaugggcauuuggauugguuccaugauuuuccucuggguagauacccaguagugggauugcuggauuaaaugguaguucuacuuuuaguucuuuaaggaaucaccacauuguuuuccauaguggcuguacuaguuuacauucccaccaggaguguagaaguguucucugauuaccgcauccauuccaauauauacuguuuauugauuuuuuaauuauggccauucuugcaggaguaagguggguauugcacugugguuuugguuugcauuucccugaucauuagugaugcugagcauuuuuuucauauguucauuggccauuuauauaucuucuuuugagaauugucuguuuauguccuuagcccacuuuuugaugggauuauugguuuuuuucuuacugauuuguuugaguuuguuguagauucuggguguuaguccuuugucagauguauagauugugaagauuuucucccacucuguggguugucuguuuacucugcuaacuguucuuuugccaugcaaaagcacuuuaauuaagccccagcucuuuaucuuugcuuuuauuacauuugcuuuuggguuuuuggucaaggaauuuggguuuuauucuaagggcagugaaaaauuauugaagaccuuaaccaguggauuuguguuauucccuuaaauuccuccaaauauguauaaaaggaaauacugcugaugauaaaggggagaugagaaagguagguggauuguuauggugaaauauaucuuuaaaccacuggaacccuucucgaaccauugcuacuuccaacuugggcaucuccauacucuagggauugucaguuucaaaacucagacaugugcccaugugcugcacauccuucaaggucacagagcacucugaauggcuugaugguggaccaggcccuuuggaaggcagcgucccccccgggagaaagcaguaccagcugaagaguccacucuuaaaggugccuuugcugucacuugagcauugucugaaggucacacaugauccugugaaggaauuaacuccuguguugcuuaacaacugggauggauucugagaaaugcaucaggcaguuuugucauugugcaaacaucauagaguguacaguacuuacacaaaccuagauaguauagucaacuacauaguaaucuaugugauauagccuauugcucuuaggcuauaaaccuguacagcauguuacuguguugaauacaguagguauuuguaacacaaagcacuaagugauaggaauuuuucagcuguuaugggaccacugucauauaaugcagucaaucauugacugaaaccucaucaggcagcuacaugacuguguaagauauuuaagcuuaaugcuuagcaaaccugaacauaagaaacaaauucuguaaugcagaaguuuuggggaguguuauuuccuuguuuuugccuaccaaaaucuuggguaauuuuauuaagaguugaugagccuaagaacauaaaugauuuuugagaauuauuacacucauacuuuaaaaauaaagaggauaguuucuaacuguuuguuuauuuauuuauuuauuuauuuauuuauuuauuuauuuauuuauuuuugagacggaguuucgcucugucgcccaggcuggagugcaguggcgugaucuuagcucacugcaaccuccccgucccggguucaagccauucuccugccucagccuccugaguagcugggauuacaggcacacgccaccacgcccagcugauuuuuguauuuuuaguagagaugggguuucaccauguuggucaggcuggccuggaacuccugaccucgugaucugcuggccucguccucccaaagugcugggauuacaggcgugagccaccaugcccagccuuuaacuguauuuuuaaaacuaaaucaugaauaaugauuuauuaacuuuaccaauguguuuggauccuacugaggaaugucacuucuuguuuuggguaguuguuacuguguuucuuuuccuccuuauuuaaauuuaagucagggccuuacucugucacucaggcuggagugcagugguacagucaccaccucuuaggcucaagugaugcuccagccucagccuuccaaguagcuggcugggaccacaggcaugcaucaccaugcccaccuaauuuuuaaauuuuuuguagagacagggucucccuauguugccgaggcuggucucaaacuccugaccucaagcaauucaccccaccuuagacucccaaagugcugagauuacagacgugagcugccucaccuggccuguauuucuguagaauacagucuuacuaguucauauguucuguaaaaucuuagcuggcugguauauuaauuaacagaaaugauuaugucaugccuccccuugcccacacagaaguauuuuauauauguguucuuuuugguggcuguacucuuucugcuguaaccaacuuuugguaugugguaggacuuguaaaccucuguuacccuggaaagucacaucuuucaccauugagccagagcugaaaauaucucuguugcauagcaccguaacacuuccugcaaaauaccauuaaacauucccacccuccacaucacugcuauuauuugcagaguuacagauaggaaagauaauauuuucagaggacauauugugagugugauacacuguuuauggagaagcaacuugcaugcuucccccccacccccugccgcccacuccccugcccaaaggaaaaaguaaugauccaggaaaaggaaaagaaugauccaggcuuugugucccaucuggcuuguagagcgaucauaugacagcuaguuaagagugacuccccuaacgucaguucaaacuuuuaggcauagaaaaguuauuuagaaguggacuuaaagauccuuggauuuuauggcugggcaugauggcucacaccuguaaucccagcacuuugggaggccgagguggguggcucccuugaggccaggaguugagaccagccuagccaacauggugaaaacccaucucuacuaaaaauacaaaaauuagcuggguugguggugcacaccuauagucccagcuacuugggaggcuaacgcugaggcacaagaaucacuugaaccugggagguggagauuacagugagccaagauugcgcugcugcacuccaaccugggugacacagcgagacuccaaaaaaaaaaaaaaaaaaaauccuuggauauuuaagaaccuaugacaaaggauaugcauuaaacuauuucucuuugguuaauuuugucaaaaaaggauuuacaaggugacagaagguaagauaggcaauauuugggguuagagauugguuggaacaguucacaucagaacauguugagaaauaacauacuuguuuaugauuuaguuguaggcuugacauuagcauucauuugcauguuuuaaacauucuuuauaaacaaauauguaagucacucuauuucaaacuuaagggaaaaacacucaaguuuguucaucaaaucuuagguaaagcucaaaagaaguguuaugauacuaugcaauggauguauuuuuguguuuauauagaaggggaaaacaaagugggguuggggugucugagagccaccuuuucuuggguguguguggggagcaccuugggcaguuaaauauaggauguugaaacuuacagucagaaaaccacugaucuaagugauccauaagguuuuucuaaaaagugucaucuuucggugucugauaggagacuguuuagugccugugaauuuaacuacuucuaguuuuuuuacugaaaaaugguaacuuccaacauguucccaagucacuuccauuguuugucuuguuaacuuuguuucuucauagugccuucuuggaauaguugcauguucuccuuuuggaugauguaauacugugguuuaugugguugaaauguuguuuucuacuacccacaaaaaauuaagaacuucuagaaguucaucauccucaggguuuuauccagcgaguucuuucauaggagauggucaaauccaggcaaaaagaguacaucuugacaacugucacauaggggauuacaggaucuaaugggagauuuuauuccccuguccaggcuucucucuagcucugagacccugugacugccugaauaagaugggugugccgaggaagugugugccauauucagggcagcccacuggggugcuuaggaggagcagcgugaacaccgggaaaagagcaucuggagagaccuagauaguaggcuguugcuagugcuguuuggcuaaacacccuaccuaacuuuuugccucaguugccucagcuguaaaauagauacuaucaauuugauguacaguguggugauuaaggacgcuuuggaucaagacagaucugagcuuguuugaccacuuaguaccuugagccucacgcucaaccuugcuaaacuucaccaguaaauaggagcaggagauuguuagaaaggguuucaugaaaugaugaguucuagugcucagcaucaggccuggcaguagcaguugcccugugagugggagcugcugcucucuaccucagcagcaucagucagcauguucguccccauuugcgugguuaggagagcaauugauuugaaggaaagaaaaacaaaguguuuugaaaaauacaguguucuguaauucuaagacaucuguguauuaucauuucuugcauauauuuguggauuucccuguuccuacugauuuugaaaguuauguaaaaugacuugccuaaacacggguuuucuucccagauuaggauuuagaaagucugucuuccguugaucccaguguuugcucacaugaaccuugugcuguguucuagguagcacaggcggagugcagcggaggccccugccgcugccgucaugccguucccguuugggaagucucacaaaucuccagcagacauugugaagaaucugaaggagagcauggcuguucuggaaaagcaagacauuucugauaaaaaagcagaaaagguauggauuuggcuuuauuuauauuugaaauaucuuaauuagcaaaugcaagacaccuuauaugaggaaucaguaagucccaauuuggguuuauuuuggauuuuaaaaauaacauccaaaagcaacauaugcugcuguugcaacauacuuuuucuucuguauuuucgucuaacaaauagauuucuaacuguucugucagguuuucgaguuuauuuaaauuguguuuauuucaucuugaaguguuugauucuaauuuauuuauuuauuauuacuaauuauuuuuguagagacaggguugugcuauguugcccaggcuagucucaaacgccaagccucaagcgaucuuuccgccucugccucccaaagugcuaggauuacaguuaucaguuaucugcuugguugguuuguuuguaaaaguuuuagagcaagaacaaaaggaaguaaaguauacuugaaagaaggccaagcaggcaacuugagagcuauaagugccacaguuaccugauucuugaaaucgguucuucccccacaaucuuccugggaggacaccccuccugguuuucuuccuguauucaguguauccgugccaaaugccuccaucuacccagucaccacaguccaaaacccaacuuucaucccacuugugacuugcccucucuucccuaaaauauaauuuuucacuaaaucuuguucaacucccuaaauuguuuaugauucaguucugacuuccauuccuucuugaagaaguuguucauacucuuugugauuuuagcaguagccuucuuacugcacuuucuaaaaaucucugcuuuacauuuucaguguagauucuucuuguaacacacaggaucuucgugaucugaucuuuauuucucuaaguaaauuguagagguuuagugucacuuauccaaaaugcuugggaucagaaguguuucagaguuuggauuuuuuuuuuuuuuuacuuuggaauauuugcauguacauaaugagaucuuggggaugggacccaugucuaaauaugaaauucauuuauguuuuauauagaccuuguauacauagacugaagguaauuuuauacaauauuuuaaauuugcauuaaaugaaguuuguguacauugaaguaucaaaaggcaaagauguugcuaucucagccaccaaugucauagucucugguucuguggcaucaucaucauuccugacucugaauuuauaugcuaccgauaagcagucauuuucuuacacuuauucacauguaaguacuuaacuguaaaaaauaugacauaccauuaauaauaccaggcuggagugugaugguacuggaacuaaggugguaccuuaguucaggguaacuaagcagcauaguuguuguaucacuuguaucuguuguaaccucuuagaaugucauaaucauuauuugauuugggauuucugucauaaggauuauacuucaguguaguacggaugcuuucaggugaguuugaggaguauacaacuaauuauuccuacucuaaaugguccuggcuucgguaccuaugaguuaucauuucuguucugucuguauuuuccuuuauugcuuauuaucuuuugguaugugcugcuggcugaucuuaagcuuacccagcuuccuugcauuuucucauucuguucaauguuucuaaugcccuuuggacugggaaacuagauuaauugaaacaauuuauaauaagacaauauagauucuaagagaacuuccuuggguaagguaagugguacuguuuuuuguuuguuuuuuauuuguuguuguuguuguuguuguuguuguuguuguuuugagauggagucucgcucgguuagccaggcuggaguguaguggcacgaucucagcucacuguaaccucuacguuccauguucgagcaguucuccugucccagacuccagaguagcugggacuacaggugcguaccaccauguccggcuaauuuuuguaguuuuaguagagacgggguuucacuauauuggucaggcuggucucgaacuccgcaccucaggugauccaccagccucagccucccaaagugcugggauuacaggugugaaccaccgugcccagcugguaagugguauuguaaacgcaggauucaaguacauuucucauuuuauuggucaauggggauauaaaaauaugaaaaguuuagcuccagaaacuagaaacaaagugaccucaagaaguuagaggggacuuuugacugaaccacauuaacaucuacuaacucagaggguaauagcacauaacuugaccucccucucacaguuggacaucuucaacuuuaggaagcacucagcaguccugauagcccuacaggcuuugcaccagguggaggcagcuaacagccagcaaagagcagagguacccaagacuggccucuagaggcagucgggagagagcagaccccacagaguagacaugauacaugucugcuggaacugcccucaguggcuauuccuuaauccuuaucuuaaaacugcaaauugaugaaaggauaauguguaugucccauaaauuaaaaaugguucaucuuuugucuguggcuaaauauguugucuacucauuacauucauucuauucaucagaaucguacugaacaccuaaaugcugggucagauuuuaggcacuggggauauaauacucaauaagaugaacaaggucucugcucuuucguagcuuccguucuaauuaagaaagcuggacaguaaauaaguaaacauagcugaaaaagaauuucaguuggcagcaagugccacaaaagcaauagaauguacugaugugaugauagagcacauuucuuaaacuuuugggucucaagaccccuuuuauacucuuaaauuauugaggacccaaaagagauucguguaaguauagguguguuaucuauugaugcuacccuauuacaaauuaaaacugaaaaauuuaacaauauuuauuaauacauuuaaaaguaauaaacucauuacaaguuauaaauaauguguuuuaaugaaaaauaaccauauuguccaaaacaaaaaauuuagugagaaguguagcauuguuuuaaguuuugaaaaucuccgugucuggcuuaauagaaaacagcuggcuuaucuuagcuauguuuguaaucaaacugcucaaacauuauuuugcuuuaaguauauaaagaaaauguauacuuaaaguugggagugguggcucaugccuguaauucugacacccugggaggccgagguggguggaucacuugaggccaggaguucgagaccagccuggccaacauggcaaaacccuuucucuacuagaaauacaaaaauuagccaggcacgguggcacacgccuguaaucccagcuacucaaagagacugaggcacaagaacugcuuaaaccugggaggcagagguugcagugagccgagauggugccacugcacuccagccugggugacaagcgagauucugucucaaaaaaaaaaacaaagacgagaaaaagaaaaccuggucucacagcuguguaauuagaaaaaagagcaguauuuuaauagccuuucagauaauguaaaauauuuaauaccaugcaauuggugguuucuugauugcauuacagaacauuaaacuacaugaaugaacuuuuuauacucuguacuuugaacgaaacuuuuaccaguacaugauuuuauaacauguuuugguuguucagaaaguacaaaugguggcugggcaugguggcucacaccuguaaucccagcacuuugggaggccuagucgagcggaucacuugaguucaggaguucgagacuagcaugaccaacauagugaaaccuugucucuacuaaaaauacaaaaauuagccgggugugguggcacgcaccuauagucccagcuacucaggaggcugaggcaggagaauugcuugaacggaggaggcagagguugcagggagccaagaucgugccucuguacuccagcgugggugacagaguaagacugucucaaaaacaaaaaaaaaacaaaacaaagaaaguacaaauggucccugacuuaagauuuuucaacuuugcaauguugcaaaauagguauacauucaguagaaaccauacuuugaguacccauacaaccauucuguuuuucacuuuuguaacaauauucaauaaauuacaugagauauuccacacuuuauuauaaaauaggcuuuggguaagaggauuuugcccaugauaggcuauuguguuccaagcucauuuuagguaagccaugcuaagcugugauguucugugaguuggguguguaguacaugcacuuuugacuuaacaauauuuucaacuuuugauggguauaucugcauguagcuccaucaucaguuuaugaggagcaucuguguuggaucacugacauauacagaucucccagauguugacacauuauacagauuauaaaaauuaacauuuuuaaauaacaccacugaucucauuagaagagucuuaaguauugggauguggucaagcuuauucaugaucuagucaaauuucagaauucagauuuggcaacaaauauaguuggucguuuuccuugaagugacagguucauuuuauucauuuuagagaaaauaacugccagauaauucaagucugaauagugugucugucugucuuccaauaacaaaagcaguuaguugaacuuauagcugaaauaaucacacaagggcuuuucuuuaagauaaccauucuauaaggagccaaagguacuuuauauguacaugccauuuguuaacuccaaguguuaaaaauauuguauguauauucaaaggucaagauuuaauaaaauuaaauuuuuacugcuucaggaacauuccuaaguuggaccuuuuuuuuuccuuuuuugagacggagucucgcucugucgccaggcuggagugcaguggcgcagucuuggcucacugcagccucugccuccuggguucaagagauuguccugccucagccucccaaguagcugggacuacaggcgugcaccaccauacucagcuaauuuuuuuuguauuuuuaguagagaacaggguuucaccauguuggccaggauggucucgaucuccugaccucgugauccacccgccuuggccucccaauggacugacuuuuuuuaacugagugcacggugaugaagacugcaauaacugcuauuaaaguuuggcgucacugccuuuguucaugcuugguucaugauggugucagcaccaucaguauaaauagcaauacagagggaggaagcacaugucuuaugaaaacagccuugaccuuacagacgcuuugaaagggucuugaggaccucaaggguccgcacuuugaaagguacuaugauaguuaaaaggcuguguaugagaguggcugcagguagggagaauguccuaauuuagguagguuauguagggaaagucuuguugagaaggugacauugaaaaugagucuugaaugauagaaggcaaguuuagucucugaugcaauccauaucaucugcuugacuaaaugagugauuuucaaccaggggcaauuuugcccugaaggggacacuuguaaugucaggagacauuacagguuguaacacuaggggaauacuacuacuggcaucuaguuaguacaggcuagagaugcuguuaaacagggaaugaauagcuccccacaacaaaggguuaucuagccaaaaaaauguuaacaaugcugagauugagaacuccugcccuaaaccagcauugaacaagaauagacauuucgcuauuaggauaaacaaaacaaagaaaaacauuugaauuuauuaaaaauaaauuuuaguucaaagcaaggcauuucugaagagcagcccaugcaaauuacuuaugcugaaauaguuuaagacuaggagggaaaaacccuggaauuuccaguucacuuucuuaucaggauucgaaaggaaguagcaacuaaugcaaauaacgaagagaguacugagaccugaaaacaauggaaagaugaaaauccauuacuaauugaaaacagugaaaaacaacugaugucauacugaaaaucugaugacuauaaacccaggugcuugcgaccuguugagcauuguucuggaaauucuaaucaaugcauaaagaagugguuuagaaauaaagaauauaccuauugcaaguaaagaggggaaauuauuguagagguauuuauaaacauuuacaaaauacaagauaauuaaugggaaaaaugagaguuuauuaggagagagagagacuaggaaguacuacagucuuuaaaacaaccagaucucgcaugaacucacagugagaacucugucauuaccauggggagagcaccaagccauucaugagggauccaccuccaugauccaaacaccucccaccaggcccuaccuccagcacuaggguuauguguuuucuugggacagggucucacucuaucacuuaggcuggagugcaguggcacgaucaucgcuugcugcagcuuccaccucccgggcucaaucaguccucagccugccaaguagcugggacuacaagcaugugccaccauguuuggcaaauuuuucuauuuuuuguagagaccgagucucacaauguugcccaggcuggccuugaacucccgggcuuaagcuucagcccaguuggccucccaaauugcugggauugcagguaugagcugccaugccuggccuggggguuacauuucagcaugagauuuggagggaacagauaucccaaucauaucaccaaccauaucuagaaaauguaauuuuacaagaaaguagcucauucacuauagcagcaaaaaaauaaguauaagauguccaggaacauuuucaucaggaaguacgcugaacccauaugaagaaagcucaaggauguuguucagagguacaagaauuaccuggccuauguuauuagaaguaaauauggaauauaguuaaaaugccauuucuucccaaaucaugcuuaaagcaauucuauucagaucacagcaggauaauuuugaagcuuuacagauagaaguucuacucuguuuugaagcaaaaugcauacuucaaaaccuguuccacucacauucuucaugcucaucauuagcauaacucuauccuuuccguuuuucaggccaaaagucuuaagggucacccaugacuauuuucucacuccccaaaucuauccacuuuaucuggagaaaaaaaaaguccagaaucuaaucccuucuccccauuuuccuuguucccacugagcuguccuuuucucugcccuggauuacuguaguguccugcucacugcuucacuggucucccuugguuucccuacaaccauagugauucuuucaaaacaugagucaaauaauauauuccuuagaguaaaagucaaaguccuaacaggggccuaaaguaauuucugcaggcaaauccuguaaggccuauuuuuaucaaucucgugagcuaagaaugguuuuuacauuuacagaguugguuaaaaaagcaaaguauaugaggcagagaccuuauauggccugcaaagucuaaaauauuuacugucuauuccuuuacagaagaauaaaugccaacuccugcccugagcaaugaggcccaugacuuuaugaucuugucuccuaauacucuucaccacauuggucuccuuuccucaugcacuccagucauacuccugccuguuggagaccuuugcauuuggcuuuuuccuuugccuggaagguucuuucccuagugcucuauuuggcuuaccuccuauauuuuucaagucuuugcucaagugccauuuuucacccaauccucuauuuaaaaugcaacccuaccguguggcauuccucuucccccuuaucuugcucuaguuuccugugcacuauacguaaugauauaugcuugcuauuuuccccuuguuagaccaucagccuuucaaagauagagcucaacaaauaguuguauuuauugaaaauggaaucaaaaacagaguuacuaauaacaugaaacacagucaucuuguucucuucugaauucuuaaucuuaucugaauuaguuaaaacagauauugcuaagacuuauaagaguuuauauauugaauuugugacugaggagagaguaccauagcuagguauguucucuggauucugugaugguggccaacuacuguauuauauuucuuuucagugcuacugcccacaguaguaguaagauaaauguccuuucucaagagauauuuacuggugguccugguauuguccauacagguuuauguucaucaucuucccuguaguuaagggugaucaggggacauuuuucccuauuagauaaauaaucauaacugauggaugugaugauugagucacugugagcuuguuggcaggguuuuggugaucuaggacaguucucaagucuaagcugacauucauugugauuaaguuauaugaagagaauuaaaggguuuaauuagccaaguuugugaaagacaaaaauuggaggagaauagcacauucuaugggugacuaaauuaggcaccaaaaacgggucaauuagguggagguggugggucagugguuagagggaaugguuaauauuaauugacaaaacacaguacaaauaaaaguaugacucuguauguaaaaaaacagaccaugugucaaaaagaaaccagaaucauuaaaaacacuugauuaauuuaaaaaggcagaaaagggaugaagggaauuaaauaacagaugugguauagaaaacaaauaguaagaugauagacucagauguacuguaucaguaaucacauugaauauaaauggucugaauaaccauuuaaaaaacagagauugucagauuggaugaaagaaucccuacuauauggugccuauuaaaaaauguacuuuacaguuagcaacuuaaaauagguuaaaaguaagaagaauggaaaaagauaaacuuuguuaacacucauaaaaagaaagcuggaggggcuguacuaauagcagacaaaauagacuucagagcaaagaauauuaccaaggguaaagaaagucauuuuaugauaaaguaggggugaaauguuccaacagauauaauaauucuaaacauuuaugcacuuaguaacagaguuucaaauuaaagcaaaauaaaaccugauagaacugcaagaaguagucaaauacacaauuaauaguuggagauuucaguaccccacuaucaauaauugauagaacaagcaagcagaaaaucagcaaggauuuucuagguagaccagaaugguacugucaaccaacuugaccugauugacauuuauagaacacucaacaacuguggaacacaccuacacauucuuuugaaguucacauggaagaucuaccaagguagaccauauuuugggucaaagaaaaaggucucaguacauuuuaaaggauaaaguuauacaauggauguuccaagacugcaauagaauuaaauuagaaaugaauaacagaaaaauccuuagaaaaucccaaaauauuuaggaacuaaauaucguacuucuagauaacucauggaucaaagaagauauuagaaaguaguuugaggcuggacauaguggcucaugccugucaucuuagcacuuugggagacugaggcaggcaaaucacuugagcucaggaguuggagaccagccuggccaauguggcaaaacccugucucuacuaaaaauacaaaaaaaaaaaaaagggccgggacucgggaggcugaggugggaggaucgcuugagcccagggguggaggcugcagugagcugagaucacaccacuugacuccagccuggcugacagagugagacccugucucaaaaaaaagaaaguaguuugaguggaauaaaagcaaaaauacaucucagaauuagugggaugcugcuaagcuuuacucagggaaauuucuagcacuaaauaucuauguuaaaauauauuuaaaaagaagaaaggucugaguuucuaccuuaaaaacuagaaaaacaagagcaaauuaaauacaaaguaagcaggagaaaggaaauagcuaucaaaacaaaucaguuaaauagaaaaaaaaaauuaaaagaucaagaaaauugauaaacucuagcuaagacugaccaggaggaagaaaacacaaauucccauuaucuggagugagagauuccuguagugacauuaccacagauuguacaaguuaauagggaauauaugaacaacugcaugccauuaaacucaacagcuuagaugaaauggacaaacuccaaagacacaaauugccaaagcuaacucaagaaaaaauagauaaccugauagcccuauguaguuaauacccuuccuuaucacagugaagacucuaggcccagauggcguuguuagagauuucuaccaaauguuuaaggaagaaauaauacaauuucuauguaaaccuuuccagaaaauuuaagagaaaucauucuuaacucauucugugaggucagaauuauaaucaucgccaaaucagacaaagguauuacaauaaaauaaaaccuacagacuaauaugucucacgaacauagaugcagaauuucucuauuuuagcaaauugaauaguagaccaagugggauuuauuccuagaaugcagagcuaguauaacauuacaaaguuaaucaguauaauucacuauauugaaaaaguacaugucaauugaugaaaaggggaaaaaaaccagcaucuauuccugauaaaaaaaauaaucucagcaaacuagaaauagaggaagggaauuuucucaagcugauaaagggcaucugcaaaaauccuacagcuagcauuauacauauggugaaaggcuaagucauguuaucucugagaucaagaagacgacagggauaucuacuuucaccacaacuauucaacuucguacuuggagguucuagccuaugcagucaggcaauaaaaauaaauuaaaggcauucagauugaaaagaaagcaguaaaacuuuugauuuguaaaugacaugaucaucuacauagaaaaacugaaggaaucuacacaacuaguagacuaguaaauaaguuuagcgagucacagguuauaaggucaauauacagaaaucaguuguauuucuguauaguagcaaugaacaguccaaaauugaaauuuaaaaauaccuuguauucaagaguguuagguguaauugggaaaaaagaauggaaaaaaagaaaaagaaaaaaacuagcauuuagaauagcaucaaaaaauaugaaaugcuaaaaauaccauuuagaauagcauaaaaacaugaaauagggauaaaucugacaaaggaagugaaagaguuguacacugaaaccugcaagauacugcuaagagaaauuagcccaaauaagcaggagauacauguuguucauggguugggaaacucaauauuguuaaaaugucacuucucuccagauguaucuagagauucugugcaauuccagcaggauuuuuaaaucaaagaguuuguucuaaaauuugaauggaagugcaaaagaccuggaguaaucaaaauaacuaauuaaaacaaaguuggagggcucacacugucugauuucuagacuuaaaaagcuacgguuguuaaaacaguguggugucagugcaaagauagauauauuaauggaacagauuggggugcagaaauagaccuacacauguauggaacauugauuuuugacaaaggcauaaaugcaguugugcagaaagaagguaguuguuucaacaauuggugcugaaacuauuuaguaggcagaaagauaggacucagaccucauaccauauuuaaaaauuaacucaaaauggaucacauagccaaauguaagaccuaaaauuauaaaguugccagaagaaaaucuuugugaccuuggguuaggcaaauaauuuuuggauguuaugcaaaaagcacaauucauuuuaaaaaaaaugauaaauggaauucauaaaaauuaaaaccugcucuucagaagacacuguuagaagaaugaaaaagacaaaccacaaacuggaagaaagucugcaaagcauauaucugauaaaagacugcaucuagaauauauaaagaauucucagaauuuaacaguuagaaacaauccaguuaagagugggcaagauacucauauaugcauuucaccaaaggagauaggcagaugucaaauaagcccuugaaaagauguuaaucauuaggaaauuguguaguaaaaccauaaggagauuccacuacacagcuauuagaguggcuaaaauggaaaauauugacuauaccaaauguuggcaaggauacagagcagcuggaacugcuugugggaauauaagaugguaugacuacuuuggaaaauaguuuggcagguuuuuuuuuuuuuuugagacgaagucucacucuguugcccaggcuggagugcaguggcacagucucggcucacugcaagcuccaccucccugguucacaccauucuccugccucagccucccaaguagcugggacuacaggugcccaccaagacgccuggcuaauuuuuuguauuuuuuaguagagacgggguuucaccguguuagccaggauggugucgaucuccugaccucgugaucugccugcuucggccucccaaagugcugggauuacaggcgugagacaccacgccuggccuaguuuggcagcuuuuuaaaccaaacucgaaccaaccauaugaucuagccauuuaaguauuuacccaagagaacaagaaauauauguucaugaaaagacuuuugcuuaaauguucauagcggccuuauuuguaaauggcccagacguguggauaaaccaacuguaguacauccauguaacagaguacuacucagcaauaaaaaaaaaaaaaaaaaaaaacuauugcuguauacaacagcauggaugaaucucaaagugauuauguugaacaaaagaagccagacuauaaagagcacauaguauaugauucuauuugcacaaaacucuagaaaacaaagcuaauccauaauuacagaaagcagaucagugguugcuuuagcuuugauaaagauguuuaggggaaggguugcaugguagagggagggaaccacaaaggagcauaaagcuuuuggugguuacgguuuuggugguuacagagguguucacuaucuugaugguuucauggguguauguguauauauauauauauauguguguguguguguguguguguguguguguguguuacauuagguacuuuaaauauguggaguucauuguaugucauuuauaacucaguagugaauaaaaaaagacuguuuauguaccaacuggggcagauguggcuuagaaaccauaaagcacccagaaaggccauuggaaggcuagauugcaauacuugaaauacacuauugaaauucagcgauuaucuucuacucuguauaggcaaguccacacuugaggauguagagaaacugcagugugccaagagaggagugaccaggcugacauagaaauucaaaacucuacugugaggaacaguugaaugaccucaagaugugagguacagccuagggagaagauuugagcagaguaauguuguagggcggauuugcucuuaguaaaauguauuugggagaccauauaauguaacaaaaggauucgaacugaucguggcaggagguagaauucagacccaugaguggaaauaaaacaagaaguccaauuuugucuugauauuaggaaaaacaguaaguggaagcugacuuuuucagaagacagcaaguuuucuguuucugaagagguauugacauggacuaggugaccacuuaguuaaguauucuagaaggaauucaagcuuugcacuguugacauauccuuacaucgauauaccaccauacuuugcaaggugccuuuguauagagucccccaucuuauuuugagauagaauugauucugguuucccgugauccagaugaagaaagcuguuauuuacuaggcuuauuacuuugacucauuauauuagagucaaagacggaauucacaccuagcucugccaaauccaugguaaaauuaugccuuuuuccacuuuauucauuaugucccugggcuuuuuccauccauuucuugugaucucacagacaaaaugauaaauauaacauuugaguguuuauuccuuuauuuguuauauguugguauuuguauuuguuuuauaugguacauaguuaccacauuaagaauuguguaugauacaaauagauuagucucuuaggagacuaauucuuuuaaaagaauucauacaaaacuaauuuucuuacauuuuaaaaaagcgguuaauguuaccauccuuauuuuuagguaacuaggggcagggguggggugggacuuagucuuucacugccaacaaccaaacagaugugguguauguggggacuauuuacgcacucuucgcccaccacaugcuguauaaaggagguauggcugccuugcucagcuuauaggugguucccuuccuuacgaugaaugcuuguguucacaggguugaauagcuauauucacucauuucaugagaggaguaaguuugcugacauauuuuaagaggggggaaagggaguagccucuucauagcauggccauuuaacagugacucaugguuacuaaacuuguuuacaguaaucuuggacaccagaagguuauuaauagacuuuccuuaguccaugaucauucagcuuagacuaugcagacauuuucuuuaguaaagagguggggguugggggagguagaaagcauuuaucacuggaauuaaugugauaauagaauuguucuuauuaucaaauacuuggcaccaacaguaucugucaguucacuuuuagauuccauuucacaucuuggucuucauuuacuuugauauagaacuuucuuuuuucaacaaggucauuuaaucucuucuuguagaaugaauugauauuucaggcaguaaauauaaauggguaaauauuuagaggacucuuguuuaaaaugauucuuuuguuaaagauuggguuuaaagaaacucaaaaaaaacaaaaaauaauaauuuaagccucaucauuccccccaaaucugagcucuuuaaggcauuucuuuuuuucuuuuuucuuuuuuuuuuuuugaaacagacucuagcucuguugcgaggcuggaguguaguggugugaucucggcucaccgcaaccuccgccucccggguucaacugguucuccugccucagccuccugaguugcugggauuacaggcaugcguugccaugcccagcuaauuuuuguguuuuuaguagagacaugguuuccccauguugaccaggauggucuugaucuccugaccuggugauccucccacuguggccucccaaagugcugggauuacaggcaugaaccaccacaccuggccucuuugaggcauuucuuaacaauaacuaguuauauguaaguuagaaucaauucaguuauguaaacuaaugaacacagguauggaaaauuuugcuaaauagaucccuucaaaauuauuucuaaaaagaugacuuaacaguggugcgcauuggaguuaacguuuuccucaugcaugguugccuuuguuguugucuacugucuuuacuugcaucauuaucucuugcaagagauccccaguuugauugaauccacagacauuuuagugccucucugugugggcagauaggcauaggagucaaaccuuguccccguucuuaaaaaaguauauaauccaguagaggagauacacauguaaauaauauaauauagagggacuugggggcgcagauaaaauucugugggaaccaagaggauaaagcaguuccuacgucugucagagacagauacagagaugacagguuugaagugacguuuaagcugauuuuuaagguuuuuggcaggcaaagugugaaagggaacagaauuugaaacaaccuauggcauguucagaaaacagugacaaguucagugugacuuuaagagguggagauaaagaggaaugguaggaaguaagacuagagaaacaagcuuugguagaaugaaaagggccuuauagacaaccuaaggguauacugagggggagugcaagaggucuuacgcuauagaagucuuauguugccuuacuuuguuuuguuuauuuugaaauuaauuaauucacaggaaguugcugaaaugaguacaggagaacccauguaccuuucacccauauccccagugguaaccucucacauaacuauauacaauaucaaaaccagagcauugacauugguauaauccacagggcuuguucagauuucaccaguuuuacaguuuguguggauaugcauauagcucuaugcaauugcaucacacuuaucuguucuccaagucuauacauuuuauuacuucaagaauguuaaauaaauagaaucauauaguguguaaacuuuugagaugggcuuucuuccacucagcaucauucccaugagauccacacaagugguugugagugucacuaguucauugcucuggagaaacaaguaggucaugguuccaggugcucugucucacuucauccacuuuuuuucuuccccccccgagauggagucucgcucugucacccaggcuggcaugcgguggcacgaucucggcucacugcaagcuccaccuccuggguucaugccauucuacugccucagccuccccaguagcugggacuacaggcgccugccacgcccggcuaauuuuuuguauuuuuaguugagacgggguuucaccguauuagccaggauggucucgaucuccugaccucaugauccgcccgccucagccucuuaaagugcugagauuacaggcuugagccaccgcaccuggccuuucauccacuuuuuuaguuuuacuuuauucuaacuaguauauuggaauucuacauuguguaguagggaaguguguaugagugugugcgagaaagaucuuuguuuccuucauagauucuaauuuauuucuguaucuauacaaagucauguucuaaugauguauaugauguauguucauucccccaaaaagcagaaaauacaagacuauaaagaaaaaaauuaaguuuauccuuaauucaguaccacgugaaaugacuacuguuaacuugguggggauucucauucauauucuagcuuguuuucucccucucucuggggcagauaaguaaaugaguauggggucaugcugcucuguaaccuguugguguuuuuuuuguuuuuuuuuuuuuaauuuuaaauuuuaacaucuuuucaugugcauauagaucucaauuuuguuuuuuuuuuuuuaaauauggagucuugcucugucacccaggcuggagugcaguggcauaaucucagcucacugcaacuucugccucccagguucaagcaauucuugugccucagccucccaaguagcugggauuacagguaccuggcugauuuucauauuuuuaauagagaugggguuucaccauguuggccaggcuggucuugaacuccugaccucaagugaucgccaccuugaccaccucccaaagugcugggauuacaggugugagccaccaccccuggcccucaauuauuuuuaaagccugccgugguucuuccauuuuauggguacguaaugauuaaacuaguucagugggauaacuuuuacuucuaauucuuugcuguuguaaguaacacugcauguacuuaccuuuguguacuugucuguuuccauaggguaaauuccugaaaguauaauucacaggaaguugcagaaaugagucagaggccuugcaccuuuuaaaacucuucaauaacauuuugccaaauugcccuccaguaaaguuguaccaauuuauuuuccuaccaguggcguaucuaaaagccuuugccucugauaagaaggaagaauauuuuauccuuuuaagauuguuacuauuacuaugaaauagaaucuuuuguaagguuuuuaaugucugacuuagccauuuguauacuucagcauguuacuauguuugucuuuaagugugcuuucuauauugagguuagaauugcuacuaacuacuaaaaauuggggacagugaagagggcagcccagucuuguaucucaccaaguaaaguccugucccuucauguggaaguagccuucuugucaccuuguuuccuaacguaaggccgguuuggaucuacugagugcuugaguccagaggaggaguguugguaagggcugugaguacuucaaggacauugcauagaagcacuaauggguaugugagcugucuucucgagucuucugaaauuguacuuuuguaucacuacuuuuuaucagcaauugccucuagugacaguaaaauagugcacugauagguaccgugggaauauuggauuuaagucaagagaguuaauacgaaaccuccugagguuuuggugaucucugaaaaggccauuuguacuaauguuuagcuuacuaauugcuuauuuucccacccuguuuuauuuuuuaaugggaaagcaggcagugaaaaaucucauagccuuagugcuacuugaagagguuauuauggacucuauccuuaaaaauuugaaguccuguuacacguuacuuaacaacagggauacauuccaaaaaaugcaucauuaggcgauuucuuccagccuguugcuccuaggcuacaaaucuguguagcuuguuacuauagcgaauacuguaggcaguuggaacacaauggcaaguauuuguuuaucuaaacauagaaaagguacagcaaaaauaugguauuguaucugugggaccacaguugucucuguggucugcuguugaccaagacguuauguggugcgugacuauaguuaccuauguccucacccugggagggaaaguuuaguuucugauacuguuauuagugaggugagcauuaggugugaacuuugggauacugguuacuacuuaaguugauccuaacacuuaaauauuuuaacuuuaaaaaauuauuaaauguaauuaaagaugaaguuguuaucauuugaucauauguggaagucaggcuccauaguuuagaauuaauaugccuggccccaugggacauagggacuucaccucucaacucagagccuugaucugagaagcuuugccaagccccagacccuuuccucugugcugugcucuuuuggagccuccacacucccaccacauacggcugcucuguacagccacacaggaugaagcacuucucagaagccauaaggaaacagcuaagaacugaaacaaaacucuguaccucccucccagacgagucagcaguaagggaugauccgcaucucuuucuaggcaagugagugggcuuguuauaaaggggggcuguucucuuaugccuuucuucuugaccaugaucuauaaaacaguuggcuacuuuuaauaaagcagucugcccaugaaaaguaauaugaggcuaacugguacauagaaauguagcaucugugucuuggaacaccauguucaacugaggaaacuucccagacaauucagucaguuaacaaaaucaucaggucauuccauguguaaauugccaucauaagcgcuuuccaaagcccuugaauguguuagggagaugagagguaugugugaaagguuauagcacuuacaaggucagcaacugaaauaaggucacagcugcuguaggcaucagaggaggagagagucaugggagggaggagagucuuccuggaugcaggagcucuuaagaguggaaagaaggagugugagcauucaggcuuuuauguuagcuugaguagagacagagauguccagggugagagaaggaauguagaugacagggcaaaagagaauugaagaccuuuauuuggaguuugagaucuuaaagaaauggaaugggucuuaggggucaucugguccaguucccuuaauuaucggaugguccaguaagacccaacagguuuccaugaggccacagaacuggcacaauugcacaggggguaccugagucaaagcuaaccuccuuuuuguuugggagcccuuucuccagugcacagagagagccaucagccuuggaacuaaguaggaugccccuuaccugugaagaaaaggcaaaaagauuauugaugaacuuaucagacuuacagaaugguuuagaagagugccuuucacccagccucccuaaauguuaacgucuuuuauaaccacagggcaaugaucaaaauccaaaaaauaacauugguauaauacuauuaacuaaugcacaggccuuuuucaaguuucaucaguuguccuacucauguccuuuuucugaaccaaaaucuaauucaggaucacacguuacauguaaggagucguaacaucucccuaggucuccuuuaaucugaaacaguuccucagucuuucuuaugacuuuuaugacccuugguacuucugagaaauacuagucagcuauuuuauagagugucccuugauuuagguuugccugauguuucuucaugauucaaugucgauuaugcauuugcaagaauaccacagaagugaaguacccuuuucauugcaucaguucaggaggcagugaugucaauagucucauuacugaugauggucaguaacaucauuugguuaagguggugucuacuggaaaauuacuauuuuuccuuuugucauuaauaaguaucuuggagccaggcucaguggcucaugccuguaaucccaacacuuugagaggcugagggggcugauaacucgagcucaggaguuugagaccagccugaccaacauaaugagaccccauugcuacagaaaauuuaaaacguggucagacauggugguguguaccuguagucccagcuacucgggaggcugaggugggaggaucacuugagccugggaggucaaggcugcagugagacauaauugcaccacggcauuccaccugggcaacagagcuggaccugaucucaaaaaaaaaaaaauuaucucgggggaacugagcaucucuucuaaaaguuucucaggugauucugaguguguugacaaguuugagauaggaugcagaaauacaucaagauguagugaagaaguugagaauguuuuaauuagaaagucuuauguuaauauaggaggagugaagcuagauguucagauaaaggaguaaagagagacuaauggcucuugaggaaaguggagccgucuugaaauaugugcugcugggaguuacugguuggaaaucagcccgguuuaaaggauuguuucugagcugcuuugaagucgaaugacaugguguauuggugaaccgaaugugcacaaguuccaucacuuuuucuacagugcucagaaauuugggagcucaaguagagaaagauuugaauaaagcacauuuaagauuauguaggggagccaagagaccuugagcugcucgcaugaguggcacugaaaugugcaggcuuggcaggaccuggaauguggucauuaaggguucaguggauuaggugacaugaugauucagcagcuugaaaaggauacaguguuuggaggagcuguaagugugaauaccuuacucaguaggugugaggggaccaauggggugguaggagaugagaaggaugugguuacaagggcagagaauauauugacacaaugccugcaggccagagguggggcccuaggcauagucccuaaugcaagcugcuaugaagggaaccaagucaaaacuaaacaagaacaaccaagguuuuguguuuuguuuuguuuuuuuccuucuugaaacacagucucgcucugucacccaggcuggagugcaguggcucaaucucggcucacugcaaccucugucuccaagguucaagauagucucgugacucagccucccaaguagccagggcuacaggcucaugccacugcacccagcuaauuuuugcauuuuuuaguagagacgggguuucaccaaguuggccagguuggucucgaacuccugaccucaggugguccgcccggcucggccucugaaagugcuaggauuacaggcaugagccaccacucccggccacaaccaaguuuaucuguugugugugugucaucuucaguuaguaaauacuugcuaaauugccuucucuugugaaacacuuauuaaaauuuucugaucaucuuuugguaauauuuggauauauuuuucaagcuuuuuguuuaaucagcuuauaauuguccaugguuauuugguuauuuguuagaaaucuuuaaaaugugggaggggggaugucucguggggagggcugaaaaaggagaaauggaagaagaaaucaaugaguaccaacauaaugaucauuuugaucuauauaauuuaccucaucuuuuuuuuucuuuuuuaaauaaaaguagaaugugaauugugagaaaaaauauucaagcaagucugaaauggagcaaauacucuucuuacuccaccccacagguagacgaccauacugaguuugauguguauucucccagaguauuuucucugugagaccauagggaauuacguuguaaauugagcacaaggcaaaucacaaccaaacuuaaccuuugaaaacccuuuaauuguccauacagagcaguaaacaguguggccguacugugacucaagauuuccaacaccgcaaguauuuccuccaacauugaaacagacugcuguuucuuucuuucuuucuuucuuucuuuuuuuuuuuuuuuuuuugagaagaagggagucucccucucugucgcccaggcuggagugcagugguggcucacugcaagcuccgccuccuggguucacgccauucuccugccucagccuccugaguagcuggcacuacaggcgcugaccaccacgccuggcuaauuuuuuguuuuuguuuuuguuuuuguuuuuaguagagacgggguuucaccauguuagccaggauggucucgaucuccugaccucgugauucgcccgccucggccuccaagguguugggauuacaggcgugagccacugcgcccggcccagacugcucuuucuuuaguggagcaccagaugcaguaguuggcuuucauugggcucagcuuggggacuuguccacacuaugagcugugugugcacacugagacccaagcucuggacauaugcucauuaagugaaauggccagcauugaaucacucagccagucucuuuccuuguucagugcuguaacucuuuguuaggaagacaucugcuuguaauucuuuagcuggcucccuuccuuugaacugcaguuauuuuuucacaucucaggugauuuauuucguugcccguucuuagagggaagucuguucuugucuaguuuuguuuuguuuuguuuuguuuuguuuuguuuuguuuguuuugagacagggucuugcucucgcucugccauccaggcaguggaugaagugcaguggcaccaucucggcucaguucaaccucugcaccacuccccacccccaccccccaggcucaagcaauccucccaccucagccucccaaguagcugggaccauaggcaugcaccacuaugcccagcuaauuuuuuguauuuuuaggagagauagggucucucaccauguuuuucaggcuggucucgaacuccugagcucaagccauccaucugccuuggccucccaaagugcugggauuacaggcaugagccacuguggccugccucaauuaaacacuuuuaaggaaucccuugacuucaugguaugauaacaucacauuucucuacauccauuuguaaucugaauuuuaaacccugugaucaggaaugcugauuuucagccauucaucaauaauguaugaagcauuuuaagcaacagcaaugucuuagucauauuuauguuaugaaaagauaauucuaggugugauguggagaaugcauccccauuaggcccccugcaauccaaagaaaccagucaguacacgauauauuaaucuaggcaagaguuaugggaacuuugauuuggguggugaugguagacggggauaaauggauggauuugggagucagugaugaguuagcuauuggggcgaggugaagaggggagaguugaagaugacuccuaaauuucugacguguaguaacaucaucagugguaucauuacaugaaacggaacaaggcaggauaucaggcacuagggcgagaucuugaguucuauuuuagauguauucgauuugagguaccuugagacauuacgaguggagacauuuugagaaggcugcccagugguacugauaaggccugggagaaaagaacuggauuagagauaggaaucuaugaggcaucugcauuuaacuguuaauuaaagcaguggguguggaugagaucacuuaagagucuagagaauaagaagaggaagcccuaguacccugccuugcgggauucccuguguuuaaauggccuagccaaggugaaugaggcaaaaaggagacagagaaggagcaaccagagaguuaggagggaaaauaaggaugguggugagucacggaggaccagaagaaugguuuucagaggcggguguaaucagcaauuccgaauccuguggaaaguucagguguaauuguugggaaugaaguuuuuggugucgggaaaaagagaaaaaaagaauuaacgcgggaagaaaugaucucucagcagagagagcuuuacuuucugcagaaagggugcuacucaauaguugucuggccacgagagcacaccgaacaaaggagacagaguuauuuauaaccugacguguuuacccuacugcuguguccaguuuccauuggcugggauaggaccucacauuuuacacuuuauccuauuggcuauuaguuuaaaacuuucuuaaauagguaaggggaacagaacaaagaaaaggaaguuguccaggacuaguuaaggaagcaucuccaaauaaggaauggcaugcacugugggcuccggugugccuaauucuguccaggcaugcuggagcaagcuaggagagcugauuuggaauacauacauauacacacuaauagugcacagcaaucuuauaguaagaaauugugacuuuucauaaucuuugaaaaagaacuuccccauuucucacaguaauaaagacacacaauuguauuuaaugacaugcaggucagugacuagccaaaaggauugggcugaagagugagugaggaaaaagacuuggacuaugguaaauacaggcaaauguuuugagagguuuaauuaugagguguggguaguagcugggcaggggcgcgugggcaggggggcaggggggcagggggcgguuguggaaucuaaggagggccuauucgauuuugucaaauggagucuuaaucagguuuaaaacugauaggaagaaauuaggugaggggagauugacucugugaggaggaggugagguaacaggcagggugaguuccuaagaacgcauggggguggggagauccaaaagcagaugaggauuaauguagguggcgggugcaguaucagcuggugagggaauuccuucugaaagagaagggggcuuuauacagaguccacaaugccauucaauucagaaguacaacaaauagcuuucucucucuuuuuuuugagacagggucuugcucugucacccaagcuggagugcaguggugcaaucauagcucacugcagccucaaccuccugaucucagccucagcuuccugaguagcugagacuauaggugcaugccaccacacucagcuaacuuuuguguuuuuuuuuuaagagauggagucuuggccgggcgcgguggcucacaccuguaaucccagcacuuugggaggccgaggcaggcggaucacaaggucaggagagcgagaccauccuggcuaacacggugaaaccccgucucuacuaaaaguacaaaaaauuagccggguguuguggcgggugccuguagucccagcuacuggggaggcugaggcaggagaauggcaugaacccgggagguggaacuugcagugagccaagauugcgccacugcacuccagccugggugacagagcaagacucugucucaaaaaaaaaaaaaaaaaaaaaaaaagagauggagucucaccauguugcccaggcuggucucaaacuccuaggcucaagugaucuaucugcugcagccucccagagugcuaggaucacaggcgugagccaccacacccagccauaaauagcuuucuaauuauguuccugucucucucuuuccuuccuuuuuuuggggggugggguggggauggggggaacagcuuuauugagauauaauuuacaugccguauaguucacccauuugaaggguacaauucagugguuuuuaauuuauucacaaauauguguaaccauaaccacaguuaauuuuaggacauuuugucaccucacaaaccuguacccuuuaguuauucaccucccuucuuucuuacucaucuuuugcugucagaauagaauauggucugaauucaaauuugaaaaucauauaauaaaguauaaacugagguacaugaagaauuguuaagagcuuuaaaacuuugaucuaaccagagaagcaaaggaggcugaggccuccuacuuauggucacugguguagaaucaauagauaaugcauucacaaaaccuauuagguaucagauucuuccugucaaagagaauuaucugaagaauagagauaguaaaauggaguagaaaacccaauacaugcagauagauuguaagagaacaccuacuauugcuaaaugauuuucucuuggcccagaaaaauuacauucuggguuacugaauuugcauaugggaugaugaacuaccaucagaucuccaaggcauuaccgauaaugaaguguaguaacagcaggcuggaaaagguagacucggcuuagcauugauacugagggggauuauuaggaggaugacuuacaagcauuuagaaaagaaugucauagucaguagauauuaguguagguguaguaaaaaggucagaccaaauaacugcauuuucucauggucaggaaauagggaagaaauaguauaauuuaauuuuaucaagguauuugaccaaaaaaaccuuuggaauauaacuuggaaauaguugcauauauacaugacugagcagcccugcuccaagauuuguaguagaucauuacugaaaggagcaugaugauucaaagauaugaugggcucuauucaugcgucauuccuuuccagcauuuuagucaaugauugaggcaggucaugggagacauacauaugagauuuucauauguaugugagagcguuuagcuaauacauuggauguccaucagaauccagaguuacugccauaaucuugaaugaugggcugaugagauuaaauuaaauagaaaaauugaagucuucauugcagugucauucgccccaguuuaagaauaacauuuggaaagaccugucuuuaccaagcaguaccugugaaagccaaagacauuuuguucacuguaagcucucucugacucaauuauacaauauaauugcaaaaauucuuagaagguagccuugggcugcacuaacauuuguaauggaggagugguggucuggugucuucugcauuguaccauucuggauagggcugaauguuagcucugccuuucuuaggagguuaaucaaagaaccugaggggagguuuucuggagaagaugacaauuuagggaagauaggcaggcugcccucaagagauuuauguggaagagaaguuaaaauauugccugaucugcaguacaaacccagggccaguagacaguguagugaagcaauguuugucucguaaauuugucuaacaacuaucugauucugaauucagcucauccugcauuacuggacacuggaaauauuuaagguaaagucaugugauuugauaggaagcuuagaagguuacauaacugaauaccaugagacuauaugauccucuaaguacugcuuaacgcugagguuuugugaaucugugcaaaguaaucuugaaguauauuucugaucauaaaugcuucacuuuauauaaguuuuuauagccuuuauguuaugucucuuuaauacucuacuugggucuccuuuguugguuuauuagcuauaaaucuuugauuuuguuuuucgguuuuuuuuuuuuuuaagugguugcuuuagggcuuauaguauacaccuuuaacuuacuauagucuaucuucaggaaauauacuacuucaguuauuauaagaaccugacaacauuauaccuguguaccuccauuacaccucuuugagcuauuguugccguauuuuuuguucuacauauguuauaaccccagaauacguuguuauuuuugcuuuaaagagccaauucucuuuuaaauaaaagggaaaauuuuguuuaauacugucuucauugcuuuucauuucuuugugaagaaucauuuuucuucagccaguaggacuuccuuaaauauuucacgaaguacaagucuucuggugaugaaauauuucuacuuuucugugucucaaaaacucuauuccgccuuuguuuuucaaagguauuuuugcugugguguaaaauuuuagaaugacaauuugguuguguuuuucaguauuuuaacaauguuccuccacuaucuuuugacuugcaucauuccugucaagaagucuguugucauucuuugauucuuuguccauaguauuuuuucccucuggcuacuuuuaagauucuuuaucacugaauuuaagcaauuugauuauucugugccuugguauugucuucuuguuucucaugcuugggauuuuucaauguuuuggcucuauggaauuacaauuuuuauuaaauuuggaaaacauucguccauuaugucuucaaauaguuugucugcccuuccaccucuuuugggggcugcaguuacacaucugugagguugcuuaaaguuauccccuagcucacuaaugagaugucccuuuuuccccccuaaguuucauuuuagauaguuuuuaggcucucucuuuguguuuacuaaccuauucuuaucuacuaucuaaucugcuguuaaucccaucugguauaauuuuuaucuuagaccuuguaguuuuauuucuaaguguuucauucagguguuuuuuuaugccuuucauuccucuacuuaacaugguacauguuagugauagauaacuauuuguaguuguaguaacuauuuuaauguccuuauugaguauuuuaauguccuuguugaguaauucugccaucugugccauuuccacagcuguuucuguugauuaguucuucuucuuauuagucguguuuuccgguuuugguccuuuccaggauugcuguuaagcuuuguugggcaggaccagaucagaguuuggccuaggauuaauuuuguaugccuacugaggcaaaacccccugaguacuuugcuugaugacuagugaauaugagguuuuccauuaggcugguaggaaacaggagcuauuuccagccccaugugagcuccaagguucugguuccuagccuuggcuacuuuccuuacccaugugugguuaucaguacucaguugaagacaugagugggcucugcaggucucugccaugcucuuucugggcagcucuuuccucucugccacucugcccuguuguaaacucuagucuucuuggccucccuggguugccaggucugccucuucaacuaauggagaacaccucuucuggcuggcucccccguccuggugcuguggccuagcaagaagguaggguaauuaugaaguuucccucauuuguuuccuucucucagggaucacuguccuguacugccugaaguccacuguuucaaagucauuguuuuggccaggcacgguggcucacaccuguaaucccagcacaaguugggcagaucgcuugagcccaggaguuugagaccagccugagcaagauggcaaaaccccaucucuacuaaaaauacaaaaaucggccuggcaugguggcacacaccugugggaaacccagcuacccaggaggcuaaggaggaucuuagcuacccaggaggaucgauuaaguccaggaaguugagucggcagugagcugugaucucaccacugcacuccaggccugggcgacagcacgagacccugucucaaaaaaaaaaaaugucguuuuauguaucuuauccuacucauuagucuuuuucauggggaaagguaaaucuggcccuucucuaucuugagcagaaguagaagcucuuuagugacuuuauaucuaucacuaacaccuuagcuuugcacucacccauuuucugcucucuucccuuauuuccuccacaccuuuucugugauaagacuuguacuuucccuucucccucaucccuagcucaugccauuccuuauccuccauacuugcuugucagaaucucuucauucuuagggaucagcccaguugccucuuuggugauguuucccucccacuugaggaagugaaccuuucucccuguuuuguuucugccauagauaaacaugguuuucaguguuugggugucuguguugugcacaugcuggccuuccugugguguaugcauguugguccccaugugcacgcagacauagcgcccagcuccugagggcaaggauggagcuugcccacuuugcuucuuguucauagguccaugggucuguaauauagagaggugauuugacaaauuuugacguguuauauguuuguuaaaaugaauuguuuuuucuccucuucccaacuccucucucuaaaauuaggcuacagaagaaguuuccaaaaaucugguugccaugaaagaaauucuguauggcacaaaugaaaaagagccucagacagaagcaguagcucaacuugcucaagaacucuauaauagugggcuccuuagcacccugguagcugauuuacagcucauugacuuugagguaagaaaucaauuucuuauuuuuaaaaaacaguacccugugcauaauucuuuuccauacguucucucuuuuggaacauuguaagauuccuuuugggcucuuggcucaggguuacugaccucugucagcaugccugggcugccugccugauuagcagagcaaaggcaggaacccagggguguuucaggcuugggacaggguucuucccuguuucaucacauuggacauggaguuucuuagauauucauuaugccauuucauuuagguuguuuuaaaaaacaacugcucauuagagcacucuaguacucuaauaauucacuggcccuugacuuucaaggaauaaacaaucuaaagacagcuauagaauguuagaauuucagaggaagauacaaucuuaagagaacauccaguuaugucuucguuaccuguuaauucauuacaaccagagaccauauguguuuuguuugcuuagcacugcuuuuaaauuuuaaauuaguguaacauuuaagugacaggacauuuauacacggucugaauuucuggcuucucuugaaaaacuugauucuagcaauauuggguauauaguccugcuuggcccuucagcuagagcagaguagcaucacagggcgucuacaccuggguuugcuguagguggcacagcuugcuccuccugucucagggcccauuugcaucuccugcccagcccugguaggcauuugacauuguugcccgaguuaauacaguuggaucaugcuauguuaaauauuuaguggauuuaacagugagaauaaugauccuggauaccaucugaauauuugcgaugcauauaugguaaugaagcuaaugaagcgcuguggcauggccaugccucuuuaacucuuugucaucagugugcuuuguuuuaagccccaguguuugucagccugagugaguggaugucuguacaggugcuugaaagacagguacauguuccagaggagaaaaugacagacguauagccagauuaaauuuuggaaaaggaugagaggguaugguucauaaguugaguauaauacuguuaauaaaauaaaguaaaauuuuauuucuguccuacuguagagcagauagaacugcaauguuuucauuucauagcugauuucauguauuuuuaauaauguaucaaauuccaacagcaacaauuuguauuuccucugcaaaguuggggauguaguggaacaucuagguuccuucuccuuugucugccuccacccgaccuggacacugaauuuaauauuuauguggaacuucaaagacaucaacuuaaaagaaaagugugcccuuaaggcugguucuuagagauugccauuucugcuccugagcuagugcggggcccaggaugaucucucugucugugguuuagguauacccuggaaagcuagcauuucacucccucuccuaugggcuuguuagccuuguaacaaguggcuguucagaaaugccacuuggaguccaguucuccauuuguugauuucuugugcagcuuuccgauuguaagauucacuggaaagauccgucuguuuuguacaguaguguaaugaaguucugaucucugaacuacuguaucaugugauacuuaguaccuucauuauuaaucuauauaaagucuucccuaaacaggccuaguuuaauuggaagauaggucuacuuuccauuaaagcccagcuucauacagaauuauuccauuuuuaauauagcagcagaguauauuuuccucuccuuccaucacuaugaaaggaaagcacauauaguguucccaauguaagcaucuuauuugaagcugcuuguuccauuuggguggaauucagaucccuuagauuguuaacauauugcaggguuuuguuucucauaucagagucagcgugauccugagacuuagaaaugguggaaauuauauguggaauauagucaacccauuguuguuuuugucaacacauuguucauguuaaaaauaguacacuaguaaacuuacaauuuggaauuacaaaugaagagauaauuuaaugucuaugaauguguuaaagucagauauucagucauaacaauaaguacaauggccuuauucgaguucauuugggagggugaaugagcauuuugauguuuggucaggaaaauguguuaaugauuguauuccuaauagggcaaaaaagacguggcucaaauuuucaacaauauucucagaagacaaauugguacgagaacuccuacuguugaauacaucugcacccaacagaauauuuuguucauguuauugaaaggguauguacaauguaauaaaauuuguauucucaguugaacauaaaggaaggauugccuugggaaaaaaaacaggaugcugaaugugggaagcauuuucucuguaguuagauaauuuuuccauagauuuugaacacauuucccuccuugaaauucaacuugugagcuaaauugaauuugaaaaugcccuacaggugggaauuuaaaauuaggugaauucugagcuuuuaaauucacaaauccagcaugacugaaggaaaaaauaauaauucucuguggucuuauuucuguucucuaggauuuaaaaaaguugaauuucauugaaguaucaguuaaguuauauauugaaagacaucuccuuuggacauaauacgcacgcuguaaggcaguaaaagcugccucuuaaauggagcauggauucucuacagcuuuacuuuguugagucagcaaaguacauguuuaugaaguaguguccuuugauuuuuaccucucuguguccacuuacuaauccauauaauuugguaauucacagugcaucuuccugaaauuacuacuggucuaagcaggcauuaauguuuggguagucuugucaguuuaaaaaagccugaaaaccgaaccauagaaccaaaugcccuucucccucaucccugagccucauugacuggcaagguaaccuccugcuguuucacaccagaguugugugccagccccggguauggugugcaucuguuugucccaacauuggugguggucuguucuauuaaguuggugggcaggcauguuccuggcaugacuguuggugugaaucagcuugcucuacuccuccuggcuuuauagcuugccucagucugauucacgucucugcgguuuaacacuucccccaaguucaagcuuguuuagacaaagugugagucagugccuguguugcacgccagcguucuguuucccucuuucuauuucuaaccaucuguguuacuucuucagauuuugggauacagaacuuuuggcaucuaauuuuguguuguaucaauucagaguuguauguaaaaacauguagugagcagugugaaauuguggugaucuuagagcagcuuucaggugccuuuguguguuuuuaaagcccauauuuccuuuuccauagaaaccaaggauuauuaaaaucaauacauuaguuaacucugcugacauuuuucacuucagaguaaucagaggcaugauaugaauguuguuaaauggcaugucaagaaagacuuuugagauacaauuuacaguuuagagcucucaccugugcuggccagagcagacacuuccagccaggaaguagcauggagaaugcaacuggugggcccaccggaagccccgcccaccuccuuuguugugaaaaauauacguacaacuagagggaauauguaacauaccgguuccuacccuaaacccagcuucaacaguuacgaauguucugucauucuuguuccucuaguccuugcccccuuuuuccucugacacaugacaucacucaguaugcaucccuaguacgcauuacaaaacacaguauaacacaguuacguuaccauuugcaaaccuaaugucuaaugcccaaucuacagauuuccucaauuuucacaaaaauggcauuuuacaguucguuuauuuaauauuacuuccaggcuggacaugguggcucacgccuguaauaccagcauuugggaggccaaggcggguggaucacuugaguccaggaguuugagaccagccugggcaauauggugaaaccccgccucuacuaaaaauacaaaaauuagccgggugugguggcacacaccuguaaucccagcuauucgggaggcugaggcacaagaauagcuugaacccaggagauggagguugcagugagccgagauugcgccacugcacuuuagccugggugacagagcaagacuugauuuccaaaaaaaaaaaaaaguuccaaacaaggcccacaaacugaauuugguuaauacucugagcucucuuuuaaucuauaauaguuaauauuaugccaucucuuuguugaagccuggauuguuuguuuuguagaaaaaucauauauuuuagacuuggcauuccuguugcuucuguaacauguuccacuaucugcuagugauuuaacugguagauaguuagaucuggcuuuuuuuuauuagauucggauucacuuugaggggggcaaaaguucauggauggugcugugugcuucauauuggguggcacugguuaucccauuucuggugauguucggauugaccgguggaugcagguguccucagucuguaaucuguccauuacaaaauucucauugaccuuucaccuccugguuuuaguuuccauugagaaucauugccuagauucagaauggcaguuuccugauucuguuauuucuucuucauauaauuaaauuguuucuauaaagaagaacccuucuuccuugaugacuuaguuaucccaaaauagucucauuuuuuaguauaaucagguauuuuuuuuuuaguauaaucaguugaugaccuggccacuuccuuagauaaguauugaguuguuuuaaggaucauuauaaacucacguuuuugucuuuuuaaaaauuauauuugauaugucucaauccauuccagucauuacuuucuuguguccaaguugccccaucuuuggcccuugggaacuccuucaaguugccuucuguguuguuuuggcaagaccccaucagucugugauugcuuccuugcuuucuggcguaggaugaccaucuugcucauuuuguacgaguccugccagaccuggaaacagcuguuucuugaaggagcgcugugaacugcauuuuaagauuuuuguacuuuuguuaauuaauuuagacugcuuccauacagugugauuaucuucuuaggcugugaguacuucuguuagauauuuauuugcggggccaugcugcuaauacuagcaugcauuugaagucguauugcuaguguuagacuacauuuggaggcgauuuuuuuuuuacuggcaauuuacauguuaguaugcuguucacucuagugcucacagguuauacagcauaacuguuugccuuguauuuacugguuuaugguuuaaucguuuagacaagcuugacaagccuccaucaaaaccuguucaacuuguaccaaacugucuuacccuugucuuuccugccuucuaaagcucagcaaagaugaauuguaugaucagccauuuugugagcagauauuuccaucaaguaagagccggucagcauucuagcugcaugccuccacugaugccaaggagugugguuuuaucuuguugaggaucugugauguguaagaggacaccacuacuagauaacaaaugaguacuacaggauuucagaggauaaaaugugguuuggguuaauaaggcaaggguugauaaaaggaauaggacuuaagaugggaguuccuaguaguuuagaauuuacacaggcagaaaagagagaaggcauccuaauggcauaugacugggaacaaagguacaggggcaggaaugaacauaacaugauuggcagcaauaaggagagaauuugaaaguuguguggcagguugggaggugacauugugcuagaacaggagaucuaauaagaggaagacuggauaguuaaguccagaaguuugucuuuauuugauuagcuagaagaaaucauuuuaagcucccaagcuggaaaugcuguugauacacuuguguguuggguagauuuauuaugacagagcuugaacaaaggugcuggcuaggaaucauuuccaauuguccagguaugaauuaauguagcagugggaaugaauaaaaggaaaugaaacuaagauaaucagaaaaauauuuuuaaaagccuuugaaggcuuuugaagccugacauugaaguugggaagauuuggaguaaagaaggaaagguuuagaacugggcuguccaauauaguagcuacuaaccacauguaauuaauugaaauuaaauaauauuuaugauucaaccccacagucacacuagacaaauuucaggugcucaguagcuauauguggccaaucucaccauaaugaacagcacagauacagaacauggaaauuucuguuagaccugguuuagaacuggguaacugaaacaaaauaaugaugccaaauuauagaaaugaggaagcaggggggugggggugauuuuauggagggggaugagauuugauuugagacacguugaguuuaugguagcccuuuaacggaaguuguccagaggcaacagaaaaugccuaacuaauucaggaguagacauggaggugggguuaguagucauggugggagccaugagauuguaugggcuuucauuagcaggcuguaggcaacaggugaagaccucagccaggcaagaaaugggaacagucagagagauagaaaggagaacaugaaagguuuuauuuugguuuuuuacagcacugucaggacacuugaguagaagacucuauuuagccaagagggaaucuuugcuggcccguuauuucacuaguguguugggaaauggaauaugacuagaggagaaugugagguggaaagaaagccagugcaugcagcuugagaggaaguagaagagagcgauguguuugagggggcggaagaguccagucagagggcuugugcacaucugaaggggaaaugccucuugcuuggcugagaggugucucucuaauggcggggaaggaagaagccagagacauggagaugagcauagggaaggcugugugcagagagcugaugaggggggucugccugcucuguggccccugggcucucugauggggacacuuugugaaguccucaggaggaggcuuaucagcuugguaguguuuacauguggcugagagucuccaaguacuaucuugaguauugaauugaaacaacaagguauaaauucuauauguuuguagaccuauuuagauauucugaauuuggggaaauauuuuguuuucuguuuuuugauuuagcuuuugguuuuucugagugucaagagcaccaucuguaaaagcuaaccccuguauggagugguaugacccgaaauacuucucuugaaaucuuucagcuuaaauaaugaaccuuuagucacacagucacucguauggcuauuuuucuuugguuuaaggcggucaucaccaaccaguguguguuugcacucuggagucaguuuaccugagcacaugcucugcuccgacugaaauaccuucuguaaucugcgauggucauuuaguuaggauacaugucugaaaacugucuuuggccugaaaguuugaacuguucaguguuggaguuuugaaaaagcaaucauguuugguuuguuuguuugguuuuuuguuuuugcagguaugaaucuccagaaauagcucuaaauuguggaauaauguuaagagaaugcaucagacaugaaccacuugcaaaaaucauuuuguggucggaacaguuuuaugauuucuucagauaugucgaaaugucaacauuugacauagcuucagaugcauuugccacauucaagguaacaaaaacuguagaauucuaaauauccuugaaagucagaggugugcuguuuuucuaaaccuucauugcccuccuaaaucuacacguggcugcccucuagugggaagagaaagauacauuuuguauauguuugugugauagagguauaugcaguaaagucacagcuuuaaaaggguggaaaaguuagauucuaaagucuaucuaaaagacaaaaguccuguguggucaaaauucuacuuugcuguuaaauuauaauuaaguaugguauacuguacagcauauguaacaaccagguuuucuccuguguuugaaacauuguguagcaguuucuuugguuaagcaccagaugaaguaguuggcuucuguucagguuuauguuaauuuggaauauacacuucaugaaauauuaggaccacauucaggacagagauacucacauuguggacaggcccgaggaaacaguggauucaccucucccaucucugcucacacuggaucaugucgauuaaauguagagcguggacagaaucacccacacuauucaaaucauaauguaucuuccccgcucccccaucuaccuuuccucccuugguguauauuuguauaaauuaaauacauacaugaugugacagcacuguacaacgugcagauucuuguuuugaguuacaagguucuaugcuguuuacaaucuaugaauaaagcaggagucuuuuacaaugagagcaagcguuuguagguuacauucccuuauauaaauugccuaaccuuaugaauaaauauuuagaacuguuuuaauauaaaccaauacuugccaggcgcaguggcucgugccuguaaucccagcacuuuaagaggcugaggcgggcggaugaccugaggucgggaguucgagaccagccucaccaacauggagaaaccccgucucuacuaaaaauauaaaaucagccgggcguaguggcgcaugccuguaaucacagcuacucgggaggcugaggcaggagaaucgcuugaacccaggagacggagguugugguaacccgagaaucacaccauugcacuccagccugggcaacaaaagcgaaacuccaucucaaaaaaaaaaaaaauguauacacgcacacacacacacagcccaaagaaaauacauauauacacaccaguauuuagcauacugauaugcagacgaccaugcucagaaaccaugaacacuaucacagugagaaguggccaccuuucuucugaggguucauuuucaugauuaugaaaagccccugaaauaaugagcacacacuuuggucucugggugaaauaugucccaccucagagugaaugaaugcccuaaagauaggaugaaaccuggggaccugaucauuaggguuuuaccuugaaugagaaucaggucauaaggcccccagggauuuauugaaugagaaucaggucauaguaugagagcuccccaggaauuuauuucccaaaacucuuaaagagggaguugaaagccucaggugaggacccagauauuuguauguagguguacaaagcaaaacaaaaugaauuugagauuauaacauagagugaucaauaugaugucuuaggugucaccacaguuggugggcuaggacucaugcuuauaaugcaucgguggaaggguaugucccauucagaaguagcagaccugccaugaagggcgguguagcagcaccaugugucaaagagagauuccccuguguggaaggacagccaggagccugaggguggcaguacucuggccacaugagggugaaggaagaggauugagcagcaguggugugggagaaugcagcaagaccccugaccccgucaggaugugguugacaugcuucuggcacagauggcaaagguggcucagaggugagagagauguacugacuaugugcuggaaaugggauuugcagugagucucgucuggccuggcugauaauuucauuucaguuaggguuacuucuuuugauaauucucaccaaggagaaaauggcagugauggaucgcuauggguaaagcagcccuaucaggucaugguggccagagagggagacugggcagccaggcaggucaccccuacuugauaaagaggaagcuucauaaaacaagguaguguccuaagggugagcucuggaagagagagcacuggggagcuggccuggacugugcaucucaggugcuccuuauugcauggaaaggaaggagcugagaggagaggccccccaaaagaggguucuccaagaaacaaaauuaagcagagucuacagccaagacaacaugugaaagagaggacagaccucccaucauaauuucaggguagcuaaacuagcagacagguggaagucaccuuccuacuccucccugaaagaaacuccagucagggaagaaaggaagaccagcaggaacagccuuacagcugcacaccagaggcgcugacaaggagggacacguugcugcuccucuccugucuugcugcuagucuccuguuugcagagcauauucuuauaauggaaaagaagaauagaucuaugguucaugcuuuccuuugagaauguggcaagagcgcccucccagaaaacgugcucugcacacaaaaauuuccaaacauguggcucauccauagcccuggaacaggugcugagucuuuaaaggaaauuagaacugcucuaggccaggcaugguggcucacgccuguaaucccaccacuuugggaggcugagguggguggaucaccugaggucaggaguuugagaccagccuggccaacaugaugaaaccccgucucuacugaaaauacaaaaaauuaguuguggugacaugcgccuauagucucagcuacucaggaggcugaggcauaagaaucccuugaaccugggaggcagagguugcagugagccgagaucacuccacugcacuccacccugggcgacggagugggacucuguuuaaaaaaaaaaaaaugcucuaaauauguccaaaauucauagcuugaauaaauggaugcucagauaguaaaccagauggccaaauauuuguaaauuuuuuuuucuuuuuugaggaauuaaggagauggagaggggcauuagaaagccaaaaauguuuccaauguucuagaauaaaagaagguagccucaccagacugugccuguguaagguucuagaaaguaugucuaaagagaugguuucugccacucaaaaccacacaacuacauggaaacugaacaaccugcuccugaaugacuacuggguaaauaacgaaaugaaggcagaaauaaauacguucuuugaaaccaaugagaacaaagacacaaccuaccgcaaucucugggacacauuuaaaacaguguguagagggaaauuuauagcacuaaaugcccacaagagaaagcaggaaagaucuaaaauugacacccaaauaucacaaaagaacuagagaagcaagagcaaacacauccaaaagcuagcagaaggcaagaaauaacuaagaucagagcagaacugaaggagauagagacacagaaaacuuuucaaaaaaucagugaauccaggagcugguuuuuugaaaagaucaacaaaauugauagaccgcuagcaagacuaauaaaaaagaagagagaagaaucaaauagacgcaauaaaaaaugauaaaggggagaucaccaccgaucccacagaaauacaaacuaccaucagagaauaccauaaacaccucuaugcaaauaaacuagaaaaucuagaagaaauggauaaauuccuggacacauacaccuucccaagacuaaaccaggaagaaguugaaucgcugaauagaccaauaacaggcucugaaauugaggcaaucauuaaaagacugucaaccaaaaaaacuccaggaccagacggauucacagccaaauucugccagagguacaaggagaagcugguaccauuccuucugaaacuauuccaaucaacagaaaaagagggaaucuucccuaacucauuuuaugaggccagcaucauccugauaccaaagccugguagagacacaacaaaaaaaaacuuuagaccaauaucccugaugaacaucaaugcgaaaauccucaaugaaauacuggcgaacugaauccagcagcacaucaaaaagaguauccaccacgaucaagugggcuucaucccuucgaugcaaugcugguucaacauacgaaaaucaauaaacauaauccgucacauaaacagaaccaaagacaaaaaccaugugauuaucucaauagaugcagaaaaggccuuugacaaaauucaacagccuuucgugcuaaaaacucucaauaaacuagguauugauggaacguaucucaaaauaaucagagcuauuuaugacaaacccacagccaauaucauacugaaugggcaaaaaccggaagcauucccuuugaaaaguugcacaagacagggaugcccucucucaccacuccuauucaacauaguguuggaaguucuggccagggcaaucaggcaagagaaggaaauaaaggguauucaauuaggaaaagaggaagucaaauugucccuguuugcagaugacaugauuguauauuuagaaaaccccaucaucucagcccaaaaucuccuuaagcugauaagcaacuucagcaaagucucaggauacaaaaucaaggugcaaaaaucacaagcauucuuauacaccaauaacagacagagagccaaaucaugacugaauucccauucacaauugcuacaaagagaauaaaauaccuaggagugcaacuuacaagggaugugaaggaccucuucaaggagaacuacaaaccacugcucaacgaaauagaagaggacacaaacggaagaacauuccaugcucauggauaggaagaaucaauaucaugaaaauggccauacugcccaagguaauuuauagauucaaugccauucccaucaagcuaccacugacuuucuucacagaauuggaaaaaucuacuuuaaaguucauauggaaccaaaaaagagcccgcauugccaagacaaucguaagcacaaagaacaaagcuggaggcaucacacuaccugacuucaaacucuacuacaaggcuacaguaaccaaaacagcauggcacugguaccaaaacagagauauagaccaauggaacagaacagaggccucagaaauaacaccgcacaccuacaaccaucugaucuuugacaaaccugacaaaaacaagaaaugggggaaaggauucccuauuuaauaaauggugcugggaaaacuggcuagccauguguagaaagcugaaacuggacaccuuccuuacaccuuauacaaaacuuaauucaagauggauuaaagacuuaaauguuagaccuaaaaccauaaaaacccuagaagacaaccuaggcacuaccauucaggacauaggcaugggcaaggacuucaugacuaaaauaccaaaagcaauggcaacaaaagccaaaauagauaaaugggaucuaaauaaagagcuucugcacagcaaaagaaacuaccaucagagugaacaggcacccuacagaaugggagaaaauguuugcaaucuacccaucugacaaagggcuaauauccagaaucuacaaagaacuuaaacaaauuuacaagaaaaaaaucaaacaaccccaucaaaaagugggcaaaugauaugaacagacacuuuucaaaagaagacauuuaugcagccaacagacacaugaaaaaaugcucaucaucucuggucaucagagaaaugcaaaucaaaaccacaaugagauaccaucucacaccaguuagaauggcgaucauuaaaaagucaggaaacaacaggugcuggagaggauguggagaaauagggacacuuuuacacuguuggugggcguguaaacuaguucaaccauuguggaagacaguguggcgauuccugaaggcucuagaaauagaaauaccauuugacccagugaucccauuacuggguauauccccaaaggauuacaaaucauacuacuaugaagacacaugcacacguauauuuacuguugcacuauucacaauagcaaagacuuggaaccaacccaaauguccaucagugacagacuggauugagaaaauguggcacauauacaccauggaauacuaugcagccuuaaaaaaggaugcauucguguccuuuguagcgacauggaugaagcuugaaaccaucauucugagcaaacuguugcaaggacagaaaaccaaacaccgcauguucucacucauaggugcgaauugaacaaugaugagaacccuuggacacagggcggggaacaucaaacaccggggccugucaugggguggcggggugggggagggauagcauuaagagaaauaccuaauguaaaugauggguuaaugggugcagcaaaccaacauggcacauguauacauauguaacaaaccugcauguuguguacauguacccuagaacuuaaaguauaauuaaaaaaaaaauacaaaaaaaaauggcuucugagcaguuuggaaacuguacccacagccaucauggauucacuaagaggaaguucagucauauugaucucauagguacugguggauugggggaguaaaagggcauggcugccuagguucacaccagcucugcugcugaucucaccuccaaucucuucaucuguucagauucagguaauaacaugaccauaucaguuguugugccuucacacagugucuaugcaguaaacauuagcuguuagaauuacuccuucaucacaacaaggauaugcuagauguuguauaauucuacaaaucuguuuucauggaaacaguaaaacugagcuagauggaguuucaguauaguaauucacaaccaguuguauguuauauccauaugcuauuggcacguaaauugccgucacccugcagagaaacuucuagcgaauuuccacggggcuuuccccacccagcugaacguuuuuauuagugacugaaauaaaaggugacaaggcauacuuaucaaauguguagauguuagccaggaagggaaggacagcagauaacagaggauccuaaaacuuagaaaggucagagagaccagaauauagcaggaugaaguuaaauacagauaacugaggucuuccacuugaggacccagcuguauaaaauaugggauggaggaauaacacaauaauaauaaauacaaaaugagauacuaaguauaauaauuacuaggauguagauaauuucauaucauacucaacccuaggaaggcaguguuguuauuacugacuuuacagaugaggaaagugaagccuagagauuuugauugaaaucagacaauaaauggggaagucagacugcggacccaggcaggcaggcuaccagagcccacuuugaguaaacaauuuugaauacccccaauacaauuaagcaguaugauaauguguuccccagagcuccaugugaccacguaguauguaaccuaaggagcuaacugauagucucacuccacuaugagcuuaucagguaacaacacauaaauguguuccauuccaggcgcuacacuuuaagaggcacauagacaaauagaugacuuucagaagacaguagauggugagggggacucagaacccugucauucgaggagugguuaaaggaacuggaaguauuuagccuggagaagagaagccucgguagggaccugccaugagagcacuacuuguauuugaaguggggucccauagaaaauggacaaaacauggaucugucagcucugaugguuccuggcauaguauuuggggauaggucugacccuagcacagggagaacuuucucacuguaagaacuccagaggugaaccacacaacuggaaaaauugaguuucuuguccuuagacauaaucaaacaucaaguaggaaauggggccaaaugguuugccaagaugaaugugaaaauaagcccccuggguuagcaggauuucuucagggaucccagggcugucuuagucacaugauguuucagcccaaacucaagcuuuuaggaagcuuuuaaauucagccuacccuaaaaguuggcugcuuagucugcuggacuugggaaaugaucccuagucuuucuuccauuauaugagggccuggcauagacuggaauucagauagauggaagaugaggaauccuuuuauucuccccucugcugacugaccuagcaacucugcuggucuggggucacaugcacccuaaacuuugcaggucugcaugcccuuugcccauuauguucuauucuguuggucuacacacaccccccucccacccacacucaccccaguuugagcuguccgaaguuuuuggcugcagucacuaggcuaagguuccuucucaucucucaguagauagaggcucugcugauuguccucaucuccuccuuuucccagcuuaguauucaccuuuuucucugagcuggcgcuuaacaguugcucuuuuccuacuaguguuuuacccccccaaccccccaccccaggccuuugaaugacccuuuuuaacaaaggguuuucauccuguuacguacuggguccaccugcuccuugggcagacucugagugccccuuucaaucgcucuuaccccaaagccauugagauuugauuucugguuggcagcaguuuccugaguuuccagaugguaacacauagaaucuccccuacaugggaagauguuagaggucccccuuuguguggcccaucugugagccucuggcugcuuuugagauaccuuacagagugaauacucgcuucucucaaaccuucaguaaaaaucuguugugcaacauguuaacaccuagagggccuuugcuuuauagaguagauacuuuguuccugccuguuccuaagaauccaaccucaguugagagccagugucucucaggacccuccugcuuggcacucucuucgugagguuaugacagaacagugagcagcaaguuccuucugcuguacuuccucacacuggccuccagaacgauuuagucgcaaaaaguuagaagcaacacugucugacagggauccugacacuugaauuccuaaguuaacauauucauuuguuauucaccaagauugucagugccugcucugugccaggcacuuuuuuucuuuucuuuucuuuucuuuucuuuuuuuuuuuaauuuuuuuuauuuuugaggugaaguuucacuauuguugcccaggcuggagugcaguggugcgauuucagcucagugcaacuuccaccuccuggguucaagcgauucuccugccucagccuccugaguagcugggauuacaggcaugcaucaccacacccagcuagguuuuuguauuuaguagagacaggguuucaccauguuagacuggucucgaacuccugaccucaggugauccacccaccucggccaggcacuauucuuuaggggugggggauucagcagugaacccuacagacaaaacuugcccuguggcaccuccauagcgggacaucagccauaaacacaccacaauagcauguuaaauggugcuguccguacuugauaacauuccccuucagguccucauguuccucucucugcaucugugaccccauggaccacgguacgaagauaauggaaauucucuuaccacuuucuucuucuccuuccccuggaggggaaacguuguagcacuucuugccaaacucuugaguguacucagaauaaacuucagguuuuuaauauggccuguugaauccucaaggaggauuugggaaaaauuggguagguccuuccuggccaucccuguuaugaucaggaaauauaacacauacccuauccagcaguuugaacaacuguaaaucuuuggggugggguuagaaaccuucucaaaagcauacuuugaagauugcugaaugugauguuuuuccagacauguucccugauuuuauugguucauucauugauuuauuaaauauuaagcacuuacuaugcacugggcacugcauaggugcuggggauucaaagguuaaugaaaacagacacgauccugguauuuauggaacuuacaguguagcauaagagagacuugaaucaaauaaucccacaaaccaguguagagucacagcuauguccagugcuuuugugcuggugaccaaucaggaggaguugagguccgaaagacgaacaguagguaaccacgcaguggggaaagccuguacagaggcccuuucgggaagggcuuucacagaaaguaggugacaaaagagcucccugugcagucuaggaccugacaucuggagugagcuguggcacuucccucguuugcuugaccaugggacauuucuuaaagcguuucucagaaccaguguuucauuucagcauacuucaagaaacacuaguucuuuguaaccugggcaaccuucaaacauaaacaggaacgaaaacuaggaaaggugguugggagaaaggcgaugauuggcgcuaucuucuuuagcagugguacgaaggaccucaauccauuaguuuaccagcuacuggccaggccuuccugcugucacuuguucccauucucuuucccacccagugagaccaaggcuaguccuuugcuaacuucuagguccuugaaggcagggaucauaucuuuuugucuuugaagcccuagcaccuagaguuuuaccuggcacuuaguaaauauuucugaaugaaugauccuugggaaagcuauagggugaggcauaggguucuguuucaugguaauacaaaaucagacuggagguucacagucguuguuaauucuacguuaucguaccaacauucugcuuaccuaaaacacacucuaccucuaaaaaauuugcguuagcuaugaaccugaaugugauugaacuuaggaggaagaaaauagagccucuaauccuuuuucuaauaaaagaaauuuccucuuucuccaccgggagcgcuaagugggcguggaauuguuugacaguuuaccacuacuguuagcuuuguuuuuguguuuuuguuuuuaaauaaccagcccacuuggggaguguuaacuuuaauuucacuacaauuccuuauucuuuuccuuuaguuuauauuuccauugccuuuaucauuuuuucuaagagcuguagauccaugacucaucauaaucauuaaaauugcaguuccaaauaauuaaugauuuuauuuugcucuuauagaaucaguguuuuaauacaauucaugcuaaaauguuaaguauggugauuuuuaacaacaguuuuuauuagguaaaaugguguggaauuuaggauucgcuuuuuugaaaacuuggagaacaacuguaaacaauuuuuuuuucuuuuuguaggauuuacuuacaagacauaaauugcucagugcagaauuuuuggaacagcauuaugauagaguaaguauaugaaauacuauuuuuaaauaauaaauuguaacuuuuguuaccagaaaugaaagacuuacauuagguuuuuguacuagaauauuuauuuugcauauguaauguuuauaaauggugccguaguuauuucucuacuuaaacaacuuauagaauauuacuuggucagaaguagaucuuuuugauugacauacugcccuuugaagcuuuuauugcuuuaaaagaggaaaauagagcauuuugcugcuaaaaugauaguaaagauaguaggaaaauuaucugacuuuuuaacuuuuccuuccuuuuccaucaguugccccacauuucugcugcauacaaauagagagaaagggaggcagcagcugauaggaugagagcagcacuggccagaggggacgggagcccggcucugcuccugcucuacugcucacuccuuuguggccauggccaaggcaguuaaccgcuuggggacuuagaaguccguccuuauuguaaaaugaggacauuggacuagcuugucgguaaggucccuuccagcacugagucaaugucagauguuccugguaauagugucccccagagauuugucaaugauuuccagagugcuugauagcuugauuucccuagacccgcacaacugccucuagggcugccaugugaaaugaucucuuccaccacugccaguucugccagccucaggaggaucuuccacaauacccacaagcacuguugugauguacugguuuaacuacacaucgucgaagauucugauagguacccguaaagagguuagaagaaugacaauccacuuaaaacuccugucuauccugcaaaauuugguuuagauuuuaauuuuuccacuacucauuuaaauuuuugaaauccugaguauuauuaauacuucauuauucacuuugcuguucaaauacauucugagauucuuagaggcaaaaaucuaugcuugcuuguucuuuuguggguuuuuuucccugucuuuucccccugcccuccacucccaguaagaacauaacacaacacugagcacacaaguccuucauaaguagccucauaaauggcuuaaaaauugcugguccuuuauuuuuauuucagcucauguguauuuggauaugggugcguuucuuguauguucauugcuuuaaaauggcaguucugucaucaucagggccuuuuuacaguagauagaagcauggacuugagccuuggacugccuggauucuggcugcaagucucagcccuaccaugggcugguaggacuucagcaacugccuucaugcacccucugugccuucaggaucuuccacccugaagaaagcucuucauauaguaccugucuacugggaucaucaugaggauuagauaagaacguguaugugacgugcauggcacagugccuggaacacaggaagcacuuaauaaacguuaguucauuuaucaucaccacaaagauuuuucaacauacuaguaauuuaaggccuaccaaagacacagacuagcugauuuccaagacauuugcuacagugaaaucuguuuaaucuugcaguaaaauagcuuccuacauguuguuaauagaugacaucaguuaacaggauuuuagaagaacauaugugaggcaacaaaucuauagaaagcagucagaucuuauagagggagaagcagugggggauguggguaauuuaaagccacaggugagguuauuacaccaaaauaacaugcucuaaauucugauccaguuuggcucugagcuuucuaauaaccaaagcguagaaagaaauaaaacaauuaaaagaugacaguauuuguagaguaaaauucaugcuggcugcucaaaagaaacguagccuuuccuagcacugggaccugaaaccgguuucucuccuuggcguucuuaaaggagagucaaguuacaguaucauguaguggacagucauugccguggcauugcaguaaauaaaaugcucaacuccgaugcaguucccugaaagcaagucuuugaggaacccagaagugggugggaggacagguaucuagguuuguuacuuacucuuugucuguccuaauacagagaagaaaaaaucuaacauaaccugaaggaaacaggggccacauacauacuuuucaggcaguucuccaugaaaaguuucuugcaaccaagcuuauccaaagaugcagcagaaaaucuuaacuugcauuuucuguauauauaagaacuugagauguauauauuuuguuacugauuaaaagcagguccaguuguuuugaucaucaguuugaugauaauuugagaagguagacuuaacagcuuuuucugaaaagagagaaaucuaacucaaauacauaccaaauagauggccagcucaccucugccaagaggcaggcagaagaaauaauguauaauucuguguuagcucuaaaccaagaaggccagaaagcaaauuuuugaggcuuuguaagccauguggucucuguugacucuccugucuguuguucuaugaaagcagcuguaaauaauacauaaacuuuucagugaauucauguucaguaaacaaacgagcaugggauguguuccagaaaaacuuuucacaaacaggcagcaggccauaguuugccaucccuugcucuagaccacagaugaauggcuaaugaggacccaucauaaagcauggacaccaguaguucucucauggacagaugacaaagcaggcaucccccggcacucgcgaugaccaaaggaaagucucaggaaagcacgaagauccaacagucauacuagugcugcagacuuucagaauguuuuaaaccuaucugugguuuaaacagacagacaaaaaauaaaaucuuaaggcuaacuggccuugucuacuagguuuuugaaggauagccuuggcccccaagugccugucauuucgguuuuguaacucugcuuuaaugggcuucuagccuucaccauccagcagugccacucuugucagugaccgcuguuuugaaggucuaguggaccugucaguucuuaaauuuguggcauuuuguucuccccggggcuucauucauacuauguccuuccuuuuuuaucugcccagauucucuuuucuccccuccauuucugagugaaaucccucccauccgacaggucugagacuaagccccaccuucguugucggccugguuaacacaaugcugaauuucuccucucuuaauuucuauuccgaauuacuuuuucucuuugccugauacauugaaagagcagauaacuuuucucuuugugguugugcuuugaacaaauugaauucuuguuuauauaaaauacgaguuuuucaaucuaacaucaagauaugagagcagacucaacaagcaaaagugugagggguaugggaguuagguuuugugcauagggagcuuggggugacagagaggccuggauuuaagcucugucugcaggccuggcuggaacugggaaggggcucagucccaggagcccucuucauggaagggauuggugggaucaccugagagucucagagcaaacaugucagaggaagacaugaaagagaguggcaggggagccagggcagcuguuggccuucauggugugagaaauguguccuuaagcuaauuuacaauguuaccuaccagucuuuuuuuuuuuuuuuuuuuuuuuuuuuuuuuuuuggcaauaacccugauuuauguucucuuaucuuuuaguuuuucagugaauaugagaaguuacuucauucagaaaauuaugugacaaaaagacagucacugaagguaugacagaccauuuuguauagcuuauuucucuguaccuuguguuugaaauguggauuuggggaaagggagaugugcaggaugggucauagaccuuugggggaaauaaauaccuuugccgagggucaagauuuuugcggaaaggaauggaguuggacagugauccauguggagcacuuuccugcuuccuaguaagguggagacacagaaagggaaugaacgggaguuugaagaagacuucaucuccuagcagugcauucuuugcgauuuugagccauagucauaucagcuagaugaaggcacuccaggugcugugcuccugggcuguggccuggguggcacaggcaggugugugaggguggagggaggcgaugugcgugugaggcuguggaccguagacaggcuuggcugcuuuguaucaaagcaggauauccuuugcaaguuagaauguuaaauuuaagauuuaaacuguagaacaaggguuggcaaacuacaacccaugggcuaaauccagccagcugccuguguuuguaaguaaaguuuuacuggaauaaagacgugcucauuuauuuacauauugucuguggcuguuuugagcuccagcagcagaauuaaguagaugccucagagacccuauguucugcaaagucuaaaauauuuacuguuuggcccuugauaguuugcugaccccugcuguagaaaguucuuauagcaguuaagaagugcauacccuccacucugucaguaagcagucccaacaggagauauagaugaaaucacaaaggauuugaggggaaaaucauaauuccauucaguuuuuugccagguccauuuaaaauuugacucugcccagaguucuuccccucaugggugucuggaccgauaaugaccaagauuccauccacucauccccuuccuaccguggggaaaucucccuugaagaccuuaucuuucuguggaaaagacuaaaggacacuaggagcaucuggaauacuuuguguccuuugauaggaacacuccaccguccacauuuucaaucagcacuuucuuucagaacagcauaugccuuuuuuccguguaaggcuguaauuccugcagcagggcauccgugacagccacagcuggggaacaggcacaguccagccaggccccuugcuuuccauucauugcuguugcuugggccccaccuucccuggcuuagaggaucauuugcuguccuuucaucuuugggggguuggacagaacuuccuggcagcugugggaggaguuucuccucccuggacaucagugugugagagaguggagguuccuggggccucuccugcucugugauccucaaagggcugagguauacuacucuugccagcaguuauacagaugcacacaguucacuggagucaguaucuucuaaggccacaaaggccagacaggauagccuagguuaguagcuucuagggccauugugggaggaagcuggggccgggggugcaggguggagguuauuggcaaauccauaaacuuugaccaaauguuggauucuugggcuguuuggauaaggagaaaggccuucaagacccuucugccauucagaauuaccaacaugaaaagaaaggcugagaccaccauuuccaagcccuuaggaauggauauaaagcaaguugcuggcuccugcaguuuauguuagcggugggccugugagugccccaugaacacauggagcggcuucagcaccagccguacuuuaaagauggauuuuaauuuguacucucuuuuucguagccacauuggcauuuauuuauucccauauuuaugucgccagcaaauuuauauucccuaugcaagacucccaaguuuuuuaguaaaguauuacauguuugggcugaguaugguggcucacgccuguaaucccagcacuuugggaggccaagguggguggauggauggaggucaggaguucaagaccagccuggccaacauggugaaacccugucucuagccccaaaaauuaauuagccaggugugguggcacaagccuguagucccagcuacuugggaggcugaggcaugagaaucacuugagcucgggagguggagguugcagugagccaagauugugccacugcacuccagccuuugugacagagugagacuaucucaaaaaauaaaaaaagaauuacauauuugaagucaucuuccuucagauuuucuuugguuucugugauagaaaaagaacacgaaagcuauaaaucacauaauacuaacuuuucagucuuuguaagauacugguugcuucucaccguaagaauagauuuugugauucacauugauaugaagccuacuccuuucaguuuuuccuaugaguuccuuauaaagccuaaguaaaauagauuuguuuucuuguacaucagcucauuuuuuauuuaauaugaugacaaguuacuuauccagagaucaguuaccuggaaacuucaaguaucuagaacauagccagaaacccagaaaggaagcaacaaaagcaauuaaagcaaagccacagagccgcuauuugcgccuuuucuucccuuagcccucacucacucacaucucugcagauacaggccugauacgugcuuugcacacugaugcucguuucucacugcacucuccugagagagaggcacuguuccauuauacagaugauggaaccgagacacagaggaguucaguaacgugcucaagauuacagagcucacaagaaguagggagccaggauuggaacccaggcaggcuggcaccagggaccaagcucuccacagcucugccaccgcccacaaggaccgcagcuuggcaccugccccacugccggcucugcacacucagccuuggccagguuguuggcauguugacaaccugaagaagugacugcugguuuuaggaaagaguaagccgugacaguuuaaaaguuaugaguuuauaugauauaaccaacucuccagaaauuaguaaacccuugaaguaaacagauguuuuuuuagcauuaauugguauaauuagugauggugaggggucaguaagaaaacacuggauuaucuucaggagaccuaagaaggagcagaaaaauacucacuuguguaaaccuuucugaauuagcugugauaaaacgauaacuguggcaugugcaggguacacaaauggaaaacuuuggacacaaaacccuuuaucuuggaaagucccgcuaaauaaaauuuaaaaauaguuguuuuaaauuaagcuaagguuugugguuaguuaacaggaauaaucaauaacuuuugaccauuuucuugaauaguuucuuuuuagugagcuaacacaaaugcacgcuuaaaggggaggcuuugagagucucccacuggggccaagggggcaucuugaacauccucugcagagagaagcgucaggccucccguagacuucaucucucagggaaagggaggaaggcauucagguggcagagagaaggcccuucguagcuuuuagguuguaauucaguucaguucuucggucuuuugagugccuacuaauacucuauacuugaugauuauaaaauaaauuguuuuuuuaaacuuugauuuuucuuuaaguuuuaauaacaagguaauuguuuaaaugucuucucagcuucucggugaacuacuacuagauagacacaacuucacaauuaugacaaaauacaucaguaaaccugagaaccucaaauuaaugaugaaccugcugcgagacaaaagucgcaacauccaguuugaggccuuucacguuuuuaagguagaguacuagaagcaucagugauacuguccacuggaauuguucgucgucuuucauucgcaaauaacggaaauuauuagccucacucugguaauccaggugacuuaauuaaauucagucacuuuucauauuugugugcuaugacuuuuaaacagaaagguagaccuggaaacggguuacuguuuggaucugggaacgagaagguuuguucauagaagagugucauuuaucuuuggccuagaagauuaguaacugcaaaacaaaagcauuucuuaaugcuuucuguggagguuucauucuuaaaaucccaucugaccucuugugcugagaaauaauuucugcccauuuuauucuaaaaucaaagucuguauuuaauacuaaacacuguguugcagggcuggcagaaugaguuuaucagucguauuuguguuaaaacauguaauuauuauuuuuuuuuccaaauuguaaaauaacgccuucuaaagcaaaaccuaaugacccugacuucagcgccaucccaggagagcacagcucugcuuuucugcacuguggccgcagcucagguguggcugcguuuuguccuuucucugugccucaugugcguuucucuccacgcagguguuuguagccaauccuaacaagacgcagcccauccuagacauccuccucaagaaccaggccaaacucauagaguuccucagcaaguuucagaacgacaggacggaggaugagcaguuuaacgacgagaagaccuauuuaguuaaacagaucagggauuugaagagaccagcucagcaagaagcuuaaucuccaauaaacaucuauguuaaauccaaauucagcauuugcuguuagcuauucagcaucaggcacucuuauugauucaugaggaacauuacugcuaaucugcuguuaagugaacgguuuuucauuuuacccuuuuguuuuucaguccagguuggagaucguagcugcugcugcuugcacacuagggcacaugugggcuuucucuugaucuuugugucauuucagaauucaaagacugugcuacgggaguucugaacauggcuggguucaugaaggcaaauguauggaugagagugugguuuaggaaagagggcacugauaucagauuagaccuauguguuugcacccaucuuuguuggcgaucugagugcaguguggcaagugcacaccuggcaucccugcgucagaucgcgcaccuucaggucgcgcaccuucgcugaaggaagaugacgcagagcuuuaucugaaaucagaggggagcuauccaaaaugggaguuugggggcagcuaaaguugacaugcgaauaaauugauacugaaacuuagcaacuucuuaaaaguguaaagaagccucauaagaucauaaggaaaauguauauaugcuuuucacagcuuucuagaauuuuuugacauuugauuuucuugagacuuguaaaccuggauauguugaaggguauuuguuaauuuuacuuuucaaagauacuuuaaaacaguagagcuagcaaugacaccuugcauuucauuucaacacugcuucaagguuucuuuuguauauaauucuuagaaugcucauuucuuuuaaaugguuuaauuuguacagcagaggaauguuauuguaguaguauguaacuauuaccuaauacugaguuuuugcaaaaaacaaugaaugcucauauguaauugaaauacuucagaucacaugaaaaugcugauuuaacauuuaaguaucacagcauuaaaagaaaaagaaaguaaaccaguccuuuguauucaguuaccuaauggggugccaucaauaagcugcgauacagcccuggagcucagucagccacaccuuccugcauccuauuggccuuauucauuuuaaaugaguuaaugaaucugccagaucugugaaugauagagauuaugcuaaauuaaugcugauucuuugugugugugggaaaucucuguagagcaccuuuucuuucuuagacuaaguaacccaguacaauaguugugaacugaauaauuaaaacuuuggcuucucuuaggaaaagacgacuuccuagucauagguguccuauggggaaauuuauuuuuuuuaauguccuguuccuuaaugcugcaaauuaucaguauuuauaaaguaacugauuuugcaccacuuuuuuguuacugugaccacggcagaacaaugucuucuagacuauaucuauguaaaguuauuagaaugguaucuguucauuuuagugauaugaagaucacaacuaacaacugacaaaucagaguuugccaguucaaauucagcauggcugcagcugauuaagaaauugauaugauuauucuuugcuagccucucuuacuaauggaauuauauacuggccaguaaaaugggccucccaauugcuguuucagcagguuuuaaaccuucaggaacaccaguuaggaaaauagcuccagaaaauauagauauauuuuauuuuuauuaaaauggcagucuacaucauaauuggcauuucucaagacugucuuuaccagaaucugugugaaauaaggcaaucuagucuccuugaaaaaaaaaucucuuggauguuuaggaaggaagacuuggccgugaugugguguccuggcuuugugguguagugcuguguguauggaguuaguguaaaaacauggauuacaccaaguggaagaaacgucuucuugccaagcucauucuuagaacuuacacaucuagaacagcuuccacuuuggcagugaggucguagccuuuuagguggaagaagugagggugcagcgugucagacacaacauucauguuacucuuacauuggaaucugaagguaguucagacuucguggguuuuguuuuuaagcaaaacaaugugaaaacauuuaaguuugaaauguugcauuugaaguuaugaucauuuaauauauucauauuaccaagacuauuauacuggaagugguuuuuguguuauaaagguuuaauuuuacauaaggcaguuacuuaaugugauuuuuaacccuuaaaaaaguggagauguauacauuuguuaacaaugccaugaaagcauuuucuuucuccuaaggaaaagugaauuucuuaucagaauaucuggcuggcccuguaauuuaaauuaaaauaaaauuuuggagaaacagcauugucugucuuu

SEQ ID NO: 12780 - RNA, 16919 nt, Homo sapiens
uguuuguuuuguuuuauuucauucuuagcacaacuuugcauauaauuagaaaccaaauaaauuuuaugaugacagugguucuuuuuaaagccugaaauuuauugauuugacuuuauuucauucgaauaccuuaaaauuuaaccagagugcuggauuguuuucauuuguagcuauauaaaauuauuuuccucauggaauaaucuuguccaaauuaggaaaauuagauauucuuaauacuuacaucuuagguuaaagagaugauuugauauaugacauaaaauucuuuauauaauauauucuuggcacauuuacaucucauucaucaucuuacucaucauuauguuugaugacaacugccaguucugcuauacauaacuaacuugcucuucaguuuugucaccuucauuuucagugaggagaagcguaucuaguagaaugauugaugaagacugaaugguugaacuucggagccucauuggacucugguacauggcaggguuaaucccauuucgaauuccauguuucuugaaaaacuuagaguucucugccauuggauuccggaaguagaucuuacuggagcguuuucugagaguuuuuacugacuuuguggcccgguaauugcaggugauauaucggccaaaugcaucccgaaaugucuuauugaagaggguguagaccaaaggauucacuccugaggaaacauagccuauccacacaaauaucuccaggagcauuuggagaguaguuugguuacaggaaucacauaaaacuaaaguuauauuuguaauaaagaagggacaccacauaagcaaaaagaggaaaaacacaaucccuaggaccuuugaggcucucuguucguuggaaauggucugcacugacuuuuucccaauuguggauguucuucgcauaaguguuucaucaccugaguugggcagagccuuguccuuucgagaaccauccagcauugccaccuuuuccggugacgagcaagguguuucaucccuuuggaaaacuguagacacagucaaccauguuaggcguugagguggcuuguuuuugacuaaguaagccuucuucuguaaagcauggauagugagaaaguaggugacaaucauaauugcaagaggugugaagaaggcagccagugagccaaagagcaugaaaucgccaaaacguuccuuugucagcacacaagugauauuguuuggguuguccacaucagucucuaucccuuuaauagggacuggaauggcaaugccuaaggaagaggaaaacaagauaaauugagucauuuuaugaccuguaacucuucgauuagauccuuuuggauuguauccuuauaacuuuaugcuuguuggugcauuauaauuccugggacccacaaugcaggauuugucgaagcauucaucagugaagauuugacaaacagaaccuaagugagcaaaucuguuuuuaaacggagauugguuaguaauuucagauuuauaaugaaagcuccccuaaagcuauaguauauccaugauacaguggagaaugucuucauuuauucuacauuucucauaaucuauuuuuguuuuuuaagcuaucucagauuaaggaagagaaauucagaagagaaccugcuuuuuucuuauuauccaguguaguugaucuagaggcacuucagaguacauuuauucaauaucuuuacucaguuuugucuuugagguuacaguuucauuuaacaguuuuuccuuuugauaugugugaaugucuuuuaauccuuuccaucuaacuucuuagggaaaacuaaaguucauuaaaaagugcuacuuaaaauuugagugugugugaaucaugauguugaaagauuaugaguucuuaaucuuucuucuucuguagaagccugggcacaguggcgcucaugccuguaauuccagcacuuugggaggccaaguggggguggauuacuugaggucaggaguuugagacaagccuggccaacauggcgaaaccccaucucuacuaaaaauaugaaaauuagccaggcaugguggcacgcgccuguacucccagcuacucaggaggcuaaggugggagaaucacuugaacccaggaggccgagguugcagugagccgagaucacaccacugcccuccacgcucagcgacaaaguaagacucugucucaaaaaaaaaguucuuuuaugaccugggaaagaaauauaccucauguuaguuuucugaucuuuaaauaccaugaaguauuuaaauaugauguuucuuagugaaguagcuuauuagaaagacaaauaauacagggguuaaccugaaucuuuuuccuuugaaacagcagauauuuuuuaaaugucugaauuaauugaucuuuagaaaccucuggaauccuuguguuguuuugugaauccaagagcaccccucaucuacacacccuuuuuaugguagcuaaagagccauugacaagaauauguuccucaaacccuuucuaacagaggucauuacuuucucuacuuuuccucauguacaccaccagaaagaggauucuguauacuuguucuacaccaggggucauuauacuacaguuugaggaccauuggcccacauucuauuuuuguaaaaguuuuauuggcauacugccacucccauuuguuaguaacauauugucuguggcugcuuuuguucuacugcagcagaauggaggagcugugacagaaaccauauacgcccugcaagcccaaaauauuugcugucuuacccuuuauagaaaaaguuugcugaccccugcuuuacccuguuacuuucagaucaccauuccacuguuuauuucucccccaaaacacuugccuuuugaaguuuauuuuaucuacuuaauacuuucuucuccaucuugcuuuucuguuaaccuccaugacauuuguucaucuucaucaauggcuucaguaccugcuauagucuucucuccacuguuccagugccagcauuuucuacuucaucccauucgugacccuucuaagaccuuaauuuuauauuucuugaacucuuugacucuaauuauuauuauuugcacuaaagccaucuacaagucuacuuagaacaaucccuaagauuaugaacucuaauacuucccuuccuuguccugcuaccccucacuccuagagaacuucuguuuccuguuauuuuuaucucuaguucauucauucaucucaguuuucacauucuauuaacucauucuauuaaugagacuucauucaucucaguuuuuacauucuguuaauaucaggacucacacuacuuuccuauccagcuuguuggucaauaacuguaaaaguuuucacugguacuuuuuaugcccuuacccuguuauauuauuauacuuucuguugccagguauuaccuagaauaacuguaaauccaaaagaagagagugagcucucuucagcauuuuguagaauuucagaacugagcuuauugucaucugcauuuucauuuuuucaaaguuauuaauuugugaucgguucuacaagacaaagugcaaugaagugaaagagcguugauuuuggccuuggugcugaaaagcuguaagaguucuuaagccaacugauuaaaaccucuagguuucuuuuuucuuaccuacaaaaggaagaaguggauuucuaaaucuauauaucaugagucuuccuuuuaaucuuuuuucuccugcaucacucaucacuuuguguuaguguaauuuguuuauauguccgccuuucuugaaugcaaagauucuuuuucuugaucaucuguguauucuuaguaccuagcacauuauaaacacucaauaaaaauguggucaauuuauaaauugaugguauccagccuuaaucuagaugccauuuauaccagcaggcugcuuaccuuauuagcuugaucacauuucacaguuucaaauauuuuaauuauucuuaaggauccauuucuucaacuuuuuuucccuuucucuguccaacucucccaccccaccccaauauacacauaccucacacucucccuugcccucucccucauugcagugagcuuaccaaaugugagucaucuggcauaaaugacuuuauuauaguuuuccuccucugcacuucaaauuuuaauuuucacccauugucucccauucccuuucuguagcugcuuuuggggggcugguucugcucugucggcaucugcccccucaucuagccuuuucucacuguuuuuaaaucucuucauucugaauagacuuuuucuugacccuguuuucuucccauaccagaggaguaacacagcuugcuuuuaccuccaaacuuuuucaaagagaucaagcccuuauaucaucauuucaggaauaugaaggucaaucucauuguuuugcuuucuugcuguuuuugccccagugccccuacucagauuagggaggaguaauuuaaguauuccaggucucuuaauuuuuugccucuuugaaauauuuuuacaaggaagaagagaaucugcuggucaaaccauuguaauuuuugcaaaucuauuuguuuuucugauacuaacauauaagaguuuugaaugauuuacgcauacuucaugauaagaaguauagcuuugaguauuauagaugaguacagggccguaagacgauuuagaagaaaaaggauuucuuuuauacauaauuucugaacaucgguauguuuucuuugcaucucucuuaaaacuuugaauuaaacauacucaaaacacuuaagugcagugacucacgccuguaaucccagcacuuugggaggcuggggcagggggaucgccagagcucaagaguuugagaccagccugggcaacaugacaaaaccccaccucuaccaaaaauacaaaaauuagccaggcauggggggugugucuguagucccagcuaccugggaggcugaggugggaggaucgcuugagcccgggaagucgaggcagcagugaaccaugauugugccauugcacucuagccugggugacagagcaagacccugucuccaaaaaagaaaaaacaaaccaaaaaaacccacugaagcagacacuuaacugccuuuaaucuguacacauauguacagaaauguuggcuuccaagaugaauuuguguucuuugauaccugcccacaaaauguuugaguuguuauuuuuguuuuuucucuuauuaaucuuuuaaaaugugauuuaaggugcauuucuuguuauuuuaauguaauuacaggauuccaaaugcuagcuagaccauaauuaucuguugggaaauaugaagacuguucucaaacuuaaccuuucugcauauagaaaucuaagcagaaagaaaucucaauaaacacugugcagaugguucuuucugaggacaugaguuuuguuacuugucacacuuuuuaccaacaguauguuuuagaaggcguaugauaaaugcagugacauaaggagcuuauguuaauguaucaguaggcuggcuugaccucucaugcugaguuucauugccuaccagaccugguauucuccuagccaaguggaaccaaagauuuuguauaccacccacacucuggcauucucuacauaccuauugaaauuaaccacaccacuguaaucuugaugaaugcuguagcccgugaguuauauugauuggccuggauuggcuuuuugauggcuauguaacgauccacugaaauggcacagagaugcaugauggaugcgguugaaaagagaacgucaagaaauaaccaggcaggacauagaacaagugggaggggccacauagccucugaaagaaacaaaaacaagacaaacauuuuauucuauaaaauggcaacuuucagucuacaguuuuucaggugauacaucuuuugucuuuuuuguuacucaucugaaauuuuauaacuuuaacaacauaauguuuaacuucagauaauggagacaacauuaaauucaauauuucuguggaugguaacuuuuaaauacauuuucuauuuugcauaauaauugugccuuuuuucuaagucagcagcaguuuaacuuuuuagcauuauuaugaccuuugcucuuuugucgauuccauuugugaucuuuuuaaaauuuauguaguauugugacuggaacuuaaccuugguauuuaaauaaaauuuauuuuuaaguagcuguuguauaaaaagaaaacauuuuaccauguagaggaaacaguaugacaaaaagcguauuagaaugggagucucugugacaccuggguuuugggcucacuucuagcaauaacuagcagcaagauccuuguuuauagcauacucuaguuuggugaaauaguggagugauuuuuuugacagaaauaguucucaaauaaagauugcaaaaggaauggcuucagauuauccggaagaaaaguagauuguuuccccuucuauauuucaucauucacuccaaaaacuggagauaaaauaauuaguacagacuuuugauuugaaaagaaaaucucaggguuagacguaguacuuaauuuauuuaacaaacucuuauaaaacacugcauacuucauauagucuuaagcacuuuagaaauauuaaccuuaaaaaaauuuuagguguggaugugauauugaauauucugcauaguuuucuaauaaauuuacuuacacagauguucauacauaugugaauuuaauauauuaugcauuauauauuacacccaccacuuaacauguuuacaguuucaaaacaacuaaaauuuuagaauucccccuagaauauuuccauuagaauccaguuuaacuccuguagagaacagaugucaugcaugugagauuaucuaagucucuuuuaggauuugauuguuauauguccacugauaaaauguaaucuacuuuucuucuggcuauugcagguauaucugacuuugacagguauaaagugauugucauaauugaaggaaaaccagaauaaucaucucaggauuacagaacaacaagagacucuucuauuguuaacuguuuaaaauuuaaggagccuggggguggagagagauuaaaaucucagaccaaaaaaaaaaaaagcauaauuuaggggcagaguuuuuagauagauuuggcuguuauuuucaagcaucaaguaggagauuuuuuuaaagucagguaggauuucagugaaaaauaucugggcacuugacaaaguauccagaagguagcaaggcugacacaucuacuuuuuggugccuucuguuuccagaguugguauguggcauucugaauaagaauauuaaaauauuucuuccuaggaacaaaauaacaaaaucagcacaaacuuuuacucagaaagaauaaaugauugggacuuaguucuauguucagcagcuucuuaaaaagggauuaaagcaucaaguggaaagggucauucauacuuuucaguguauuacuguaaauaaacuuugccugcuuguugaauuggggguaggaagggauagaggugguaaauuuuagauuuauugagcuggaaggaaccuuagagauuaccauugaucuugcagaugaguaaauucagguauaauuaagucugaauauagagguaaggaggggaggcauuuauuuauugaaauguaaauguuaucugaaaguguuauuuagaacugccacucagaguuugcucuuaagauggagagugaggaucggcaucaccuggguacuuagauaugcaggcucuugggucucaucucagaccuacuguaucagacucugcaguuaaauaagguuuccaggugauucguaugcaaauuaacauuugagaagcagugcuuuggaagacuuucugguaagguuugugucugagucuuaaaagaugcaccuaaguuuccuguuguaggguugguuauaggcacuuggaaugucucauggaaaggaacuaaugggaggccucucagaauaaauuaagucagagaaacugguguuuggagaaaaucuaaucaauuggauuuucucacucuuagccauagcauucagauuuuuugucauuuaguggaaaaggaccuuggacacaggcagcuucaaagcgaacuaacagucuaaguauagugaaaagaaucauuuuagaguuugcaguggaaacuacuaaaaaugaggguacaucuugagcugaaguucuagauuuaggacuguaaguagggugguaggaaaauacucgucuagagcuauaaucagagauauugauugcaguuaaggauuuaaaaggcagguaauuauuguguuauaucuuagauuuccuuccuugaaguccuuacucucucuguaacaucuuuuaaaauaguuugccaacuauuuaaaccugucuauuuagcuauucuaguuauggauuauacuucugaagauuaagguuuggaaaauucuagucauaaaucuaguugccauaagcaggaagccauaagaaaauucauauaaaaaguacgugucuuuggaauuugaccaucugauccacauacuccuaauugugggcuaagaaggaaaguuuuuuagugcugauuuaaguaacccuaugaagcccuguuagccucacuuuaaacagaauuuauaaacucauucccacuuaaaauucacuagaauuuucuuauuacaguuagugcuuuauuguuaacagaaauauugagaugugauacagaauuuucuuuaagaaagaaugagacugaaauuuauaagagagaugaaucuuuacaauuccaagccuuucucauuucaaguuucgugaaacacugguggauaguuuuaaugaaacuaauauaaaagaaaaagauaacugcauuaaauuaauagaaaccuuauauacaacacaaaaaagaaaaagaggcuuuuuuaaaugccuaauauauuuggguaaucuaagaauuuauagaaauuaaaaacaguucuagacacacuuguuuuauaaaggggcuuuuccuagucuagagacuuucauucuaaaaucauuuuuuaguuaguauuaauuuagcucaaagucagaaaaguuuauuucuguuuagaauaacuaaauuaaagguuaaguugguauggugaaauacuuuauuucaaaacguuuauuuuaggaguuuugguuuuaagaauuucuaauuacauuauuuguuauaauguauucuguccaauauacuuccacaaagacuuaagacauugaaaauuugaaauaaugaagugaaacaguuacauacuuaaauggaaagaaagaaauguguaucuaagggucagucugagggaaacaaguuacuagguucuucaacuaaauuacuguuauucuggggcucuaaauuagacucuuucauuaaaauuaagaaagaauaauagcauuucugucaaugccugaaauaauuacagacugaauauuaaagcaacaaaacaaguccuagaugggucuugucuuauagacaauuguuuaauuaucuaaagaauaucaguagcacaaauauuuuauuguuuaaaaugaagacugcuuuaaauucugccaugcaugagggaugguaggaguugucauucaguuauauaaauuuuuauuugucucccagacaagguucaacaacuucauagguaugggccuaggucuaauaccuuccacagaaaagagaucuugcagucaucugaaggauuuguacaaguauagguugacgcacaaguauucuuuuccacuuaauaugaaauauaacuuuaacugaaaagaauacugaguucuaacuugucccuaggggggaaaaaauucugugauccucugaacaguuacaugggguuauuuaagguauaaauguugguucuguaugccaaauaugacaguuuuggcuggucagauuucucauugacauuugagaaagcggaauaauaaagguuaagagugugaauucuagaaucaguccuccuggguuuaaaucaugucucugccacuuacuuuguaaucuugaacagauuacuuaucccucugcuucucuguccucuguaaaguggggauaauaguaccuguuuuauaggauuucuuuaauagaguuuauauggaugaugauuaaauacaugugaaguguuuagaacaguuccuggcauaaagaaaacacucaauaaauguuagugcuuauuacuauuguuuaacagaaacuagccaacuaacucaaccaugaaaacacuccuacauagaaacaagccaaaucaucaguaugaaauaagaguguuugucuuucuaccugcuguagcaaaagugcaugcaucugauucagcuuaaaacuuuaagcuguacuuuccgggggugagggaggaugggcugagaacaguuaacucuguuuaacuuucaauugaauuugucauaaaaguauguuuuuuacuaacguugaauuuuaacugcuguuuauuuuauauacgguacaggaaaauaaccuguaugcauugcaugccuggguuuuuuguugguuuggguauuuuuuuguuuguuuuugcuuucuuuugaauuaguacaaaaaccugaggaguuuuacuagaaaccccguaucuugaugaggcagacuuauuuuaucugaaaccugcuuaaccuuugggcagcuuuuuaguuugggaagucagguuacacuauuuguccggaaaauaauuagcaucaguccauaaaucugggacauaaaauguuucccuuuggaggauguaaaagacuauuuuuaaaggcauuccaagugggcuguuccuauaguuuacagagguacucaguucaugaacuuauugcagcaggacaaaucauaaauacuucuuauguccaaaaagaacauaauuuucaaauauacauuuaucucagaaauucuaaugcuucugucuuuaucuuccagaaaagaaagacauaguucaguucaaauuauuguuuaaaaguuucuguuuuguuuuuuacuuuuuucacuacauuugagcauaugaguuauccugggguucagugucuaauaugauaguguuuuaaauguuuuaagcauuuuaaugcuuacagaauuuuuuccugguuuuuaaaauuuccacuuuacaaaaagaagugccuuuaauucauugcuuuucuccuccauuucagaauuggguaggcuaacauuuuacugcauaaaugaauaacugccauuuuucucuuacugcuauacauuuguuucaucucugauuagacuugcaucucaacuaaaucauauuuaauuugcaugcaguacucuaccaguuacuauuagugcuuauaagaugcugggcccugcuugacaaggugauugagcucugaaauaauaagugauugaacucugaaauaauaagugacuugccugauccaacacgggagaaccaggauucagacccugggaugucuugcuucaaacagccaucuuucagccauuuuauauacucuuucagcuauaccacggauacuguuugaacuuauagaucaugaggcaucaauugaaacuuaaguuauagccagguuugguggcucaugucuguaaucccaacacuuugggaggccgaggcagguggaucaccugaggucaggaguucaagaccagccuggccaaaguggcaaaaccccaucucuacuaaaaauacaaaacuuagccaggugugguggccugcgccuguagucccagcuacucgggaggcugaggcaggagaaucguuugaaccuguggguggagguugcagugaacugagaucaugccacugcccugcagucugggcaacagaacgagacuccgucucaaaaaaaaaaaaaaaaaaaaaacuuauaaauaaaccaauaacacccaauggauggccagaugccauaucuucccguguuacuuuuuuuuuuuuuuuucccugagacagagccucaccccgucacccaggcuggagugcaguggcaccaucucggcucacugcaacucugucuuccggguucaagcuauucuccugccucagucucccgaguagcugggacuacaggcgcguaccaccaugcccagcuaauuuuuguauuuuuaguagggacaggguuucgccaucuuggccaggcuggucucgaacuccugaccucaggugauccauccguuucagccuccuaaagugcugggguuacaggcaugagccaccgugcccagccuccccuguuacuuuuuaaaucacuuauaaaaugaaacaaagauucagagaagcucuuaaauggugaacauccugucuuuuuuauaucagcauaagguguuguuuucuugcucaaguauuucuaacguagguauuuucaagccuuguguuauaagcuguugauuugugaucauggauuuuaggaauuauggacaagacaauaaaaaacuacaacuguaaagaucaaguccagugcucccagauaggaagaaguggcagaaaaauugaccuagcacaacucauuugaaagacaauguugugccugaguugucauaaucuugggaaaauaugaauucaaaccguauauuguuaaauauuauacagaucagugguugaauaaaauaucucucaguauaaggacagaagguccacuuuuauauuuuacugcucuuauuuuuaaaauuucauuuuauuagacuacgagcuaguauaguuuuuguguuacuuucauugaauuccccugcgauagcuaaaauuauugcucauagugauaguuaaucuuuuaucauagaaccaagaacgcuuguuuguacaaacguuagaaguccuaaagauuaacacuacaauaagaguguaaagucuaauucugccuuuuaaaguuaucagaaguucuuauaaaugcauuaguuuagaaaaaucuuuguguuuauuaacuugcaaaagguuauaaaaauaucuugguauuugaagucagguuuccauuuguaauacaugcaguucccaauuuaugaauucauccuuugaaguuuguuagagggcaacauguguuuuuuuccuacauuuuuucauagaaauugaauuaugcuuuaaauaaugcaauaauguauuagauaguaguucacagauuuguucauuuuuuaaaaaucuacaaaccccacuauacaacuuauuucugauaguaaaaguguuuggggcuauaaaauauuuuauuuuguaauuagaaauuaacaaacaugagccaggcaugguggaaugugccuguaauccuagcuacuuaagaggcugaaggcagaggaucacuugaacccaggaguuugaggccagcccaggcaacauugccagacuccaucucuauuaaaauaaauaaauaaaaauaaauuuaaaguuaauaaacauuuggaagaaugaaauaauauuaaaaugucuaucaauuauuuaagacauaaauaugaagacauuucacauauuuuauguuaacauauguuggguuuucugcuaacuuguauugcuaaggauauguuggguaccagcauuuuaaauauacacuuaaaguuuucagcugcuggauaccuauuuuucuauagaauacauggaaucuauuaaacagguaaaucuuuguuaccuguuuuuguauuuuguuuguuagcucacuuuaauucuaugguacuuugccuuuuaagauuccuuaacuauuuagcugauaauuuaaguaucuaccaugguacuuugcauauaauagauguuugauauuuauggacucaaagauuuuaaagcuaaaauucacuucugcauaauucuuucaauaucauguauugaaugacguauuaaauuuuaugguagucugaaauaagcauuuugacauuuucugugugccuagcaaagcacaguuugaagaguaugauuuuacaucuuaagcuacuauuaugcacauggagaugagagcuagaaucauaugccuguacaguauuuaucaaauaugcauauauauuucuacauaauacuuucuuuuaagcuuuauucagaauuaggguuauguucucuauuauaguaagauuucuuaauuauuuuucaugguuucaugcagcauuagauuauuuaaaagauuacaaauuuauaaaacagggagauagaaagacuguuaauuauuagaaagucuaauuaaagcaguagaacuuuacucauuacugcuuguccugccacauaauuuucuugauuuauuuuaaagcccagguaaauguugauuuaaaauggaagguguaaaccuguuacuaucugauaauaguuuuagauaucuuucuguuauuacuuauaaaauuguaauguguaaaaccuggguauaauaguuggaauagcagggguuuuuuaccuucuaauauggauucuaguuuaauaaauuuuacuucuguaacuuaaaauauuuuuaucuucauauaaguaaauauaauucuaagaaacuauaucugccacaaguaaucauuuugcuuaggcaguuuaugaauggaauaucaguuuauaccaagcauugaauaaguuaaauauccuuuuaaugcugauuccaagggucuaggagcccucauaauucaucagcagaauuauuuguguuuauccaaauuuuauaacuagagaugauaugcagaaaucuggaacuacuuauaucuuuuuuuuauuauagcaaacuaagauuucagugucaaacuauaccuuuuauuaucgcaauaacuagguuuuaauccacuuaccaacuuagaggccuaucaggaacacagaugcccauauaucauaaaaaaauugaaucgauagaucaucucuuuggacacucugagccaaaccauuuccuucagcaacuaaacauaauuuuucuuaacaugacacauauguaggaauuguguucaaguuuauaauauacaaacuauuaagagcuauaauaagaauuuuuggacaguuccaauuuuaaacugggguuuagugauuuaaauugggauuuaguaauucaaagaccuuaucguuaacccagcgcauaucugucccggaaguguccuaguuauugcuuugaggaaaaaaaguaucaguguagaaaaguuaaaguauaggccuauuuacuauaauuuauagauaauauauucagaaucuauaaauaucacuaacuugaaugacuuuuuaaaugauuuuauuagauagcuuaggagggagaaaaauaguuuacaaaaaauauuuuuugcucuuuaaaacugcugaucaaccauagagaaugauauaaaacaagggacuguuuacuugccguaucuuuaaauaguccaaguucaucuuuuauuucaagaaaaguaaagauuaaaugaguguccauucucuaauaguauaucauaguucugugguuugauggcacaaacaaagugaaauacuuaccaaacauuauugucaagagggcaauuggcaucacaaacaauccaaccagcaaaucagccaccgccaaggacauuagaaaguaauuaguagcauacugcagcuucuucuccagugaaacagccagaauaacaaggguauuuccaccaauuguggguauuaucaccaugaguaucagaagagcugcccagugcaguuuauuucccuguuccucaacaaucuguuucauuuccucugguauugauucugucuguaauccagaccaguuagaagagauaacgugaacaaaggugcucugcaaaaugugcucaggaauugugcuuugaaguucagacacucuguaagagagagccauuugcuguuuuucugugauucaaucccguuccgaacaguggucagcaugguuaguagcuaagcugcucaucuguuuuuuuaaggcauuguaaccaugccaaacacucaaaagccaaaguugacaccuuccuuuaaaaaaaaaaauucaaguucucuaaaaugagcgcauacacacaucuguccauguuuguagguaagauauccaaguauuuauuauuuucuagaggcuuaaauuuaggaaagcucagugaaagaaacugauagcugugaaaaaaauaggauauauauauauuuuuaguuucucucucucucuuuuucugccguaguuguagagucguguuugaacuugcaugccagagaguucccccuagauacaaaauacauagacugcauuauuuuauucauuucugaaagugguaaaaacacuugaacuucauagcccuucccuucuuaguaagucuguugugcauuugugacaaugcagccaauucuccaaauauacuguauuucugauguugcucaguuaaugaaacagaagacacauuaauuuuuucaaugguuauaauaaaaaguuagguguuuccugacccuugaaugucuuuuuaccuuuacuuacagaagaauagaaaagucgaaacacaauaguucagaauagaacuuuuaguaugcgcuggccacccaccuagaaacacucaaagcccaacaagggucuaaauaaauguuuuaccagcuagggauccuuauauguaauuagcuuugucuuaucagguuugugaguacugauauaaaugucauuuuagauuuccuuuaguuugagagaaggaaaaaaaaagguauuacuaggauccaaauaauuguguuuaguaauuucaucucucaugguaugucuuugcaacaauuguguucuaaauuuaaucacuaaauuugccaaauucaaaccaguucuuuuuuuguuuuaaguaguguuuauuuuuuuaaccuucccaguugccuugagaagaaagggaaaccaaaaggaagauuagaccauuuauuuguucaucaaauguacaaaucacguuuuuaaaaacucuccuuuagcauuaguaaauuuuucauuuugauuuuuaaaccgcugaauagaaaugaaagauuaugauagcagaauucuugaagauuaaaaaaaaaaaccuuuagauuaauuccauauguguuuauuaaaugcuuaccucugguuucguuguuauuuugcugagcaugucaucuuaucuguucacuagacuugcuugcugcugugacugaaauccuccucccauugacuuauucug

SEQ ID NO: 12781 - RNA, 5127 nt, Homo sapiens
cucagaggugggaggaaccccagaggugaagagagggacauggugggggcacaaaaaaagcuuccagagccacaggccugggcgaguccugacauggagcccagucucauacggccucuuucccuaguggcuggcuuugcuccuggcccuagguagcccaacagcugggcaagggguccgucuggucaggggaaaggugcaggggcagaagguagcagagggagaaaaggacacccugucugccucuggccccaaagacaaguccgaauggggccagagggaaauggcugggccuuggggugccccagggucuuggaggggaccggguguucagguuucgcacaaguacaggagggaccggcgaccgcccuccccccgccccgggaggcuccgccagggacaggcguccccgggauuggaggugacccccguggguuccgaagccccgccucggccaugcacugucuacuaggcgcgcuuggggagccuaggggccgucucggagaaauggggugguccccgccaggcggcggcggggcgggcccugggcgccgaagggguuaaggcaccugggccaccgccccugccggccccuccucccgcggccgggaagaggaaagucgcggcgggggcgcggcccggucuccguccccacccgcccgccgucccgccggcccgagccguggcgcccagagcugcgagccgcucgccccuccgccgcuccggcccgggccgccaugucgcuguggugaguggggcugggggccgucgggggccugggcgggggcgugggcccggggcucccccuccuccguggccacagacgggcgccgggacucccgggauaggagaugcccccgcgcgcgccgcgccggccucaguuucccgggggcggaugggcgggcgggcgcggcggcggcggcgggagauguucgcgguacgcggccccggacccgugggggacgucgaggggucucggggcgccgcgcucagcuccccggccccgcggcccuggacaccgcuccaggacccuggcggcugggaccccaggucuugccggcagcuggguccccucucccuuccagaccccugagggcccccugcguccgggccacucuccuccucucggggcuuccuuccgcgggaccucggaccgccgcccgcccggccccucuccgccccucccgggcuuucccuacgaauggagcggacccggcagguggagcgcccgcagcccagggccucgccgccuucccggugcaccccccgaccucccccgucccggccucggugggcggcuucccuggaaccccuagggcuggcagggccggauccggagcccuccguuuccuccccggagagcuggaccuugggucacaccccccagccugcaccuaaggugccccugucuuccuccaaccacaugccccagcaaccuggggacccuauggggaaaaugucgcucuauggggcucagccugcauucacccuggggccuggaccugcaaccggaccagcccucagggcaacccaggcgucuccacgggcugccugucucuccuggcacccugcuccucccccuuggaggucagcgccaucucucugcuaggcuggcccuggaaggccacucugcuguccccagagcucucagcccccaggucuccacuggggaggguggggcagguguccuggcagcccccggagggugagaugaagagaggagguccuucaggacaggggcucaggccccagggcuugggacgaccagcacuccuggcagagagcucuaauuucugcuuccgaaauggguguggaccgggguuggggugggggggucucugggcaagaagggucccucaagggcuggagcugcaaaugugcccccucccagggaguagagcuguagccucaugucuucuaaugggguguuaugagcuggggauguuaagguaggggugaggggcagugccaugcuagaggugcucacugcauccuugggccuccaucaaccaugagggcugcucuuuguugggugagacagacuggagaagggggaggagggccagucuuccucaggucccaagcucgagccacucuccaaugugccccacaugugauggagcucccgggcggcacagaggaucagagggugcccucucaaugacucuggcucugagucaccuaaugauaccgauaccuacugcuguggguagguacaccgcagggaaaugaaaggcauugggguuccaggcguggggaacagggcagagguuuccaccugaggcccuccuguuaaggugacagcauuccccuaacugugcacccgcugccugguacuuuauauagcacuccaauccuguguuuuagccccauuugggggaagaagaaaucguggcucagagugguuguaaaccacucauucagcuuguaagcgucagggccugauuccacagugcuccuugaggagagggcagggugggagaaagaaagggcagggugggagaggaagcgggacccuacccugacagcuuagggacuccgggacugagccugugcccagguccacuugcccgucugggaccacccagccucccaaggggggcgccaggagagcccugggcucaucuuuucucucuccucuguacuguccgcucucccccacaggaagaaaaccgucuaccggagucugugccuggcccuggcccugcucguggccgugacgguguuccaacgcagucucaccccuggucaguuucugcaggagccuccgccacccacccuggagccacagaaggcccagaagccaaauggacagcuggugaaccccaacaacuucuggaagaacccgaaagauguggcugcgcccacgcccauggccucucaggggccccaggccugggacgugaccaccacuaacugcucagccaauaucaacuugacccaccagcccugguuccagguccuggagccgcaguuccggcaguuucucuucuaccgccacugccgcuacuuccccaugcugcugaaccacccggagaagugcaggggcgaugucuaccugcuggugguugucaagucggucaucacgcagcacgaccgccgcgaggccauccgccagaccuggggccgcgagcggcaguccgcgggugggggccgaggcgccgugcgcacccucuuccugcugggcacggccuccaagcaggaggagcgcacgcacuaccagcagcugcuggccuacgaagaccgccucuacggcgacauccugcaguggggcuuucucgacaccuucuucaaccugacccucaaggagauccacuuccucaaguggcuggacaucuacugcccccacguccccuucauuuucaaaggcgacgaugacgucuucgucaaccccaccaaccugcuagaauuucuggcugaccggcagccacaggaaaaccuguucgugggcgauguccugcagcacgcucggcccauucgcaggaaagacaacaaauacuacaucccgggggcccuguacggcaaggccagcuauccgccguaugcaggcggcgguggcuuccucauggccggcagccuggcccggcgccugcaccaugccugcgacacccuggagcucuacccgaucgacgacgucuuucugggcaugugccuggaggugcugggcgugcagcccacggcccacgagggcuucaagacuuucggcaucucccggaaccgcaacagccgcaugaacaaggagccgugcuuuuuccgcgccaugcucguggugcacaagcugcugcccccugagcugcucgccaugugggggcuggugcacagcaaucucaccugcucccgcaagcuccaggugcucugaccccagccgggcuacuaggacaggccagggcacuugcuccugagcccccaugguauuggggcuggagccacagugcccaggccuagccuuugguccccaaggggagguggaggguugaggccuacgugccacugggugugguggggugcagguagccagaaagggaccucccuguguggauaauucuaggaaacugaggcccaggaacgguuggagcugcccagucuggaggcccucucugaggagcgaggcgccaggcccuggcagcccuccugaccuggguccguugcuggcccccucagauguggugggagguccuggugaccucuggaggaacgcugugcucagguaccugggcuaggccuggccugaugggucuguggccgccccucgucuucacagggaagagucuucugugaaaugccucagucuccccagaggccgggcggcccuggcaggagaaacucaacccugugcgggcucacaggcaccccccaguccacacccuggucuccugggagagagggcccagccggcucuccgcagccccaggccugccuggagacgggccgccucugccacagggccuccacuccuggcuguguccuguaaggucuggaagggcgaccgcucugacuaccucagcgccccucagaaucucccuggggcugcagcccuaccccaccccgacacagggcagaagagcagcgcuccuggccccccgaagucccagagcugcugacccccaccccaggcaagucucucccgcagcccccacacccccaggccuggcucccuggcuggaaagcagccgguuuggcccuggaaguggacauuccucuauuacugugaaguuuuauuuaugaagaauuuggagggagaaggcuccaggcuucaggagggggugguguccucccuggcccuccucccuucccuccccucauuccagcugccugcccucagcacccccaggccccucacagcccagcccccuccagagcccugccccaccgcacccugcuucuccagggccuagcagaccagcaucugccccggugaagggauggaucagcugugggggugggugcagaagguugccaccuccuaccucagcgggagucaccuaggaaagauggagggauugacacuauuuucucaauaaaaugggacuuuuuuuuuuuuuuuuuuuuuuuuuuggugugaaacuuccuguucccagcugcaucagagagccugucuggggccaagguugccagagauuucugaag

SEQ ID NO: 12782 - RNA, 5127 nt, Homo sapiens
cuucagaaaucucuggcaaccuuggccccagacaggcucucugaugcagcugggaacaggaaguuucacaccaaaaaaaaaaaaaaaaaaaaaaaaaagucccauuuuauugagaaaauagugucaaucccuccaucuuuccuaggugacucccgcugagguaggagguggcaaccuucugcacccacccccacagcugauccaucccuucaccggggcagaugcuggucugcuaggcccuggagaagcagggugcgguggggcagggcucuggagggggcugggcugugaggggccugggggugcugagggcaggcagcuggaaugaggggagggaagggaggagggccagggaggacaccacccccuccugaagccuggagccuucucccuccaaauucuucauaaauaaaacuucacaguaauagaggaauguccacuuccagggccaaaccggcugcuuuccagccagggagccaggccugggggugugggggcugcgggagagacuugccuggggugggggucagcagcucugggacuucggggggccaggagcgcugcucuucugcccugugucggggugggguagggcugcagccccagggagauucugaggggcgcugagguagucagagcggucgcccuuccagaccuuacaggacacagccaggaguggaggcccuguggcagaggcggcccgucuccaggcaggccuggggcugcggagagccggcugggcccucucucccaggagaccaggguguggacuggggggugccugugagcccgcacaggguugaguuucuccugccagggccgcccggccucuggggagacugaggcauuucacagaagacucuucccugugaagacgaggggcggccacagacccaucaggccaggccuagcccagguaccugagcacagcguuccuccagaggucaccaggaccucccaccacaucugagggggccagcaacggacccaggucaggagggcugccagggccuggcgccucgcuccucagagagggccuccagacugggcagcuccaaccguuccugggccucaguuuccuagaauuauccacacagggaggucccuuucuggcuaccugcaccccaccacacccaguggcacguaggccucaacccuccaccuccccuuggggaccaaaggcuaggccugggcacuguggcuccagccccaauaccaugggggcucaggagcaagugcccuggccuguccuaguagcccggcuggggucagagcaccuggagcuugcgggagcaggugagauugcugugcaccagcccccacauggcgagcagcucagggggcagcagcuugugcaccacgagcauggcgcggaaaaagcacggcuccuuguucaugcggcuguugcgguuccgggagaugccgaaagucuugaagcccucgugggccgugggcugcacgcccagcaccuccaggcacaugcccagaaagacgucgucgaucggguagagcuccagggugucgcaggcauggugcaggcgccgggccaggcugccggccaugaggaagccaccgccgccugcauacggcggauagcuggccuugccguacagggcccccgggauguaguauuuguugucuuuccugcgaaugggccgagcgugcugcaggacaucgcccacgaacagguuuuccuguggcugccggucagccagaaauucuagcagguuggugggguugacgaagacgucaucgucgccuuugaaaaugaaggggacgugggggcaguagauguccagccacuugaggaaguggaucuccuugagggucagguugaagaaggugucgagaaagccccacugcaggaugucgccguagaggcggucuucguaggccagcagcugcugguagugcgugcgcuccuccugcuuggaggccgugcccagcaggaagagggugcgcacggcgccucggcccccacccgcggacugccgcucgcggccccaggucuggcggauggccucgcggcggucgugcugcgugaugaccgacuugacaaccaccagcagguagacaucgccccugcacuucuccgggugguucagcagcauggggaaguagcggcaguggcgguagaagagaaacugccggaacugcggcuccaggaccuggaaccagggcuggugggucaaguugauauuggcugagcaguuagugguggucacgucccaggccuggggccccugagaggccaugggcgugggcgcagccacaucuuucggguucuuccagaaguuguugggguucaccagcuguccauuuggcuucugggccuucuguggcuccaggguggguggcggaggcuccugcagaaacugaccaggggugagacugcguuggaacaccgucacggccacgagcagggccagggccaggcacagacuccgguagacgguuuucuuccugugggggagagcggacaguacagaggagagagaaaagaugagcccagggcucuccuggcgccccccuugggaggcuggguggucccagacgggcaaguggaccugggcacaggcucagucccggagucccuaagcugucaggguagggucccgcuuccucucccacccugcccuuucuuucucccacccugcccucuccucaaggagcacuguggaaucaggcccugacgcuuacaagcugaaugagugguuuacaaccacucugagccacgauuucuucuucccccaaauggggcuaaaacacaggauuggagugcuauauaaaguaccaggcagcgggugcacaguuaggggaaugcugucaccuuaacaggagggccucagguggaaaccucugcccuguuccccacgccuggaaccccaaugccuuucauuucccugcgguguaccuacccacagcaguagguaucgguaucauuaggugacucagagccagagucauugagagggcacccucugauccucugugccgcccgggagcuccaucacauguggggcacauuggagaguggcucgagcuugggaccugaggaagacuggcccuccucccccuucuccagucugucucacccaacaaagagcagcccucaugguugauggaggcccaaggaugcagugagcaccucuagcauggcacugccccucaccccuaccuuaacauccccagcucauaacaccccauuagaagacaugaggcuacagcucuacucccugggagggggcacauuugcagcuccagcccuugagggacccuucuugcccagagacccccccaccccaaccccgguccacacccauuucggaagcagaaauuagagcucucugccaggagugcuggucgucccaagcccuggggccugagccccuguccugaaggaccuccucucuucaucucacccuccgggggcugccaggacaccugccccacccuccccaguggagaccugggggcugagagcucuggggacagcagaguggccuuccagggccagccuagcagagagauggcgcugaccuccaagggggaggagcagggugccaggagagacaggcagcccguggagacgccuggguugcccugagggcugguccgguugcagguccaggccccagggugaaugcaggcugagccccauagagcgacauuuuccccauaggguccccagguugcuggggcaugugguuggaggaagacaggggcaccuuaggugcaggcuggggggugugacccaagguccagcucuccggggaggaaacggagggcuccggauccggcccugccagcccuagggguuccagggaagccgcccaccgaggccgggacgggggaggucggggggugcaccgggaaggcggcgaggcccugggcugcgggcgcuccaccugccggguccgcuccauucguagggaaagcccgggaggggcggagaggggccgggcgggcggcgguccgaggucccgcggaaggaagccccgagaggaggagaguggcccggacgcagggggcccucaggggucuggaagggagaggggacccagcugccggcaagaccuggggucccagccgccaggguccuggagcgguguccagggccgcggggccggggagcugagcgcggcgccccgagaccccucgacgucccccacggguccggggccgcguaccgcgaacaucucccgccgccgccgccgcgcccgcccgcccauccgcccccgggaaacugaggccggcgcggcgcgcgcgggggcaucuccuaucccgggagucccggcgcccgucuguggccacggaggagggggagccccgggcccacgcccccgcccaggcccccgacggcccccagccccacucaccacagcgacauggcggcccgggccggagcggcggaggggcgagcggcucgcagcucugggcgccacggcucgggccggcgggacggcgggcggguggggacggagaccgggccgcgcccccgccgcgacuuuccucuucccggccgcgggaggaggggccggcaggggcgguggcccaggugccuuaaccccuucggcgcccagggcccgccccgccgccgccuggcggggaccaccccauuucuccgagacggccccuaggcuccccaagcgcgccuaguagacagugcauggccgaggcggggcuucggaacccacgggggucaccuccaaucccggggacgccugucccuggcggagccucccggggcggggggagggcggucgccggucccuccuguacuugugcgaaaccugaacacccgguccccuccaagacccuggggcaccccaaggcccagccauuucccucuggccccauucggacuugucuuuggggccagaggcagacaggguguccuuuucucccucugcuaccuucugccccugcaccuuuccccugaccagacggaccccuugcccagcuguugggcuaccuagggccaggagcaaagccagccacuagggaaagaggccguaugagacugggcuccaugucaggacucgcccaggccuguggcucuggaagcuuuuuuugugcccccaccaugucccucucuucaccucugggguuccucccaccucugag

SEQ ID NO: 12783 - RNA, 1184 nt, Homo sapiens
guagcagagggagaaaaggacacccugucugccucuggccccaaagacaaguccgaauggggccagagggaaauggcugggccuuggggugccccagggucuuggaggggaccggguguucagguuucgcacaaguacaggagggaccggcgaccgcccuccccccgccccgggaggcuccgccagggacaggcguccccgggauuggaggugacccccguggguuccgaagccccgccucggccaugcacugucuacuaggcgcgcuuggggagccuaggggccgucucggagaaauggggugguccccgccaggcggcggcggggcgggcccugggcgccgaagggguuaaggcaccugggccaccgccccugccggccccuccucccgcggccgggaagaggaaagucgcggcgggggcgcggcccggucuccguccccacccgcccgccgucccgccggcccgagccguggcgcccagagcugcgagccgcucgccccuccgccgcuccggcccgggccgccaugucgcuguggugaguggggcugggggccgucgggggccugggcgggggcgugggcccggggcucccccuccuccguggccacagacgggcgccgggacucccgggauaggagaugcccccgcgcgcgccgcgccggccucaguuucccgggggcggaugggcgggcgggcgcggcggcggcggcgggagauguucgcgguacgcggccccggacccgugggggacgucgaggggucucggggcgccgcgcucagcuccccggccccgcggcccuggacaccgcuccaggacccuggcggcugggaccccaggucuugccggcagcuggguccccucucccuuccagaccccugagggcccccugcguccgggccacucuccuccucucggggcuuccuuccgcgggaccucggaccgccgcccgcccggccccucuccgccccucccgggcuuucccuacgaauggagcggacccggcagguggagcgcccgcagcccagggccucgccgccuucccggugcaccccccgaccucccccgucccggccucggugggcggcuucccuggaaccccuagggcuggcagggccggauccggagcccuccguuuccuccccggagagcuggaccuugggucacaccccccagccugcacc

SEQ ID NO: 12784 - RNA, 1387 nt, Homo sapiens
cggggcaggcgggggccgggacacagaggcccuuucagccccggaaggcugcgggcccgggcggggcggggcggcacccuccaggaggacgcccggccuucuccccacuucugccugggaggccccuggcccgccgggcuuuguccuauuuauaaacgugcuccugaguaaacucccugaagaaaggggccucugugugcggcagcccggcccacagcgccgcccucagcacacaguaggcgcucagcauggccuucucaugggacugaggacaagcaccgauccuugggagcugccaggcgccuccagcacccagaaccccugacaucgagcgccuggacaccuguucccgaagcccugugagcugaugggcuacguaaccucugggccgcaaugcuagaauaaaaugcauggacacuuguuccaaaacgauggagggacggugugggaaacaggccccagcccugucgacugagggugaaugcacgagugaaagugacaauacauggguaaacugaggcaggcggcaucagccguagaggagagaggaugagguuccaaccugggguguaagagaaacaagaugcuacaggagcagaagggccaucagcugugcuaagauaaagcagggaccuaaauuugggccugagagcugguccaggccugccaguggcaguggcucaagacguggggcgcugugacugggucucagacccagugaugccaccaacccaggcuucucccaggcuccucccccaguagcacucugucacuacagggugacauccaggcccuucacgaucugucuccagggagccaccaccucccccagcccaacaggccaagcacugacauccaaaccaacugacuacccaggagccugggcaugcuuuguccgucuggcccagggaggcaucugcccaucccugugaauagcagcgucucuccucaacagucagugacugccuucugacagccugaccagggggucugagugcgagaggcaucuggcaucucugaaaaagcagcuccagccuggcuuccagggcagggacucuccacugccagaucugcagacucuccaccaccagggcgccuacugcaguugggaaaagccucagaucuauguccucuccugucuggguggagcaggcaccaugaucccuguuucaugcacaaggacauugaugcgcagggacuacaggacuuguccaaggaugcacccgagcccacgucccaccuagguuccccagucucucccagacaaucccucagaaaacaguccugggcccaggaaccagagcugcugagcaggcccagcuacguaauuuguggagcccagugcaaauugaaaauuugagacccuuuguuaagaaauuaugaagag

SEQ ID NO: 12785 - RNA, 1387 nt, Homo sapiens
cucuucauaauuucuuaacaaagggucucaaauuuucaauuugcacugggcuccacaaauuacguagcugggccugcucagcagcucugguuccugggcccaggacuguuuucugagggauugucugggagagacuggggaaccuaggugggacgugggcucgggugcauccuuggacaaguccuguagucccugcgcaucaauguccuugugcaugaaacagggaucauggugccugcuccacccagacaggagaggacauagaucugaggcuuuucccaacugcaguaggcgcccuggugguggagagucugcagaucuggcaguggagagucccugcccuggaagccaggcuggagcugcuuuuucagagaugccagaugccucucgcacucagacccccuggucaggcugucagaaggcagucacugacuguugaggagagacgcugcuauucacagggaugggcagaugccucccugggccagacggacaaagcaugcccaggcuccuggguagucaguugguuuggaugucagugcuuggccuguugggcugggggaggugguggcucccuggagacagaucgugaagggccuggaugucacccuguagugacagagugcuacugggggaggagccugggagaagccuggguugguggcaucacugggucugagacccagucacagcgccccacgucuugagccacugccacuggcaggccuggaccagcucucaggcccaaauuuaggucccugcuuuaucuuagcacagcugauggcccuucugcuccuguagcaucuuguuucucuuacaccccagguuggaaccucauccucucuccucuacggcugaugccgccugccucaguuuacccauguauugucacuuucacucgugcauucacccucagucgacagggcuggggccuguuucccacaccgucccuccaucguuuuggaacaaguguccaugcauuuuauucuagcauugcggcccagagguuacguagcccaucagcucacagggcuucgggaacagguguccaggcgcucgaugucagggguucugggugcuggaggcgccuggcagcucccaaggaucggugcuuguccucagucccaugagaaggccaugcugagcgccuacugugugcugagggcggcgcugugggccgggcugccgcacacagaggccccuuucuucagggaguuuacucaggagcacguuuauaaauaggacaaagcccggcgggccaggggccucccaggcagaaguggggagaaggccgggcguccuccuggagggugccgccccgccccgcccgggcccgcagccuuccggggcugaaagggccucugugucccggcccccgccugccccg

SEQ ID NO: 12786 - RNA, 5399 nt, Homo sapiens
cuugagacagcuuuguuagaacaacucagcaaaauaaaauuccuguuuauuguuggacaacauuguuucacacauacaucaaacaggccaaaaaaaauaaacagcaacuucauagacaaaaaaggaaaaaaaaagaaaccuuuuaucuuuggccuuuuuaaccaucucauacaaaccaacuacuuauaguacagcuaaguacauacacaaaaaaguuacuggaaugcucggaauaagauuguuuuucuguugucauuuuugcuuuuuuuacaagguuuuuuuucuccuuugagauuauaaugaacauggucacaccacaaguaaagucagaaguaggacagagaacgcuccgaaggcugguuuggucauccgagaucauuaaaaauggcugacccuaacaauauguacaaaaauauaaaauguaaauaaaaaauacaaacaaauuuccuuuuuaaaguacuuuuaagaaaaaaagcagggccuuggaaguuuugguucuuuuuuccuccccuguugcaaauucucaugguuuggguugggugguggagagcgcgugucaucugcggguggcacugcccacggugggcgggcgggccucucuacucgaaggugaccacguuuagauucugagacgggaaguggagggugaauaggucacggcggccuuuuuuuuuuuaguuuaacuuuuccuuuuuugcugucuagucauccucgucggucuucugcuucuugguaucgacaucgucauccuaagcagagaaagacugucaaaggccccuccaaccccaggagcccuauccagcccacugccucagcuccugcuggcagagcaagaaccagggacccccagcuccacagcccaaggccucugggaaguugagcccagcccuguuuccuuccuguucuuaagauucaggaccacacaguggccaccuacaaagucagaaacagucccuccgcagcuugagcaccucagcuaaaggcagguggggagacccagaugccaaaccccccuucuucucaagccagaacccaccucaucaucuucagcugcccgcuugcccguagcugacucagcuuccucaucuucaucuccauccucuuccucaccuggagagaaucaaaggccagguaaaccacacuucccuccuacuguggcuccuggggaaaucccgaggaacauguaguggacugcaaggucccugcccugccucuacugccugcaacugggcccaaucagggcacccacgcccacuacacaggugggacucuccagaggagagaggcccaagcagcugcaccccaaaaggccagcccaauagaucaguggcuuucagagcugcacgaaagaaacuuucaggugugcgagugagugugagugggcaugggcacaacuccaugucagggagaccuucccugacucuacaggugggugcccagggccaugugguccacuggccccaaguaccauugucccacucccaggagccccaauuccuuccuuccccuucugccagacaaggccaggaaaaaguaccugaaaaggggaagauagacaaggcuacucaccaucaccuucuucuuccuccuccucuuccuccccaccuucuuccucuucuucgucuaccucauugucagccuccugcuccccauuuuccucauucuccucgacagaaaacaggccaugucauuaccagcuggccccaggcuggacagagcguugcuccugaugcccggccucccaccagaggcuggcggcugcaucuacagcccagccaagccaagcccaccccagagacccuucuccagucaacacccuccaggcuccaucaugaaaccugcacauuaacugccccaggacaagggcuuuuccccacccugggccaagcccaaacucagacuaccggagucuccucugaaccuauucuuguucaggcgcugcucgaaagguuuuuauaaauauuuaacuagcaauaaucgcgccucggguaaagcucauuggcuacgauacugccacugugcaaagcuauacauauacacauacacacacauauauagguauguuuaaaguagaacaggaaaaauuuuguggggcgguagcugccagggcucaggagcaaagcagacacucacagcauucccguuagcaggggcgucucuuccauuuucugccucuuccacaacuuccuucuucuccuuuaaguccuucaaaagggaagaaggaaccaguaaccaguaagucuucugagcaacccaggguaagcaaaggcgcugagaacuacuggucuguacggcuguucuguccgucccaaauuaagagucgcauguugagaaaggccugaugccccugcggucccucucccacuggucugguggaaggaaggccggcggggggcaucugugaucaagguuucccauccuuuaaggcccgcuacagcggccccgguggcgguucccacugcccccuggcgcuucccaggaaaaaggagccauguggcgccacagcccccagcccguccggccggguggacgagccccggacacucacgcccaucagccugcuuccaagugcaaagagcccgccccucgagccgucuagaaaggcggcagguuauguuccaaaaauaaauaaggcaaagagagaggggccugcgcucggggagagccccacaggcgcgccagccuggaaggcccgcgaggccgcaccgccccggccaggacagguaucuaaaaaagccaaagcacaccgaccccccaaauccgaccgcuguuccuagaggccgcaaaccgcugcuuggcggugccccaggccggggccugccgccggagccaccaacucccggccuccccgcggcggcuagggaucccgacagcaccucgggggugggacuccgcccgggauccaaaaggcagcgcggccccgggcgcccgguaacuuuuuccacacgacacggccaccaauaccaacagagguccggcguccgggccugcgggaaccccucggccgcuguccggcgagcggcuccgggccaccugucggcccucucaguccggcccgccccgcuccgcuccgcggaccccggcuccgcccgcucucgcccccuggcggccgaagccccggggagcagugggggcagggaggucgcggcgcgcaggcgcgcaucccccgcccggcgggcuuugcgcgcgggccucggcacgcaccgcgcgcagggagcacguggcccggggccgccgagugcgucccuugccuuggagacucccggccggcaggcagagcuugcaguggcacgcgcgcgggucgcgcgucggucggccgggcucucgacucgacgccccacugccgccaccccggcaggcccgaaugucugcauucggcgggccaagucccacgggaggucgccccaaaguccaccgggcugcguagguccgagacugucggggaugcgccucucgggcuacuacucaucgcccucgcgggaagucaccuuuuggugcuucggagaaaaucgaacagccaggccccgcacuggggacgguguucucaccccacaaacucauucccggacugaguccagaaggggucacugagagccccuguggagauccgggccccgagcuccgcucugccaagaagucgccccugggagagucagagaugacgccagggacacaaggguuaaggagacgccaaggugacucgcgccaaucccugcaggggcacgacgggcgcggacgagggccgaaauauuaagaaagagccagucagucugagagcgccccgcucccgccaagggcggagacgcuacccagggcgggcagugggaccgaggcggcgccgacaacaggagcggagccgcaccagccgcgcaggaccucauagccgagggcagugaacccgccacggggcccgggcgcccccccaguucgacccuaccauuggccugucgcggccgccguguuggcccgcgucgccccgagcugcggcgcacacggugcucccgggcagccgcggggggcgcccaucgucgccccagcgccgcgcuucacuuucucuuuccucccugcggcgcgugggcucucgccuccucagccaagcccggcaccgcgggugcaugacugaagcugggcggccgcucccggcgcacucaccucgaagggcgcccacccccgccucccagagcgcccaaagcggauaagcccgucacaccuccgccgggacggccgacgucgcggccagccagcccgucgccccauccgccuuaucgggacuuagucuagacaaaccaccucagguccgcugcagggcgcgaaaccgccggccuggcgccgaacaaagagcagcgcggccggcgggcgcucgccgccacuucccgcggccggcccgcgccccaacacgcgccccccagcacuuccgauucccaacgcgcuugaguuucaaaguuauuuccgugcgcccggcgggccgacgacccccagccaggcucuucuccucccgccgccacucauaccggccacagacgaguuucgagggccgugagccggccuccgcgccuagcccucggcccccgagggcgcccggcccacuccccgacgggcaucacgucugcccgcggcgguucccgcccccucccccgcaccacacaaagagugggcugccugagggcaccgcgccgggggcgggccguuuccccgcgagagggagcaacagcgggcuugagacaguccagcugcugcgcgccaaacaccgcccgagcggcggcgcgcggaccccgagggggcgggcggcguccagccucaccuugguggugauuucggagcuggugucuacggcugcgucugacaugguggggcacgccggugauccgaugcaggggauuaaaaagaaagcgagaguucagggacucuggcgauaaagcugccggaguccgcggcggcggaggaggcgcgcggcggaggcggcugcggcgagcaaggaggcggaugaggaacaaugcaaagauggcuuuucagagcagccagugggggacucacgcggcgccagaagcuuuaauauagauuagugggcggcgcucggcuucccaugcccggccgcuauuggcugagcgcagggagcgggcgcucgcucauuggcucgauuccgaacaauggacaagcgugcuuaaagcggcagugccccggcgcgucccgcgcugcgcagucgccgaucgcacugucauucaaggccggaguuugccgggucucagcagggccgagggcgcgggggaggggugcgcgagcgcguuccggacgcgcgcucccgcagcuguuuugcuggggcugcugacgcagaaagccaaagcgcggcaaagcugcccgcccaacccccuucccucccucucccgcccuccccgcggcug

SEQ ID NO: 12787 - RNA, 36773 nt, Homo sapiens
ccugcacucgguuccucuguaacuuagacuccagugugccgcgcagugugcgcaaauucacaaacccgcccgcugaguuggucguuucggaaucccgagacuugaaacccaacgggaagacccuucucacccucaaaagaagaugacagcccgcagagaguuaacuucuguuuacauggaacucagacaucugcaaaucaugguaaggcugcaaacaacaaacaaaaacacugauuaaaccgugaaagagaacaaaaugacuucuucaaaucgugcuuguuuguuggucugaggcgccuuuuacauguauuucaggguuuuuugcuguauuccugguuugcaccgggagagcuauggauuguauacucagaauaucaaaacauaaagggacuuugcuaaucuauccccuguuguuacguaugaggaaauugaggcccagagaggcgaagggauuggccacagaucacagcaaguucgggcagaguuagaauucagcccuaagucggcugacuugcagucuggacucuuugcaccacacuaaggaggugauauuuuuagcagcauggcaaugugaauuauucuccuugaacgguuuuccuauccacuguugaaacacccagaauuagguagcauuuauuugguggauuucuugcgagugagggagugugauauuuauuuauuuucagccuagguaggauuugguguuuuguuuuuugccacucaaggugacauuuaaugugauuucaggaaguagguaaaauuacagugugagccacgguuuccuuggaaaccuccucuguccuucucuuggccuuccuuccucugccuguccccacuuucacccaucugggaacucacccaauuuuuucuuccauguaauucaacaaauaucuuuucagccuguuauuugucaggcacugaguggguaaaaggugaaggacauggucacugccaccaggaagaugaacauauauuuagggaaauaaggagacuccacugagauucaagauggagugugauaaaauggcauaaagaaaugacaucagaaugcuaaggaggcccugaugaaaagguucauugcagcuggcaaaacuuuaauggacaagguggcauuugaacuugaauuuuuuuuccauguuaaaaaaguuuuuuuuuuguuaaugagguguaacauacaguaugggaacaauuuucacauagguauacaccccugucgccacuacccaaaucaagauauagaacauuucuagcacacuuagugcucccucccaaucaguauuacauccuuacauauugagauaaucacucuucugacuguaucaccauagaucaguuuucucuguucuugaauuccaguuaaauauaauaauacaguauguacaguaugugucuggcuuuuuuacuuuaucaguauuuuugugaaauucauccauguuguguguagccuuuuaauugcugaauaguauucuguuguauguuuauaccacaauuuaucuuuuccacuguuggcgggcauuuggguuguuauuuuuuggacuauuauuagcaaagccguagugagcauucuuacauguuucuuuuuguagacacuugcacacauuucuaggagaggaauugcuaguguguagggaggguaugcacaugaucagugauaguagacauugccaguuuuucaaaaugauuguaccaauuuacgccuuugccagcaauaugagagaguucuaggugccucuuauccuugucaacacaagaguuuuguugucagucuucuuaauuguagccguucuggcugaaugugguaucucauuaagguauuuauuugcauuuuuccugauguugagcaccuuucaaugugcuuguuggcuaguugaacguccucuuucgugaagugccuguucuuuucccaacuuuuaaaaauugggcugucuucuuauugauuuguaguucuuuacagucuggauauggaguucuuugauauaugcuuugcagauaucuuuuccaaggcauggcuugucuuuucacucucuuacuggugucuuuugaaacaaauuauauuuuugagggauggggucucugcuguguugcccaggcuggaaugcaguggcuauucacaggcaccagcauugcccacugcaaccucgaacuccugggaucaagugauccuccugccucugccucgcaaguagcuauaguaagacuauagguguacuccacugcaucugacaagcagaaauucuuaauuuuaacacagugcaauaguuccgugcuuuuuauuaugguuaguguuuuuugcauuggauuucagaaaucuuugcuuuuagaguuggcagguuuuuuacaggcugauagaagagcauuccaaaaaagagcaagcuugagcauagguguggugucugagagggaggguguaaguugugccgggcaugggaguuuggacugagaagggggaggggguggggugcgacaaagcuggaguuaggagggaggcacacuuugaagggcuuucagugcagccacugccugggcgugguggcucacgccuguaaucucagcacucugggagccaaggugggaggaucacuugagaucagggaagaccagcuugagcaacauagugagaccccaucuuuaaaaaaaaaaaaaggaauaaauuugccgggugugguggcacgcaccucuaguccuagcuacuugggagguggaggugguaggaucccuugagcccagaaguucaaggcugaggugagcuaugauagugccacugcacuccagccgcggugacagaguaagacucugucucuuaagggaaaaaaaaaccaaaauacuaaauccaaauugcagccauggagucuggacauuguucuagaggaaguagaggcauugcuggaauuucuaugaagucacacuaaacucacuugucuuccucucacucucauauuugucccuccucuuccauagcccuguucacuuaacacuagcucuagacagcucuggccucccagcgcagaauccuggguguuaugcucccucccucuccuuauauucaacuggucaccaagucuuauagauucuauagucuaaaugucuccaacagugucccuucuuuuucauccccaauugccacuaccuuuguuuuuguuuguauuuuugagaugcagucucagucuguugcccaggcuggaaugcaguggcgcaauuucggcucacugcaaccuccaccuccuggguucaagcgauucucaugccucagccuccagaguagcugagauuaguagugcaucaccaugcccagcuaauuuuuguauuuuuaguagagacagaguuuugccauguggcccaggccggucucgaacuccugaccucaggugaucugcccaccuuggccucccaaagugcugggauuacaggcgugagccaccgcgcccggcaacacaaucucuuaucuagaauaaaucggucaccucaccggagguuuucccugccuccaauucucuccacauccaauccacuccuauagcaccuagcaugaucacucuaacaaggcaauuauucauaccucuccuuagcuuaaaaagccuaaguaauuccccaguaccuggcauguggauuccaagaccuuugaugaccugacuccagcucuguaccccucauuucucacucuugaaaacccuggggucaaaccacucuggguuucuuuuugacaucaguauaugcugcacagugcgagccucugugacaaugggcacuaccccccuuuuuuccccuuuuugucuguuuuuuucuuccccaaccucuucugugcuuccaaaguguugucauaucuuccccauagcauuuaacacauuggagcuuuugaggguaagagcuuuguuuuaucuucauauaacuuuucaggacauaauaggugcuaaagaaauguuuuugaauaaaugaaugaguugguugaugcuaggcuccuuugcauuuguccugucucauuucugcauucuaacgcacgauaggcaaauagggcuguuuuucucucucauuuucaagaccugaaagacugugguguauacaggaaucaguuuaaguguucaauuauguggcauuucuuagccaucuucccaggggaguugguaagcaccagaugcaacucuaucaaugacauuuuggucauagaaccauuguuggcuuaacccaucucuugcuuauuuuaaaacauuuucugaauagaggucaagaacaucgucuucggccucagauagccuggguuugacaaagauagcaagcuuugucacuuucugacuuuuggacuuaguuaacucaccugaaaaaugggaacaauaauacaagccacaguuaugagaauucaacgagauaaugcauguacagcaccuggcacaugguaaaacgcucaauaagugguaguuaguaggcuuaauguaucucggugcccagggguagcgcaguagccauggggagcuccugagagagaaagcacagccuaaggggaggauuuggggcccgggauggcgauggcgacgguugggcugcaguaccgucuaggccgcauuccucuccuugggccccuagccacccccuccccgccugguucccgggcugcagacucuuccccgcccccucgcucccacuuccccaccggaggucgaaggcuguaaacgcggcggguggaaccuugugugggcggaacgcgagugcagcggugggaggcuuccgggggagcugcacgggcgacgggucggcggagacagaaaagcgccggacgccggggugaucauggacgcuugacaaccugcgggcaggcgccgggaggccgagccagcgacuaagaggaccgagagguggcguggacagguaggagcuagcgagagggugggccgagcggggccggcgcuccaggcucggccagacgauccggcuuagagcccgccgccaaggaagcccgcggccgugcccgccccgcccccgccuuggggagcgcgucccgcggcuccucacuccacgccugcggcccugcuuggagcauaccgcccaccgugaggucugcugcagcuugcgacccucagcuucagugcuguggcugcuuucgcucucccauccccaaaggcugcucguuugccccucuccaguccauccaaauagcgcccuccccugacgggaauuuaucuccgcucugugccuagccucuggcccucccacuccagaagaaagcgacugucuccgucucuuuacauucucugcgcccacaggcuuugcuccuuaagccgagauuuuuugaagggacagaaguuucucuccauuucccuacccccucuccacccccaccuccuaacauugggacucuuugcagagauccccaucugucucuucacacggguccucuuggaagggccuuuucgcuccuucccucuuuaccgucaccgacccuccuuucuucccuacuccuuuccuucuuccucguauccucuccccuucucuuuucccuuucccuuccguccucaaacucguuguuccccagcacuucauuguuuuuccugugucuggccggaccuucuuagguaacccuaagugaggcgacauacuuguuucucuaauacugugaaagggcaacuaaucugugugccugccaacacaaaacuuaguuccucuugcaccaaacuauucuucaaauuguucuuugcugcacucuacuauaccguuuuucguucauuuugucacgcugcucuaauauguaucauucuuggaggagaaaucuuaccuggaacuccuguacacucagcguguaauuagauuacacaauugagggacccuccuguacuuaaugucuucggagcgcugauacaauauuuucacuguuuucccaaaucuuuuuaucguuuucuugagguuuuuuuuuuuuuacacauucugaagucacguuugguuaaaaugucguaucaggaggaggccgaauacagggauuuuuccccauggucuuacacagcauguauguucuuaguuugaauauaucgcuacuuuucuuucaaaaugaugucucccuuuaucugugcuuacuugacuugauuaaaugagacaucuuucuugucugguuuuuuguuuuccuuaucugucuggcuguagauuggauucugaugacacagugggagcuguaacugauugcuuuugcuuacauccggugccucuguguauaggcaguauccuccauuucuuaaccagaauguauaaacgagguggauauaaaacagcugcugagaaacucauguguuuuucuuuagguccuggucagguuuaaggacuuagaagguguugccucuggaggagggacagguggaagugaaaugacuuuuacaaaguguguuucaaacaccagaauuuaggacaagauccuuuuaacuccagguugaacuccacccaucucauaagguggucauugcaucuggacucaggaacuguuuuuuuuuuuuuuuuuuuugagacagucucgcucuguugcccaggcuggagugcaguggcacaaucuuggcucacugcaaccuccaccuccuggguucaagcaauucuugugccacagccucccaaguaacugggacuacagguaucugccaccagccuagcuaauuuuuguauuuuuaguagagaugggguuuugccauguugcccauacuggucucgaacuccucaccucaggugauccacccgccucagccucccaaagugcugggauuacaggcaugagccacugcacuuguccuguuuuuucuuuaucaacacuauaaaaguaaaguauucugguguuugauucagcacugaauaggcacagacuuugcaaaggagaaggaagaaugacugacacaauuuucuuuuggacagauuucaaggccagagaauggcaggggaacagaaacccucaaguaaucuccuggagcaguuuauuuuacuagccaaagguaccaguggcucagcccucacugcucucauaagccaggucuuagaggcucccggaguguaugucuuuggagaacuucuggagcuggccaacgugcaggagguaagaacgguuugcaaacaauuucucuuuauucuaagacucuguaauucuccagguuuccaaagaauuucagugcugaaguauugugaaccugugagguacccuauugugagacagaugggaauugguggggcagagggagagauugagagaauauccuuggcuccuuuuauccaguauuuuuaucuuaccuuggguaaaauuagauuguugcuaauaauaaccuaaaagauaguaaaaaagucaaauugauccugauaaauuagaaaaguagugcuguaagcaugggcuguuuaauaggaguagauucaugcauucuuaaggaccagaaaccuccagugcaauaucgauaaggaagauuggucagggacacacagcagaaacauacugcuauugaacauaagauggacaugaauaggaguguauuguucuugaggaaaagggcaguguugugcuaaauguguuagauguguuagauaugacaugaaaagcuaggacauaguucauuuuacuuguuugcuugcuuguuauuaaaaccuuggauauccaguuuuggucauugugccucaaaaaugagaagauccauugaacagaaggaacaaagagauguaaagcaaucuauacuucucaaccucuacuuuccaauuugaacauuuuuauuuauuuauauuuauucacuuauugagaaaagucuguaagcaucuuuauuguuuugugggguggaggcuggugcucaggagcuuuuggcggauugguggggcagguccccuuccucuucauccucacaggcuucuggcuaugcagacuggugcuggcucuguggaagcugccaugcauagaucugggugaugguacuucuuguggagcaugugcuggaugcuguugagaguggccccggaguucuuggugguggcgauuugcauauaggaggugguuugcuuuuguugggcaguuuaucaccuucaugaccaccacaacaccuuugcuguuggcuccacacccacagucaguuuuaacaggaguuucagugaaucaguuaguuguaaccaaaggaguugccggccuucaguuuauuggauucggugcugugugucugccuauuccucuugauggggaaacuggagcaguucccuacaguccagccauuucaggugcccaauuaugucuccucuaccugugauguucagagaugagaagagccacuuuuacuuuuucacuguaaauuuuuauuuaaugucagccuugcuugccgaacuauaaacucugugaggaggucuguagugcucaccauuguuucuuuagagcugaauacguagccugacacacaguaggcuuucaauaaaaauuuaauuuaccagaaguggaaaaugaguuuuaugaagaaaauuucagaaaacugaguucauuuuucaacacaagagaugaccaagggguaauauguuccuucagguucaugaacagccugcaugaauaugccaaguaguuguuuuguaacuguggaagauuggcuaagaggagauggauggaaaguaaagucagaaagaccuuauugauuuaggccagugggagaaguguuggaguaucugcucuggagaaaaugcucuuuuccggcuaguuuuguuaauuauguuucugaaaaggggggcuagauuggauggucuuuaccagguuucuuccccuucugauucagggacuucaggagguuugugguaaccugagaaaguagccugagguauuauggugcuggaguucuccauagggugcuuagcagaccaccuuuaucuccccauacauugcguuuuuccauaugugagcugagaauaagcugguugccuuucagugaucugaaauuauagaugcauuucuuggaagcuuuauuuuuuuuaauggcuaaaauugaguaguaucgcuauugcugucuguagacuaccacuugcuauuccuguuuagaguuuacugggcuugguaaguuggaaggguaacaggagcacguuugugauuuuuuuuuuuuuuuuuugagacggagucucgcucugucgcccaggccggacugcggacugcaguggcgcaaucucggcucacugcaagcuccgcuucccggguucacgccauucuccugccucagccucccaaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggcccacguuugugauuuaaacaacaacaacaacaacaacaaccaguuaacguaauugacagcagagaaguuccaggcagaacaguggcucuuucguuuuucuucuacacauggcuuuuugccaucagcaucagugaagaguaaguaauuuuaaugaacauuuugauuuggggcagacugauacccugguuuucugucccagccuggcuuucugucauaccuuaugaugugcuggucucucccaggguucauaguccacguguaguccugaaacuuggaaccaacccugagcuuuguucacuuuggguuggugguggcucaugccauaccuaccaagcugguauguagauagggcugcuccagucuuuguuuuaaugcaaacagaaucuugagaagauuugaacuccuuccaaugcuuaaugcuuuguaugugugugugagagaaaagcaguucguugggcaugcuguauagaaaguaaaacauuccugagagagagaaauuaaauuuggggcuuuaauaaucuuguuuauuuuuucccgaagaaccagaguugguagagaccccaggggccaaguaaucaaauaguacagaauaaacagccauggcaucuuugacacaugcucacccguccucuguuugaacacuacagugauugguagacaguuuggucuguggugaacuuuuuuuuuccucuucagcuugcggaaggagcuaaugcugcuuauuugcaguuguugaaccuguuugccuaugggacauacccagauuacauaggugaguuggugaagauccuucaaaagacuuguguuaauuauguugcucaguuuggaagaccaucaagguuugagauauaaagcaugggguaguggggagacuucuugaccuggcugccucccauuuugcugugcccggugggugaccucacaaagggaauguuccuucucaccuuuuauauucuagugggucaaauggggccugugugugcucauccacaaauguagcccuuguuuguuuuccagaugagauucuugaggacugguguuuguagggcucuuggagugcugugaagugcagaauacccaccuguagaauguuucaacauuuuaaauauuaucaaaauaauaccagcauauugaagaaaauuuggaaaauagacuuuuuaaaagucacucauaggcugggcgcgguggcucaugccuguaaucccagcacuuugggaggccgaggcaggcagaucacuugaggugaggaguuuuacaccagccuggccaacauggugaaacccugucucuacuaaaaauacaaaaauuagcucggcgugguggugggcgccuguaaucccagccacuccggaggcugaggcagcagaauugcuugaaccugggagauagagacuguaguaagcugagauugcaccgcuguacuccagccugggcaacagagcgagacucugucaaacaaacaaauaaauaaauaaaugucacucauauguugcucagacauuuggaugcuggacuuuuuugugccccuuauguuuguguuuuguauuacauagguacaacuauguauacaguuuuaugucuugcuuguuucuucccacuuacaaacauuuauccauauuuuaagucuuuuuaauauuuuuaauauuucauaaucuacuuagcucauuuucuguugcagggcauuugggucauuuuaaauuauaaucugaaguauuagguugagguauuuguauguccaaacacuaacuuaccuucuacccaaagcauuuuuuucuggcuuuccuacccuuuuuuaaugguaugacuguagccugauacucagggccuucgcugcgauaucccugacuucuucuuucucccuggucacuucuacuuugugcugcugucagacuggacaguuugccaguuccugguacaccacauuuuuuucugaccuucccuuuguuccagggaauguguucuguuuuucuguccuugcuuacuaaagaggcagcauugcacagacucuguuagcagacugccuguagccagucuggcuccacuucuacuaguuguguguucguugacaaaugaaguaaccuuaugcagcucaauuuccucgucuguaaagugggaguaacaauacaagcccauuauuccuuaccuacacuccucgaaguuagauguuucagaauuuagaauuuuugggacuuuaaaaagguaauaugaugcgcaugccuuuuuauguaacacucccagaggaauguggaaacaagugggauaaaaagccugucuccguacagguuagaaauucccaccaggugaauuucagcaccaugcuuaagaaaaaaucaguuuggauauaguuuuuuggaauccagaauuaucguuaaggaauugaggacacuuggagucuugcggguuguugugaagaugaacuggauguguguauguacguguggaucuaugcaauccacaagauguaaagcuugcuauuuauguuagcugcugcagcugcugcccuugcuguuauuaucauuuaugguuauuauugaaauuuugccucuuucucaaggcucaacucaaacuccaucucuuccaugaauucuuucuuuuuaucuucuguacuuuccaaaugauacuguucucuuucccucuccccuccccuuucaucucuuucucuuaccccugucuccuccccaucccucuccuccucucuucuaguagcuuguaccuuucuucugguaguucugccuuggauuuguagcuauggaaacaucugauuguaagaccgaggacaaguccagggccaugaaguugcacaccuccaggugguugguggcccuggaguugugccaugcagcagcccuggcaaagcccaucuuguucauccuugauucuucucaguacagagcauugcacacaacagaugcucgaugaagauauguuuaauuuaauugaaugucacaaggggcacaaauaguacuccauuaagauaauugccacaucauuuugcuuguuugcuuuuuaggagacuaaacucuguguuuguagaaacugagucuuuucuucuuuggaaguacauagucuuccaaagaagacaggaauauuugucaaaugaauaagugcaaagucaugauagugauucaguaguagauuugguuuggggaguuggugagcuuauuccauaaaagaaauccuaauuuuauuuugugucuugauuuuuguggugggugggacugagcagccaacaaggagagccugccagaacugagcacagcucagcagaacaagcugaagcaucuuaccaucgugagcuuggcaucaagaaugaagguacgguacugagccuucucuugucuuccuccuuaccccaagucagcugucucauugacaucaaugaaggaagucccagcugcacauaggagagucacaucauaaaugcauaaaauuugcuugacagaggaaaagauaaaaugguguagaaaaguacuccccauuccauacaggaaaaguaugcccagaagugauugacucagcaggucuuaguccuggcaugcuguggugccgcauguggcaugaucauuuugccauauuaaggggagacugcuguuaaagauauacauuuuucaaauagcaaggcaucucaaggcaaguuaacagcuuaaucuguugcucaguacacagugaacuaugcccaugcuggaggaaaaacuugcuaugucggacuugcuagauuuuuuguuguuguuguuguugagacggagucucacucugucgcccaggcuggaaugcaguggugugaucucagcucacugcaaccucugccucccagauucgagcgauuccccuacucagccccaaguagcugggauuacaggcguggaccaccccgcccggcuaauuuuuuuuuuuuuuuuuugagacagaguguugcucuguugccugcgcuggagugcaguggcgcaaccugggcuuacugcaaccuccaccuccuggguucaagugauucuccugccucagccucccgaguagcuggaauuacaggcaccugccaccaugcccauaauuuuuauauuuuuuaguacagucaggguuucaucacguuggccaggcuggucuugaacuccugaccucaggugauccaccugccucggccucccaaagugcugggauuacaggcaugagccaccgugcccggccuuuuuaacuuaaaaaauuuuuuaaauugagacaagggucucaccauguugccuaggcuggucucaacccccugacuucaagcgauccucccaucucagccucccaaaguguugggauuacaggugugagccacugcacuugguuuuuuuguucuuggauugcaauuucaguugcugaaaucauuuuaucugaucuaauggcacauuucugauucucagccuagcauuucaggugggaggccuauuuuguugugaaaugaggaccugaccuuuuuucuuguacugauuguggacuucucaaguguaguaaagaauguugguacagcccaauaaagaacuauuguuggggaauucauauugguugugucugagaaaacagauacaaacuucagggugacaucugagcuggcaguacccauuggccaccuauagguagauaugcuggccugcaaguuuuuuuuguuuguuuuugcacucugcugggcaaguagccagcucuuuccagugacugggaucuguuggagauuuauggugaucuagcaaagucugaaagcuuccagaagguggcagaguggcauauacucaguaguucccuuucucuccacugguacaaguuuuuaggaucucuacaaguaugcugcagcaugugaaaucugaaggcugggugaagccaaggaggcagagaaccaggagguugcuuucuuagauguugggucuucuaggucucaugguucauuuauccaccucuuguugcccuagcuauuaauaauuaccacuagccugcguuucccgagccuagaggcagcuguuggcuaugggaguaauaccugcauuuucgcuaaugcuugccagaugguuuuuauaaugaucacauggccuuaucuacaguguauccccuacuccguguugcugaaagaccuggagaugcggaaucuccgggaacuagaagaccuuaucauugaggcugucuacacugacaucauccagggcaagcuggaccagcgaaaccagcugcuggaaguggauuucugcauuggccgugacauccgaaagaaggauaucaauaauauugucaagacccugcaugaauggugaggcuaaaaggaggagggggauaucuagcaugucuuuugugccucuccuugcaaaaaugugauucccuggugucagcugaggguuuggggugggccuguagcuaccugggagcuggggcuuagugagccggagaguggagcuacauuugugaucacagcugugugauaacaggagucauuucaggccuccuggugccuugguuguaaaauaguucuuuccuuaaaugcaacugggagcuauuuaaaagugggcuauaaaaugcccaggguuagcagguggagccuauguguccuagcugugugaggcuaguccugcccuuuccaaacucacgcucaaaguuugaccaaacucaggaaggcuaguguuuguaagauucuuucuuuguuuuuauuauuuuuucuaucccuguugaaguuaacauguuuauaagauucuucggauaaaagaacuuacguucaaaaucaguaacauauugggcuaauguuuguaaaacaccgugagggacauggaagacaaggagugggucauuuuaacuuggaauacagacucauacaaagaauaucugauaacuauacucugguauauaaaaagcauugggacauuuguguuuucucuguuuuaauggaauuugauauuuguaagagcugucucacauucuacgaggauucacuguggagugauuuaaauuauuuggggcuuauaaagccagauggacugauuggagaaguuuuagcucaguuuugaaggaaggccaggguuagaguauaccuggaggugaggagaguguguucccaggcaggcacguggcauguuggaagccaugaagcagacccggugagcuuuguacacagguucgggagggagagagaaucucugcucauccccgagagaagcauauccagagaggagcagugccacuuugacuccuuggggccugauguccccugaguuucccucacuucagcuacuuuuacaccccaggacauguguugcucaccccucaccccaaguucugucccaaauauagccccaaacaccuucucuauacaacaucugccacaaguggaaguuuucaauagcuuacaaaacuuagaauaaauaagaaauaaacuuagaaauaccccaacacaaaaauggucuggcacacaaaaucuaguuucugaaccugccaaaguuggcuguccuauucuguuuuugagauggcugacacagcuuuuuauguccauagucugguuuccuguuuuuaagcccccaauauguuugacauagaggugccagacuaacugguuaccaugggauguuuacuaguagaaacucuuacaacucauguuuaggcacuggagguagauugaaacaaaauucauaggcugagggcuaccacauauauggcaaaaugcucacacuguuggaucuuaaguggaggguauggggauauucauuguagucuuucaacuuuuucauuuuuaaaaaaauuaauaguggggaaaauaggaggagggguauggcaauuaggaaguaacuuaaacuucugagaaaaggcggaaucuucaaaacaggaugcuuuuaggaaaucuuuuuuuguuuguuguuuuuugagacaguuuugcucuuguugcccaggcuggagugcaauagugcgaucucagcucaccgcaaccucugccucccagguucaagcgauucuccugccucagccucccuaguagcugggauuacaggcgugugccaccaggccuggcuaauuuuguauuuguaguagagacgggguuucuccauguuggucaggcuggucucgaauucccgaccucaggugauccgccugccucggccucccaaggugcugggauuacaggcaugagccacugcgccuggccuagaacaucuuuuuuuucuguugagaaaaggauuacucagugccaucuauaaaaucuauucuaccuucuuuuuuuuuuuuuuuuuuuugcggcagaguuucgcucugucacccaggcuggagugcaauugcguggucucagcucacugcaaccuccgccucccggguucaagugauucuccugccucagccucccaaguagcugggauuacaggcacccgccaccacaccuggcuaauuuuuguauuuuuaguagagaugggguuucacuguguuggccaggcuggucucgaacuccugaccuggugauccacccaccucggccucucaaagagcugggauuacaggugggagccacugcacccggccuguccuaccuucuuuaaucguaugugcuacaaaaccaucuuccaugagauacaaaguugaaaauuaaagcuguauucuaagaaacuagccccagacuaccauauuugucuccuaauguccugcauuauguauuuagaagugcuugucuuugggaaggagugaacgggcaagagauguggcagagggaguauuaaaggaggucccuguaagauacuggggagagcuguuggggaagaauauuucugagccuggaagagacuucccaggccauucugcagcucagggcugguuuucuccauuguaggugugauggcugugaagcaguucuacugggcaucgagcagcaaguucugagagccaaccaguacaaagagaaccacaaccgaacucagcagcagguagaagcagagguaaggaaggaaaggaacauuuguuucucucuccaggcauaccuguuuauucguuugcaguguuuauguuuuuguuuugcgaaucuugguguagaugaaacaagcagucaccaacaagugggccugggcuaggugcuggguuacagggaugagugugacacggcuccugcucuugguguucugucucuuuuuucugauuccuggucagcauagggugaucaaucaggcuuggagaacagagaauguuguaguuucaguacacauguacuuugcagcuauagagcaaaagaaaaugaguuuggggauggaucuuaaaaauggauagaaggauggugguaaguuaccagguggaguggagggagggguacagcugggcaggggcauguggggcuucaaggcccugggaguguucugcuucuuaaguugcguggugggcacauaguuucauuuuauucuuucucugugaacuguacauauauauuauaaauguguaaaaugcaugacauguuucauacggaaagaagaaagggauaaaauuuggcagaugagcugcaagugaaguaaagaggauguaagugugguuuuagugacaccugguuguugaggaaacuuuuagcuucuuggacagauguaggccccagccuuugcguuaugggcauuuguguaccuguaaccugacacaugaagugaccucacuucacaauuuauuuggagcccugcacugauuuuccuuagcauuggaaguucuuuucuagugugaauggaguuugaaguauuaaugaugcuuaaugaauuuugaaaaucaggugucuaagaguggcggagugggacccguaauuccagcuaagaagcauaagagaugaguagauggugccuuucaaagggggauuugugaaauuuggagugauucucuauacuguuauaugcacuccuugaaaauaaaaccuguguccuauuuguaagacgagcgucuugucucaugccuaacccauaguagguacucaaauguugaacugaauauuucuggcacaccauaaaagugugucaguggacugcugaacucugcuuuucaugaacuugagcuaauuuuuuugaauacacacacacaccacccuauauacauauacucuguggauguucaauucauagaccauguuuaauccgacuagccaaggaaguaugaggcugggugcagugguucacaccuguaaucccaacacuuugagagaccgaggaggaaguauugcgugaguccaggaguucgagaccagccugggcaaggaaguguuaacuauauuuaacauuaguccaaagcaaagacaauuaggaaaauaagcuugcugcuuuucuaauaagcugugcaacaacccucuugaugaugguggccuuuucucugacuugggauugaggucugaacaaaguaggaagggcuaaccgcuuucuccuuucuguuuauucuucccuauaaaucaaacucuguacaaaaugagguugggaggcuaaccacacuaccuaaucuuugguaucaaggucauuaacaaagaugaaugauacuuguuuuagaauuuugaacuguucaaguuuauuuucauuauaaauagcaucagacaaaagaaaggcgggugugcacagagcuauuguagacacuuggcuaaaguuugaggcacaccguguaguuacacaacaguguagacucuuuaaauuuugguuauuuaaacacagagggugggugugugcacgagcagagccuggugcugccagcagguggcgguaaggauuuaaguuugagaaaaagaaaucugagcaaaaggccaaggccaccuccaccaccaauuaaaacaguccauugacguaauaaucuuuuagaaaaucugaaccagaccaauauggucuguucccugagcauggccaaagcuuaggaccuugucauuuuuuccauuuagcaaaugcaugaucuggcugcuaaguguugaaggcugcuugccaccuacuugaggcacacagaagauacucaccaaauagcuacugacuugaaaggaaaagaaaucuacaaagaaucagggugauucugucguauucuguuuguauuuaugccucuguuacccuuggccuaacuuuuaaaagccaauuuugucaacugauuggugaucuuuucuuuauuuguccuuaaauuagauugcuuguuuucagagggaaaaacgugaugucccccuccugaaucuuauaacaacagcuuucuucuggugaguuguagcuuuaagagcccuccuucuuaaugaagucagcccuaucacagacugccgaagaauauucucuccauuuaggcuuuuguggaaauaacccauauuaguuccuaguuccagcauaccugggggaccauuaugagcuguuucauuauuucugaggaagcacugugguggggagguaauacuuagagcauuacaaagcacuuucacauuuaaauuugauuuuggaaaguauuuucuuuuugagacagagucucugucacccaggcuggagugcauggagugcaguggugcaaacacagcucgcugcacccucaaccuccugggcucaagcagucuuuccaccucggccucccaaguugcuaggacuauaggacuacagguguaugcuaccacaccuggcugauuuuuuuucuuuucuuuuuuuuuuuuuuuuuagggagaacuggguuuugcuguauuauucaggcuggucuugagcgccuaaccucaagcuauccucccaccucuggcucccucuuuguugggauuacaggcgugagccaccaugcccaaccuacuuuucuuuuuuucuuuuuugagauggaaauucacucuguugccuaggcuggagugcaguggcaugaucuuggcucacuacugcaaccuccgccuccuggguucaagcaauucucaugcuucagccuccugaguagcugggauuacaggugcccgccaccacgcccagcuaauuuuuguauuuuuaguagagacgggguuucgcaauguuggccagguuguucuccaccuccggaccucaagugauccgccugccucggucucccaaagugcugagauuacaggccugagccaccgcgcccggccucauuuuucuuuauauuuggaugugccuaugucugauguuagguggaauguuaauuuauaacuauugcuacauuuacaaaguaggcuguguuccagucauggaggucguaaaguguaacuggacaaaguaagcucuguuuuccauuauguagaaaaucuccuaggaguuagugacaaucuugagauuuauacaaugcaccaaaaguaugcuuccugguaccucuuggaaagggacucuccaucacccaguucucuuuuucuuuguagcacuuuuccaguugugcacuguguuuccucucgucugccuuugcuuugccccucaacugaaggaagguuuccugccccagaaagcucuuucuccuuuugccuaaauauuuaaggucucugauggagcuaggcugcauuuuugcuagcagugcaaucuuacuugaaaauuucugagguucauguuuugaggagccuguaagccaggccacuggaggaagaaagucauaaggaacucuaccaaauuuagguaaaagaagacaagucuguggugaugauauuuguugucaguugaagggugacuguggaagaggaauuggaauucuuaagaaagucuacgagaccagaauggguuuaauugguugaccuaccuggguggccaauuuggaguccuagaaggagcugucugcgguuacaacugcccagcuacuggaagaagcuaguugaauuuuaagauccccuuccacuaggagagucugucagugcuucagaagucucguuugugaguuguguguuguaaaugcagugguaaagcugacuugagcaaagugucucuguaauggaucccagugugagggccauggcccugccccagcccaggccaggccuuuguggaggauaaaaggcucauuuccuaggcuuagagacacuugcccaagaagcccucuuuuccucugcaggauguuuacauuuugccucaaagugguaacgacuguagaggacuuagauuugucagcagucuuauuggaggagugaggugugugcaucugaaacacaaaggagaugcaguggugugggaggccaucgaagagggagaggcacugccaggcaaguacagauugaaggguggcagaucagugugggcugcagcagucagggcaguuuguauggaccaggugcucaacucuccaggcaggaucagaggggcaaccuggggaggagcgguaacccccggggugcaugaacaacagaagggcauagggggaaugacugcuuccaaguguggugugggggacgaguguggcugagauggcuugagugcagggcauguguugaggagugggaaggaagguaccugaucuugguauuucagaacuagagaaaaaaccaaguuuuucccugggccaagucuuauuucuuuuuauugcaugucaggguuacugagccccuaaaaaagcugaaugagagcaguuucuacaggagaaaauggcuugaggaaguaaauaggcaucugaauaacaggggaaaguguccaugcuucugucuacuuauuuguucaaaagcuuuugacaggaucuugaaucucaaaggcuuuuaaauagaauugagucaccaugagagagggaggcugcguuaugguagggaguggcaguacagaaaugaagcagagggucagcccuucugugacugcagaaggaugaugcgcgggcucccucaggaccagagugagaaccaugaguuuguggcucugugaaggagaagcauuggaaguguugagcuuugaaaagaaaaagaguaaaacagcaaagccuugggagucaguugaacuggucaguugcugagaggcuggcagcggagcguugccguugguggaugugccacaggcagaguuugcuccuuggcuggcaggucagggacucaucacucagcccagccauagauacucugaguccaaagccggcccaaaucaccuugggccacucuaaagagagaaauaaaugccgguugucacuuucugauaggcugauaaugacuuuaugcuacaaaaacauaggugaagcggauugaaaauauaaccauuauuuggggauugauuaaugccuuuuccuuacucaugcagggguuaugagacugucaguaaaucuaagacauguuaaauaauguagaaaacuauuuguaguauaagcugauuuuuuuuuuuuuuuuugagacagagucuggcucuguagcccaggcaggagugcaguggcgcgaucuuggcucacugcaagcucugccucccggguucacgccauucuccugccucagcgucccgaguagcugggacuacaggugcccgccacgucacccggcuaacuuuuuauauuuuuaguagagaugggguuucaccgcguuagccaggauggucucgaucuccugaccucgugaucugccugccucagccucccaaagugcugggauuacaggcgugagccacugugccuggccuaagcugauuguuuaguaaaaauuauuacacaaauaacuugaggaaauaaggcuaaauagugcuuaucagacaagaugaaauuaggaauuuuuuuugguuuuguuuuuuuaauuuuuaauaaagcuauuuugccaaaugggaaagguaauuauuugcuuggaaagauaccccauuuuggaaauacaguccuugaaacaaaaacuuguuuguuuucuaaugucuuauuugauuaaaauuuugucagcuuuuggggagacuuuaaaacacauucccucagguaauguuaaauugcaggaucuucuuuggaaguuagagguaacugacaugcaaauaaauaaacuaaagucaugucguuaccucuuauuaugauuuuaguucauuuucuucuggauauuuagaaaauauaucaaauuggagaagccuuagaauguuauuuuauaaagcaguguucccugagaagucaaauuucuuaauuuuuccuccaaugucaucaaaauaugccuuagcugggcaugauaguaugugucuguagucccagcuacuuaggaggcugaggcaggcaaauugguucaugccagaaguuugagaccagccugggcaacauagcaagaucccauuucuauuuuuuaaaaaaagucuuaaaacaaauaauauuucuuuuaucagagaaagagugauaagccauuggcuugcuccagaucauucacucaccaccuugccaggugacucacugaaugagguacaccaaaguggcagugagccgcugggagggcgagaugccucaggguucugggguucccagauuguguuuuguugucuggcaggacacuggauaaacccagaguugaauuccccucccuguuuauuauauauauauauauauauuuuuuuuuaaauuuuauauauauauauauauauauauuuauauauuuccaggcacugggucuugcugugucacccaggcuggaaucagugguguaaucauaguucacugcagccucaaacuccuggacuuaagugauccuccugccucagccuccugaauagcuaggacuauaggcaugugccaccacaccaggcacauguuuuuuucuuuuaugucuuuuuguugagauaaggucuuacuugaaugucaucuaggcuggagugcaguggugcagacauggcucacuguagccucuaccucuugggcuuaagcgauccuccugccucagccacuugaguagcugggacuacaggugcaugccaccauaccuggcuaaaauuuuuuuuuuuuuuuuuaagaaagacagggucccacuauguugcccaggcuggucuugaacaccugcucuugagcaauucucuuugcucagccucccaaagugcuagaaguauaggugugagccaccaugcccagccugcccucuguaaugacuguuccagcccacaguccucugucauucucucuucagaaaggcuacagcguugauugagguuacagaaguuuagggcauggcuuuucccccugucucaaaauagugacaacaaaaaacaauuuaugaucuaguuaagguggauucugcagaugauggcucuccuccaggaacccaauuuuugucucacccucauagcauuguuuugucuuugcauuuggacugucucuuacccucaagcucauaauauucugacuguugagaacuuuugacccugacaacuccuuuucacuauguagaaaacuggcugggugugguggcucaugccuguaaucccagcacuuugggaggccaagguaggagggucaguugacccugggaguuugaaaacagccuggacaacguggugaaaccuugucucuacaaauaaguuuuuaaaaauuagccaggcaugguggcaagcgccugugguccaagcugcucaggaggcugaggugggaggaucacuuaagccugggcaguugaggcugcagugagcugugauugugccacuauacuccauccuguacaacagaguaagacucugucuccaaaaaaaaaaaaaaaaaagacuaaaaaagcuauuacuuauuugacugcacuguucuucccuaccaccaccauccucuuccugcuguuucuuccucucaacgaacugaggagcaaagguuuggaauagucacuuuucagcaggcaauauagcaguacugauucaaauguaaaauguaaaucgacuuugaucuggaaagcucacuucuaggaguaucuuccauagauguucacagaaguaugcaaagguaaacauaaagggcuguucagaguagcacugaaacccaaacuaggaaccaauucaaaaaacuggaaaacuggagaaccuuccuaauagaauaggguucaagugucacagaggauaucuguucugacgugguaaaauguucaagagcugcuuaaguauuuacgagucuguauuuuguuaagugaaagaaagcuauacugcacacgguagugucauagcauuuugccaguacuucuauuacauuuucuucauuucucacuuaguuggcugaaguucauccucuacugguuuauucaagaagguucauggagcuguauucccaaaguuuuuaugaaaauauuugugguuuuauaaaugaauaacagcagaguguagaauucuugggucccucuuucugaggacauuuuaaucacgauuuauuucacuguuggugaugugccucuuugccaaauguuccccuuccauuuguuucaaccaggagagcauuagucccacauuuuugcuugacucauuuccacaaaucugcugugaguagcccaggcucguuucugcucaucuggauuucugaagagaauuucagguuuucuugcagaggauuuuagcuuccugucugaagugaagacauagugagagcaaguuuuggugagcacauacaggcugagcacuccaauucuauaucuccccaccagguuaccaacaucaagaagacacucaaagccaccgcauccuccucggcucaggagauggagcagcagcuggcugaacgggagugucccccucacgcugagcagaggcagcccaccaagaagauguccaaagugaaaggucuggucuccagccgccacuagggccggcuggggcagcuggcacucaccaggccugggucagguggggaggggacaccaagggcccauuuccuccccucucuaccugcagugaguuccagaccugcccguccccucaccagcgccuccccacccuguugguacuguuccagaaaaacuguuacucccccucacccacucccuccuuccccaguuguucccuucagacucaggggcuccaccaaugccaucccaaaacagggucagacacugcccagcuucccuccaggagguucuugucucuguguaagggcuugucucccucccaguuuuucuuuugcuccacgucauuuugucaggcugguuauaagccggaggcagcuuuaaccagcccccagggaugauugugaaggaggccccuccccuugugaggagggggcacuccucuccagccccugguaccacaguccucacgauggugcagugauuucuagccaggcgucaagaugcgcugcuuucccucuccugccucaucccuuguuggcagcuccaguucaggccguggagggacgugaugcugggcuguguuuacuaaacccacggguuuucagccucuuaagcccagcuccgaucuccaauuaguugagagcgcuggguugacuaaccucugguaucugagcacagacagagggugcugugggucugcuggguggcagaaaugguuccuuccggcuuggcguucucuccuggccacucuuccugcugccucugacuacucagccuuguuuucgguguguaggccccagcugcccacuggaacugccggcuaaugcuugcucucccaagaucuuuaacuccuccuggcugcaccuggguagggaugguggcaucgaugccccucugucugcugaaggaccuguugcugcuucugucuuuucaccccuccuuggcugaugacccagagcccucugaugauggcauucuccuggcaagagaaaaagacuuaacuagacuucugaacuugaacaguuucagguuauauuuuaauuuuuuuuuuuuuguacagguucugauucuaauacauuucaacaugcuuuuguccccccucgugucaauauuuguuauagacuaaucgccggggauuuuucaccugguuggaggguggggguggggugggguguguguguguguguguguguguguguguguguguguguguguuuguagguccuggacugauuaaaguucauugaggaaaaagcacauuuuacaacaaaaaaauaaaaguguagauuuaauguaugugacugggguuugggguugcauaccugguggaucuugaggggcugggauuagggugguucaggaaaaugugaugcuguuuccccauguuuagccauggucaaaaaauggauuucuccuuuuucuaaaauguccagcaacugccuacuguugaucaaauguugaaguauucuuguuucccuuuuaagccaauccaugugcccacauaacauuaugcccaaguggagaguucacuuuaauuuccaaaguauguuucaugcagcccccugucagcugcucuguggaaaagggguucuguuaugaaauaaauguugcacucccugcaucccauauccucauuggaaauucauuacucagguguccaagcauuccuuguugaggaagccuguacccacaucgauuuuaccgccaaauccuuuuggguaauaucuagguggaacaaaucuuagggaaauuuuggggaaaguauauuucugaagaagccuaagagugcugggcgcagugacucaugccuguaaucccaacacuuugggaggcugaggugggaggaucauuugagcccgggaguuugaggccaguccacacaacauagugagaucccaucucugcuacaaauaaaacccuaagagaagcugaacaccuuucaaccuuacagguuuucccagcuauucuuucuagaccucaaacagucacucucagcaaguuuucuuucauucuuguuuuucccacuggcaaguagacuaggaaacaugguuugacuuguaugaagucugugaccauucuuuauuugauugccccaaggcccuaaggguccucuccaugauucaccuuccuuaaaaauaaugauggcgacaauaauaacuugucucuaaagugcuuuacaaaguguguuugcauacaauaagucauucagucccuuccacccaaacagccuucugagguugguaaggguauucagccaucuucgcuuugcauaugagaagacaaucucaaagauuugaagugucccagugguaacuggcagaaggagaacucuuagaucuccugacuugcacauccugucaucugcuguguuacauucucaucuagagucugcucuccacacuugauccuugcuaccccucuaccugcugcuguuccucugagaguucaucuugccuuuauuuugagggagggaggggcaagcccaguguuaguguugauuuugcccucaaggacccuggcggggaagcaguaguguucccauuguagaggccagaaaagcugcccagugacacagccaggaucagucauggagccaugauaggccagagccugagcucccagccacugaggagggguggcagaggauuguuuggccaggucugugugggcugaaggcuuggugaccagggacgacaugaucaucugcaagaccaaugcuaucacugcccugaggauguucuucccccgaaaguuugccuccaauagcacaggcaccugcgucucagaugguggugacaucugaguacuuggacuucaucagcugccuguaggaggugagguagcaggaggugagggcaauacucccuucagcuucagcaggugaaaagugugguucucaaugaaguugagcuagugugugccaggucuccuucuacaguggguacgcgucauacaggaucccaucaaagcgaccaccuggcaggggagcgccaccuccuuccacaggacuuucaaggggaugaccuuguguggcugcugcuggguccaguccuggagcagcuggaagaugcugucauugcacuccaugauccaguguuccuggauggcgaccuccugcaccuuccauauucuuguggccaugccgaagcccaccucuaagacucggcccccuuuggagguggugaaggcagcgaaggggguugcaguaggggcgcucuugcugcagauggagccccaacuuggaacccgacgugccagggcccagucccugcagccaucucacuuuucacauaccucauuucugcuugccaaacccacccagccacuuaauaaggaagcagagaguaugggauagagaaauugugggaauaguggcccagccagauguucauugcuccacugggacucugauaggaggcuuggccuucaagcucugcaguuuccugucuggcacccuggcagcugggcucaagucuaaaaugugcagaaguguuuuauagauaaauagaacauuccaaagagauggccucaucagcagugagacaucuuagggaaggagacaccacaguauuaaagagaauuaccucaauggcagugccugugagcuggcuugagccaccuucuuuaccucugagcuuucugccuucugaagcccuuuuugcucuuucuguucagaugagaggcauuaugguuccuauuuggguaacauuagggagguggucaaagcccccaguauagcccauuccuguaguccuaauccaagauggucaucacugauaguaggauucuccucuccccauuucagucacaggaaaugggguggugaccaaacaagcucaagugauaaacugcuggugauauguauauauguuuguuguuuucuccaccucugaggugcuggguugccugauaccaaaguguuccaguuuguguacuaaaguuguuuuucuggcagccugagacuucgcuuuuuaaaaaaugcagcaauugguugauuuuuguuguuccugaaggacccaucacacuacccacgguaucugaguuucaagucuagcauggcuuggguaaucugugauuguaccuguuucuuccugggauucugcacauagccaggagcaucucauugcuucauuccguguuuucuugcaguuaugccugggauaugcagauggaaaugcauauuuuauuguaaauuucauuuuauaucuagcuuauauuacccuuagggcauuaagugggucuuuuaaacuuaugucuguuaaguagguugucugugacuugacgucgggcaguaaagguagaugcuaagcaaguauuuauuaucaaaaggaaauguugagucaacauuaagggugagaacugcucuucgugguuaaggauaaaaccaagaaggaaagaagugaugggaaugcagagacaggaggcagcccagcucuucuugggguuguuuacgcccauccuugcguuggucugcggcguuuccccagcagacaccacugugggcuacucuaaugacuucucuuuccuccucgaacaacuucuggagaagucgcaccguugcagaguggugccgcuacacauugaucaucuaaccuuaccuggguccucagcuauagggccgucugucucgagucagcugucacuuaaaaguuucaccauuuucucugguuugacuugcugaaaaaaaaaaaagaaacauuaaaaaauuucacuauuuucuuaaaauaguuuaccuuaucacacccucucauguucacuggaugacuauccuuucuuccuggugaaagcagaaacccucaguuucucaucuugcaccuacagacucaucugcaauccuuaccuccuugggaaaaaaagacgucucucuuuccaugugaguaucagucaucccccugugccauuucauuuucugguuuucaguccacccugccuuuucuccgcaaaguuuucacuucugugucuuuagccuuuccucuaauggauguagguguugaauaauuuuacauuuaaggggacccucccugaaccugaugucccuuuccagccgcugccuuuuucauccuuaacgaccaugcuucuugagaguugucuacccuuucugucccucucuucuccuucacugacacgugacauucuacugcuacccagccacugaucauuuuccugucaaggggaccauugaucuccaacuugcuauccuccuaaguuuuuaucuggcuugaucuuuguguuacacuuggcacuguugggcccacuucuuuaaguguucucuuaguuuucauggcuccagucucuccagauuuuccuguguuccuugaccuauuuuaacauuucuucaggggggcaccucuuccuuuggaguuggugguguuuucuaggguuccauugugaccucauuuuacuuuuauacaucuccagaaguuauaugauucacugccaugguuccacuuucauuuauaaugcccaaaucucuaccucuggcuuguucugccaacaugaauagucagcagccaccuggacauuucugcuugccaucucccagguccacuccuguagucgguaaucggugcccaccauucacgaaguauauauuaguuugcuaagucuaccauaacaggaugccacagacuaggcccaagcaacagaauuuucuuuucucacaguuuuagaggcuugaagucuaagaucaccgugucaggagguuugauuucuccugaggccucucuccuuggcucgcagauggccaucuucuugcuguguccucacauguccuuuucucuuuugugugugugugugugagacggggucuugcucugucacccaggcuggagugcacuggcacaaugacagcucacugcccccucaaccuccugggcucaagugauuccuuccaccucagccucucaaguagcugggaauacaggugcaugccaccacgccuggcuaauuuuuuguauuuuugguagagaugguguuucaccauguuacccaggcuggucucaaacuccugagcucaagcaaucugcccgccuuggccucccaaagugcugggauuauaggcaugagccacugcgccaggccaggccucuucgcucugcacacauacaucuggugucucuuccuuuuauaaggacauugguccuauuggauuagggccccacccuuaggaccucauuuaaccuuaauugccucuuuaaaggcccugucacuaaauacagucacauuggggguuaggacuucaacauaaugaguuuugggagagacaguucaguucauaacagccauuugccugagcaagaacuggggguucuuccuuaacuccucuguguugcguaucugauucaccacaucuugaccguucuacgggcguaccuuggagauacuguggauuugguuccagaccacugcaauaaagcaaauagugcuauaaaguaagucacacaaguuuuugguuucccagugcauauaaaagcugugucuauacuguagccuauuaaguacccaauagcauuauauauauuaaaaaaaguacauaccuuaacuaaaacaaaaaaaugcuaacgguugagccuucagcaugucguaaucuuuuugcugguggaggaucuugucuuaauguugauggcugcugaccagucaggguggugguugcugaagguagggaugacuguggcaauuucucaaaauaagauagugaugaaguuugccacguuaauugacucuuccuuucacaaaagauuucucuguagcauguuaacgcuguuugaugcauuuuacccacaguagaacuuauuucaaaauuggagucuucucaaaccaugccacugcuuuaucaacuaaguuucuguaauauucuaaauccuuugcugucauucaacaguguucacagcaucuucaccaggaguagaucccaucuuaagaaaccacuuuuuuuuuuuuuuuuuuuuugagauggaguuuuguucuugucacccaggcuggagugcaauggcaccaucucgccucacugcaaccucugccuccgggguuccagugauucuccugccucagccucccgaguagccuggauuacaggcagccacuaccaugccuggcuaauuuuuguauuuuuaauagagaugggguuucacccuguuggccacgcuggucucaaacuccugaccucaagugauccacccaucucggucucccaaagugcuaggauuacagacgagagccacugugccaggccagaagccacuuucuuugcucauccauaagaagcacgccucauccacuaaaguuuugucaugagauuacaguaauucaaucacaucuucagucuccacuuccaguucucuugcuguuuccaccauaucugcauuuacuucuuccacuaaagucuuggaccguucgaagucauccaugagaguuggaaucagcuuccuucaaacuccuguuaauguugauauuuuuaucuccuccugugaaucaagaauauuuuuaaugacaucuagaauggugaauccuuuccagaaggcuuucaguuuacuuuacccagauuaaucagaggaaucacuauggcaacuguagccuuugaaguauauuucuuaauaauaagacuugaaaguccaaauuacuccuugacccaugggcugcagaauggauguuguauuagcaggcauaaaaacauuaaucuggcuaggcaugguuuggcucacgccuguaauccuagcacuuugggaggcugagguggguggauugccugagcucaggaguucuagaccagucugggcaacauggugaaacccugucucuacuaaaacaaaaauuuagcuggcaugguggugcgcaucuguagucccaacugcuuuggaggcugaggcacaagaaucacuugaaccggggaaguggagguugcagugagcugagaucaugccacugcacuccagccuggggggacacagcaagacugucucgaaaaauaaauaaauaaauagagcauuaaucuccuuguucaucuccaucagagcucuuggauggccaggugcauugucagugaccaguaauauuuugaaaggaaucuuuuccugagcaguaguucucaacagcagucuuaaaauauucaguaaagcaugcuauaaacagaugugcugucauucaggcuuugucguuucauucacagagcacaggcagaggagauuuuguguaauucuuaagagcccuaggauuuucagaacgaugaaugagcacuggccucaacuuaaagucaccaggugcauuagccccuaacaagagaaucagccugucuuuugaagcuuugaagccaggcauugacuucucucuagcgaugaaaguccuaaguagcauugucuucaguagaaggcugauucaucuacauugaaagucuguuuuuuauguugcagagauugcuucuuuccuuaaaccucgugaaccaaaccucugcuagucucagacuuuucuucuguagcuuccucacuucucucacccuucaauagaacuaaagagaguuaaggccuugcccuagauuaggcuuuggcuuaagggaguguuguggcugguuuaaucuucuaucuagacccacugaaacguucuccauaucagcaauaagacuguuuugcuuucuuacucauguguucacuggaguaguacuucuaauuaacuucaagaacuuuuguauucacaacuuggcuaacuggugcaagaggccuagcuuuggccuaucucagcuuucaacauggcguccucacuaagcggauaaucauucuaguuuuugauuugaagugagaguugugcgacucuuccuuuugcuugaacacauagaagcauugccggguuauucagugaccuaguuucaauauugugucccagggaauagagaggcccaaggagagggagagagauggaacagcugguugguggagcaaucagaacaaacauacauuuauugauucaauuuacagucuuauguggggugguucagucaucccaaagcaauuaccauaguaacaucaaagaucacgaucaccaaaacagauauaaugaaaaaguuuaaaauauugcaagaauuaccaaaaugugacacagacaugaagugagcacaugcuauugggaaaaugguacugacagacuugcuugacucaguguugccacaaaccuucaauuuguagagugcaguaucugcaaaggcaauaaagugauacacaauaaaacaagcuguguauguauuuuauuauuguuugaacccauccuuuuuccaucuccucugccaccucaagcauuugaaaauuuauucauucagugcacuuuuuauuuuuauuuaucuuuugagacaggaucucacucugucgcccaggcuggaguguaguggugggaucauagcucgcugcagccccucgaccuuccaggcucaagcaguccucccaccucagccucccaagaaacuaagaauacaggcauacacaccaaacccagcuaauuuuuuauuuuuuuuuaauuuuuuauuuuuuuuugaaacagaguuucgcucauauugccuaggcuggagugcaguuggugcaaucucagcucacagucaccucugccucccggguucaagcaauuauccugccucagccuccugaguagcugggauuacaagcaugcgccaccacucccggcuaauuuuguauuuuuaguagaguugggguuucuccauguuggucaggguggucuugaacucccaaccucaggugaucugccaaccucagccucccaaagugcugggauuacaggcaugagccaccaugccuggugcuaauuuuuuacuuuuuugcagggauggggucucucuaucuugucagggcuggucucaagcuccuggguucaagugauccaccucugccucccaaaguguugggauuacaggcgugagccacugugccuggcccaguacacucugcauacacauuauaugcuagggaugcagccaaagaaguuuaaaaaauauacaacuuaaguaggcggagugggguggcucacgccuguaaucccagagcuuugugaggccgaggcaggcggaucacuggaggcuaggaguucgagaccagucuggucaacauggcaaaaccccgucucuaccagaaauaaaaaaauuagccaggcauggugguguacaccuauaauccuagcuacuugagaggcacgagaaucacuugaaccugggaagcugagguggcagcgaguugagauggcgucacugcacuccagccugggcgacaaagugagauucugucuauaaaaaaaugaaaaaguagauggaaaugauaaagcuaaaugaagaaaaauuaauuggcaaaucacaauuauaaaucuaauagaauucauuugauauaggcuggcacgguggcucacgcccauaaugccagcacuuugggaggcagaggcgggcggaucaguugaggucagaaguuggagaccagccugaccaacauggugaaacccugucucuacuaaaaauauaaaaauuagccgggugugguggugggugccuggaaucccagcuacuugggagacugaggcaggagaauugcuugaacuugggagguggagguuguagugagcugagaucaugccauugcacuccagccuaggcaacggagcaagacuccgucucaaaacaaaacaaaacaaaaaacauuauucugauguaaugaaaaauaccugucaaaucgaauuaagaaaagacaaugaguaaagagaacuguuaugauuuuaaaaauacguuacccacaaucacuuuggaacucaaaauaguuuccugggaggaugaaugaucauaauuuauuc

SEQ ID NO: 12788 - RNA, 36773 nt, Homo sapiens
gaauaaauuaugaucauucauccucccaggaaacuauuuugaguuccaaagugauuguggguaacguauuuuuaaaaucauaacaguucucuuuacucauugucuuuucuuaauucgauuugacagguauuuuucauuacaucagaauaauguuuuuuguuuuguuuuguuuugagacggagucuugcuccguugccuaggcuggagugcaauggcaugaucucagcucacuacaaccuccaccucccaaguucaagcaauucuccugccucagucucccaaguagcugggauuccaggcacccaccaccacacccggcuaauuuuuauauuuuuaguagagacaggguuucaccauguuggucaggcuggucuccaacuucugaccucaacugauccgcccgccucugccucccaaagugcuggcauuaugggcgugagccaccgugccagccuauaucaaaugaauucuauuagauuuauaauugugauuugccaauuaauuuuucuucauuuagcuuuaucauuuccaucuacuuuuucauuuuuuuauagacagaaucucacuuugucgcccaggcuggagugcagugacgccaucucaacucgcugccaccucagcuucccagguucaagugauucucgugccucucaaguagcuaggauuauagguguacaccaccaugccuggcuaauuuuuuuauuucugguagagacgggguuuugccauguugaccagacuggucucgaacuccuagccuccagugauccgccugccucggccucacaaagcucugggauuacaggcgugagccaccccacuccgccuacuuaaguuguauauuuuuuaaacuucuuuggcugcaucccuagcauauaauguguaugcagaguguacugggccaggcacaguggcucacgccuguaaucccaacacuuugggaggcagagguggaucacuugaacccaggagcuugagaccagcccugacaagauagagagaccccaucccugcaaaaaaguaaaaaauuagcaccaggcaugguggcucaugccuguaaucccagcacuuugggaggcugagguuggcagaucaccugagguugggaguucaagaccacccugaccaacauggagaaaccccaacucuacuaaaaauacaaaauuagccgggagugguggcgcaugcuuguaaucccagcuacucaggaggcugaggcaggauaauugcuugaacccgggaggcagaggugacugugagcugagauugcaccaacugcacuccagccuaggcaauaugagcgaaacucuguuucaaaaaaaaauaaaaaauuaaaaaaaaauaaaaaauuagcuggguuugguguguaugccuguauucuuaguuucuugggaggcugaggugggaggacugcuugagccuggaaggucgaggggcugcagcgagcuaugaucccaccacuacacuccagccugggcgacagagugagauccugucucaaaagauaaauaaaaauaaaaagugcacugaaugaauaaauuuucaaaugcuugagguggcagaggagauggaaaaaggauggguucaaacaauaauaaaauacauacacagcuuguuuuauuguguaucacuuuauugccuuugcagauacugcacucuacaaauugaagguuuguggcaacacugagucaagcaagucugucaguaccauuuucccaauagcaugugcucacuucaugucugugucacauuuugguaauucuugcaauauuuuaaacuuuuucauuauaucuguuuuggugaucgugaucuuugauguuacuaugguaauugcuuugggaugacugaaccaccccacauaagacuguaaauugaaucaauaaauguauguuuguucugauugcuccaccaaccagcuguuccaucucucucccucuccuugggccucucuauucccugggacacaauauugaaacuaggucacugaauaacccggcaaugcuucuauguguucaagcaaaaggaagagucgcacaacucucacuucaaaucaaaaacuagaaugauuauccgcuuagugaggacgccauguugaaagcugagauaggccaaagcuaggccucuugcaccaguuagccaaguugugaauacaaaaguucuugaaguuaauuagaaguacuacuccagugaacacaugaguaagaaagcaaaacagucuuauugcugauauggagaacguuucagugggucuagauagaagauuaaaccagccacaacacucccuuaagccaaagccuaaucuagggcaaggccuuaacucucuuuaguucuauugaagggugagagaagugaggaagcuacagaagaaaagucugagacuagcagagguuugguucacgagguuuaaggaaagaagcaaucucugcaacauaaaaaacagacuuucaauguagaugaaucagccuucuacugaagacaaugcuacuuaggacuuucaucgcuagagagaagucaaugccuggcuucaaagcuucaaaagacaggcugauucucuuguuaggggcuaaugcaccuggugacuuuaaguugaggccagugcucauucaucguucugaaaauccuagggcucuuaagaauuacacaaaaucuccucugccugugcucugugaaugaaacgacaaagccugaaugacagcacaucuguuuauagcaugcuuuacugaauauuuuaagacugcuguugagaacuacugcucaggaaaagauuccuuucaaaauauuacuggucacugacaaugcaccuggccauccaagagcucugauggagaugaacaaggagauuaaugcucuauuuauuuauuuauuuuucgagacagucuugcuguguccccccaggcuggagugcaguggcaugaucucagcucacugcaaccuccacuuccccgguucaagugauucuugugccucagccuccaaagcaguugggacuacagaugcgcaccaccaugccagcuaaauuuuuguuuuaguagagacaggguuucaccauguugcccagacuggucuagaacuccugagcucaggcaauccacccaccucagccucccaaagugcuaggauuacaggcgugagccaaaccaugccuagccagauuaauguuuuuaugccugcuaauacaacauccauucugcagcccaugggucaaggaguaauuuggacuuucaagucuuauuauuaagaaauauacuucaaaggcuacaguugccauagugauuccucugauuaaucuggguaaaguaaacugaaagccuucuggaaaggauucaccauucuagaugucauuaaaaauauucuugauucacaggaggagauaaaaauaucaacauuaacaggaguuugaaggaagcugauuccaacucucauggaugacuucgaacgguccaagacuuuaguggaagaaguaaaugcagauaugguggaaacagcaagagaacuggaaguggagacugaagaugugauugaauuacuguaaucucaugacaaaacuuuaguggaugaggcgugcuucuuauggaugagcaaagaaaguggcuucuggccuggcacaguggcucucgucuguaauccuagcacuuugggagaccgagauggguggaucacuugaggucaggaguuugagaccagcguggccaacagggugaaaccccaucucuauuaaaaauacaaaaauuagccaggcaugguaguggcugccuguaauccaggcuacucgggaggcugaggcaggagaaucacuggaaccccggaggcagagguugcagugaggcgagauggugccauugcacuccagccugggugacaagaacaaaacuccaucucaaaaaaaaaaaaaaaaaaaaagugguuucuuaagaugggaucuacuccuggugaagaugcugugaacacuguugaaugacagcaaaggauuuagaauauuacagaaacuuaguugauaaagcaguggcaugguuugagaagacuccaauuuugaaauaaguucuacuguggguaaaaugcaucaaacagcguuaacaugcuacagagaaaucuuuugugaaaggaagagucaauuaacguggcaaacuucaucacuaucuuauuuugagaaauugccacagucaucccuaccuucagcaaccaccacccugacuggucagcagccaucaacauuaagacaagauccuccaccagcaaaaagauuacgacaugcugaaggcucaaccguuagcauuuuuuuguuuuaguuaagguauguacuuuuuuuaauauauauaaugcuauuggguacuuaauaggcuacaguauagacacagcuuuuauaugcacugggaaaccaaaaacuugugugacuuacuuuauagcacuauuugcuuuauugcaguggucuggaaccaaauccacaguaucuccaagguacgcccguagaacggucaagauguggugaaucagauacgcaacacagaggaguuaaggaagaacccccaguucuugcucaggcaaauggcuguuaugaacugaacugucucucccaaaacucauuauguugaaguccuaacccccaaugugacuguauuuagugacagggccuuuaaagaggcaauuaagguuaaaugagguccuaaggguggggcccuaauccaauaggaccaauguccuuauaaaaggaagagacaccagauguaugugugcagagcgaagaggccuggccuggcgcaguggcucaugccuauaaucccagcacuuugggaggccaaggcgggcagauugcuugagcucaggaguuugagaccagccuggguaacauggugaaacaccaucucuaccaaaaauacaaaaaauuagccaggcgugguggcaugcaccuguauucccagcuacuugagaggcugagguggaaggaaucacuugagcccaggagguugagggggcagugagcugucauugugccagugcacuccagccugggugacagagcaagaccccgucucacacacacacacacaaaagagaaaaggacaugugaggacacagcaagaagauggccaucugcgagccaaggagagaggccucaggagaaaucaaaccuccugacacggugaucuuagacuucaagccucuaaaacugugagaaaagaaaauucuguugcuugggccuagucuguggcauccuguuaugguagacuuagcaaacuaauauauacuucgugaauggugggcaccgauuaccgacuacaggaguggaccugggagauggcaagcagaaauguccagguggcugcugacuauucauguuggcagaacaagccagagguagagauuugggcauuauaaaugaaaguggaaccauggcagugaaucauauaacuucuggagauguauaaaaguaaaaugaggucacaauggaacccuagaaaacaccaccaacuccaaaggaagaggugccccccugaagaaauguuaaaauaggucaaggaacacaggaaaaucuggagagacuggagccaugaaaacuaagagaacacuuaaagaagugggcccaacagugccaaguguaacacaaagaucaagccagauaaaaacuuaggaggauagcaaguuggagaucaaugguccccuugacaggaaaaugaucaguggcuggguagcaguagaaugucacgugucagugaaggagaagagagggacagaaaggguagacaacucucaagaagcauggucguuaaggaugaaaaaggcagcggcuggaaagggacaucagguucagggaggguccccuuaaauguaaaauuauucaacaccuacauccauuagaggaaaggcuaaagacacagaagugaaaacuuugcggagaaaaggcaggguggacugaaaaccagaaaaugaaauggcacagggggaugacugauacucacauggaaagagagacgucuuuuuuucccaaggagguaaggauugcagaugagucuguaggugcaagaugagaaacugaggguuucugcuuucaccaggaagaaaggauagucauccagugaacaugagagggugugauaagguaaacuauuuuaagaaaauagugaaauuuuuuaauguuucuuuuuuuuuuuucagcaagucaaaccagagaaaauggugaaacuuuuaagugacagcugacucgagacagacggcccuauagcugaggacccagguaagguuagaugaucaauguguagcggcaccacucugcaacggugcgacuucuccagaaguuguucgaggaggaaagagaagucauuagaguagcccacaguggugucugcuggggaaacgccgcagaccaacgcaaggaugggcguaaacaaccccaagaagagcugggcugccuccugucucugcauucccaucacuucuuuccuucuugguuuuauccuuaaccacgaagagcaguucucacccuuaauguugacucaacauuuccuuuugauaauaaauacuugcuuagcaucuaccuuuacugcccgacgucaagucacagacaaccuacuuaacagacauaaguuuaaaagacccacuuaaugcccuaaggguaauauaagcuagauauaaaaugaaauuuacaauaaaauaugcauuuccaucugcauaucccaggcauaacugcaagaaaacacggaaugaagcaaugagaugcuccuggcuaugugcagaaucccaggaagaaacagguacaaucacagauuacccaagccaugcuagacuugaaacucagauaccguggguagugugauggguccuucaggaacaacaaaaaucaaccaauugcugcauuuuuuaaaaagcgaagucucaggcugccagaaaaacaacuuuaguacacaaacuggaacacuuugguaucaggcaacccagcaccucagagguggagaaaacaacaaacauauauacauaucaccagcaguuuaucacuugagcuuguuuggucaccaccccauuuccugugacugaaauggggagaggagaauccuacuaucagugaugaccaucuuggauuaggacuacaggaaugggcuauacugggggcuuugaccaccucccuaauguuacccaaauaggaaccauaaugccucucaucugaacagaaagagcaaaaagggcuucagaaggcagaaagcucagagguaaagaagguggcucaagccagcucacaggcacugccauugagguaauucucuuuaauacuguggugucuccuucccuaagaugucucacugcugaugaggccaucucuuuggaauguucuauuuaucuauaaaacacuucugcacauuuuagacuugagcccagcugccagggugccagacaggaaacugcagagcuugaaggccaagccuccuaucagagucccaguggagcaaugaacaucuggcugggccacuauucccacaauuucucuaucccauacucucugcuuccuuauuaaguggcuggguggguuuggcaagcagaaaugagguaugugaaaagugagauggcugcagggacugggcccuggcacgucggguuccaaguuggggcuccaucugcagcaagagcgccccuacugcaacccccuucgcugccuucaccaccuccaaagggggccgagucuuagaggugggcuucggcauggccacaagaauauggaaggugcaggaggucgccauccaggaacacuggaucauggagugcaaugacagcaucuuccagcugcuccaggacuggacccagcagcagccacacaaggucauccccuugaaaguccuguggaaggagguggcgcuccccugccagguggucgcuuugaugggauccuguaugacgcguacccacuguagaaggagaccuggcacacacuagcucaacuucauugagaaccacacuuuucaccugcugaagcugaagggaguauugcccucaccuccugcuaccucaccuccuacaggcagcugaugaaguccaaguacucagaugucaccaccaucugagacgcaggugccugugcuauuggaggcaaacuuucgggggaagaacauccucagggcagugauagcauuggucuugcagaugaucaugucgucccuggucaccaagccuucagcccacacagaccuggccaaacaauccucugccaccccuccucaguggcugggagcucaggcucuggccuaucauggcuccaugacugauccuggcugugucacugggcagcuuuucuggccucuacaaugggaacacuacugcuuccccgccaggguccuugagggcaaaaucaacacuaacacugggcuugccccucccucccucaaaauaaaggcaagaugaacucucagaggaacagcagcagguagagggguagcaaggaucaaguguggagagcagacucuagaugagaauguaacacagcagaugacaggaugugcaagucaggagaucuaagaguucuccuucugccaguuaccacugggacacuucaaaucuuugagauugucuucucauaugcaaagcgaagauggcugaauacccuuaccaaccucagaaggcuguuuggguggaagggacugaaugacuuauuguaugcaaacacacuuuguaaagcacuuuagagacaaguuauuauugucgccaucauuauuuuuaaggaaggugaaucauggagaggacccuuagggccuuggggcaaucaaauaaagaauggucacagacuucauacaagucaaaccauguuuccuagucuacuugccagugggaaaaacaagaaugaaagaaaacuugcugagagugacuguuugaggucuagaaagaauagcugggaaaaccuguaagguugaaagguguucagcuucucuuaggguuuuauuuguagcagagaugggaucucacuauguuguguggacuggccucaaacucccgggcucaaaugauccucccaccucagccucccaaaguguugggauuacaggcaugagucacugcgcccagcacucuuaggcuucuucagaaauauacuuuccccaaaauuucccuaagauuuguuccaccuagauauuacccaaaaggauuuggcgguaaaaucgauguggguacaggcuuccucaacaaggaaugcuuggacaccugaguaaugaauuuccaaugaggauaugggaugcagggagugcaacauuuauuucauaacagaaccccuuuuccacagagcagcugacagggggcugcaugaaacauacuuuggaaauuaaagugaacucuccacuugggcauaauguuaugugggcacauggauuggcuuaaaagggaaacaagaauacuucaacauuugaucaacaguaggcaguugcuggacauuuuagaaaaaggagaaauccauuuuuugaccauggcuaaacauggggaaacagcaucacauuuuccugaaccacccuaaucccagccccucaagauccaccagguaugcaaccccaaaccccagucacauacauuaaaucuacacuuuuauuuuuuuguuguaaaaugugcuuuuuccucaaugaacuuuaaucaguccaggaccuacaaacacacacacacacacacacacacacacacacacacacacacaccccaccccacccccacccuccaaccaggugaaaaauccccggcgauuagucuauaacaaauauugacacgaggggggacaaaagcauguugaaauguauuagaaucagaaccuguacaaaaaaaaaaaaauuaaaauauaaccugaaacuguucaaguucagaagucuaguuaagucuuuuucucuugccaggagaaugccaucaucagagggcucugggucaucagccaaggaggggugaaaagacagaagcagcaacagguccuucagcagacagaggggcaucgaugccaccaucccuacccaggugcagccaggaggaguuaaagaucuugggagagcaagcauuagccggcaguuccagugggcagcuggggccuacacaccgaaaacaaggcugaguagucagaggcagcaggaagaguggccaggagagaacgccaagccggaaggaaccauuucugccacccagcagacccacagcacccucugucugugcucagauaccagagguuagucaacccagcgcucucaacuaauuggagaucggagcugggcuuaagaggcugaaaacccguggguuuaguaaacacagcccagcaucacgucccuccacggccugaacuggagcugccaacaagggaugaggcaggagagggaaagcagcgcaucuugacgccuggcuagaaaucacugcaccaucgugaggacugugguaccaggggcuggagaggagugcccccuccucacaaggggaggggccuccuucacaaucaucccugggggcugguuaaagcugccuccggcuuauaaccagccugacaaaaugacguggagcaaaagaaaaacugggagggagacaagcccuuacacagagacaagaaccuccuggagggaagcugggcagugucugacccuguuuugggauggcauugguggagccccugagucugaagggaacaacuggggaaggagggagugggugagggggaguaacaguuuuucuggaacaguaccaacaggguggggaggcgcuggugaggggacgggcaggucuggaacucacugcagguagagaggggaggaaaugggcccuugguguccccuccccaccugacccaggccuggugagugccagcugccccagccggcccuaguggcggcuggagaccagaccuuucacuuuggacaucuucuuggugggcugccucugcucagcgugagggggacacucccguucagccagcugcugcuccaucuccugagccgaggaggaugcgguggcuuugagugucuucuugauguugguaaccugguggggagauauagaauuggagugcucagccuguaugugcucaccaaaacuugcucucacuaugucuucacuucagacaggaagcuaaaauccucugcaagaaaaccugaaauucucuucagaaauccagaugagcagaaacgagccugggcuacucacagcagauuuguggaaaugagucaagcaaaaaugugggacuaaugcucuccugguugaaacaaauggaaggggaacauuuggcaaagaggcacaucaccaacagugaaauaaaucgugauuaaaauguccucagaaagagggacccaagaauucuacacucugcuguuauucauuuauaaaaccacaaauauuuucauaaaaacuuugggaauacagcuccaugaaccuucuugaauaaaccaguagaggaugaacuucagccaacuaagugagaaaugaagaaaauguaauagaaguacuggcaaaaugcuaugacacuaccgugugcaguauagcuuucuuucacuuaacaaaauacagacucguaaauacuuaagcagcucuugaacauuuuaccacgucagaacagauauccucugugacacuugaacccuauucuauuaggaagguucuccaguuuuccaguuuuuugaauugguuccuaguuuggguuucagugcuacucugaacagcccuuuauguuuaccuuugcauacuucugugaacaucuauggaagauacuccuagaagugagcuuuccagaucaaagucgauuuacauuuuacauuugaaucaguacugcuauauugccugcugaaaagugacuauuccaaaccuuugcuccucaguucguugagaggaagaaacagcaggaagaggaugguggugguagggaagaacagugcagucaaauaaguaauagcuuuuuuagucuuuuuuuuuuuuuuuuuuggagacagagucuuacucuguuguacaggauggaguauaguggcacaaucacagcucacugcagccucaacugcccaggcuuaagugauccucccaccucagccuccugagcagcuuggaccacaggcgcuugccaccaugccuggcuaauuuuuaaaaacuuauuuguagagacaagguuucaccacguuguccaggcuguuuucaaacucccagggucaacugacccuccuaccuuggccucccaaagugcugggauuacaggcaugagccaccacacccagccaguuuucuacauagugaaaaggaguugucagggucaaaaguucucaacagucagaauauuaugagcuugaggguaagagacaguccaaaugcaaagacaaaacaaugcuaugagggugagacaaaaauuggguuccuggaggagagccaucaucugcagaauccaccuuaacuagaucauaaauuguuuuuuguugucacuauuuugagacagggggaaaagccaugcccuaaacuucuguaaccucaaucaacgcuguagccuuucugaagagagaaugacagaggacugugggcuggaacagucauuacagagggcaggcugggcaugguggcucacaccuauacuucuagcacuuugggaggcugagcaaagagaauugcucaagagcagguguucaagaccagccugggcaacauagugggacccugucuuucuuaaaaaaaaaaaaaaaaauuuuagccagguaugguggcaugcaccuguagucccagcuacucaaguggcugaggcaggaggaucgcuuaagcccaagagguagaggcuacagugagccaugucugcaccacugcacuccagccuagaugacauucaaguaagaccuuaucucaacaaaaagacauaaaagaaaaaaacaugugccuggugugguggcacaugccuauaguccuagcuauucaggaggcugaggcaggaggaucacuuaaguccaggaguuugaggcugcagugaacuaugauuacaccacugauuccagccugggugacacagcaagacccagugccuggaaauauauaaauauauauauauauauauauauaaaauuuaaaaaaaaauauauauauauauauauaauaaacagggaggggaauucaacucuggguuuauccaguguccugccagacaacaaaacacaaucugggaaccccagaacccugaggcaucucgcccucccagcggcucacugccacuuugguguaccucauucagugagucaccuggcaagguggugagugaaugaucuggagcaagccaauggcuuaucacucuuucucugauaaaagaaauauuauuuguuuuaagacuuuuuuuaaaaaauagaaaugggaucuugcuauguugcccaggcuggucucaaacuucuggcaugaaccaauuugccugccucagccuccuaaguagcugggacuacagacacauacuaucaugcccagcuaaggcauauuuugaugacauuggaggaaaaauuaagaaauuugacuucucagggaacacugcuuuauaaaauaacauucuaaggcuucuccaauuugauauauuuucuaaauauccagaagaaaaugaacuaaaaucauaauaagagguaacgacaugacuuuaguuuauuuauuugcaugucaguuaccucuaacuuccaaagaagauccugcaauuuaacauuaccugagggaauguguuuuaaagucuccccaaaagcugacaaaauuuuaaucaaauaagacauuagaaaacaaacaaguuuuuguuucaaggacuguauuuccaaaaugggguaucuuuccaagcaaauaauuaccuuucccauuuggcaaaauagcuuuauuaaaaauuaaaaaaacaaaaccaaaaaaaauuccuaauuucaucuugucugauaagcacuauuuagccuuauuuccucaaguuauuuguguaauaauuuuuacuaaacaaucagcuuaggccaggcacaguggcucacgccuguaaucccagcacuuugggaggcugaggcaggcagaucacgaggucaggagaucgagaccauccuggcuaacgcggugaaaccccaucucuacuaaaaauauaaaaaguuagccgggugacguggcgggcaccuguagucccagcuacucgggacgcugaggcaggagaauggcgugaacccgggaggcagagcuugcagugagccaagaucgcgccacugcacuccugccugggcuacagagccagacucugucucaaaaaaaaaaaaaaaaaucagcuuauacuacaaauaguuuucuacauuauuuaacaugucuuagauuuacugacagucucauaaccccugcaugaguaaggaaaaggcauuaaucaauccccaaauaaugguuauauuuucaauccgcuucaccuauguuuuuguagcauaaagucauuaucagccuaucagaaagugacaaccggcauuuauuucucucuuuagaguggcccaaggugauuugggccggcuuuggacucagaguaucuauggcugggcugagugaugagucccugaccugccagccaaggagcaaacucugccuguggcacauccaccaacggcaacgcuccgcugccagccucucagcaacugaccaguucaacugacucccaaggcuuugcuguuuuacucuuuuucuuuucaaagcucaacacuuccaaugcuucuccuucacagagccacaaacucaugguucucacucugguccugagggagcccgcgcaucauccuucugcagucacagaagggcugacccucugcuucauuucuguacugccacucccuaccauaacgcagccucccucucucauggugacucaauucuauuuaaaagccuuugagauucaagauccugucaaaagcuuuugaacaaauaaguagacagaagcauggacacuuuccccuguuauucagaugccuauuuacuuccucaagccauuuucuccuguagaaacugcucucauucagcuuuuuuaggggcucaguaacccugacaugcaauaaaaagaaauaagacuuggcccagggaaaaacuugguuuuuucucuaguucugaaauaccaagaucagguaccuuccuucccacuccucaacacaugcccugcacucaagccaucucagccacacucgucccccacaccacacuuggaagcagucauucccccuaugcccuucuguuguucaugcaccccggggguuaccgcuccuccccagguugccccucugauccugccuggagaguugagcaccugguccauacaaacugcccugacugcugcagcccacacugaucugccacccuucaaucuguacuugccuggcagugccucucccucuucgauggccucccacaccacugcaucuccuuuguguuucagaugcacacaccucacuccuccaauaagacugcugacaaaucuaaguccucuacagucguuaccacuuugaggcaaaauguaaacauccugcagaggaaaagagggcuucuugggcaagugucucuaagccuaggaaaugagccuuuuauccuccacaaaggccuggccugggcuggggcagggccauggcccucacacugggauccauuacagagacacuuugcucaagucagcuuuaccacugcauuuacaacacacaacucacaaacgagacuucugaagcacugacagacucuccuaguggaaggggaucuuaaaauucaacuagcuucuuccaguagcugggcaguuguaaccgcagacagcuccuucuaggacuccaaauuggccacccagguaggucaaccaauuaaacccauucuggucucguagacuuucuuaagaauuccaauuccucuuccacagucacccuucaacugacaacaaauaucaucaccacagacuugucuucuuuuaccuaaauuugguagaguuccuuaugacuuucuuccuccaguggccuggcuuacaggcuccucaaaacaugaaccucagaaauuuucaaguaagauugcacugcuagcaaaaaugcagccuagcuccaucagagaccuuaaauauuuaggcaaaaggagaaagagcuuucuggggcaggaaaccuuccuucaguugaggggcaaagcaaaggcagacgagaggaaacacagugcacaacuggaaaagugcuacaaagaaaaagagaacugggugauggagagucccuuuccaagagguaccaggaagcauacuuuuggugcauuguauaaaucucaagauugucacuaacuccuaggagauuuucuacauaauggaaaacagagcuuacuuuguccaguuacacuuuacgaccuccaugacuggaacacagccuacuuuguaaauguagcaauaguuauaaauuaacauuccaccuaacaucagacauaggcacauccaaauauaaagaaaaaugaggccgggcgcgguggcucaggccuguaaucucagcacuuugggagaccgaggcaggcggaucacuugagguccggagguggagaacaaccuggccaacauugcgaaaccccgucucuacuaaaaauacaaaaauuagcugggcgugguggcgggcaccuguaaucccagcuacucaggaggcugaagcaugagaauugcuugaacccaggaggcggagguugcaguagugagccaagaucaugccacugcacuccagccuaggcaacagagugaauuuccaucucaaaaaagaaaaaaagaaaaguagguugggcaugguggcucacgccuguaaucccaacaaagagggagccagaggugggaggauagcuugagguuaggcgcucaagaccagccugaauaauacagcaaaacccaguucucccuaaaaaaaaaaaaaaaaagaaaagaaaaaaaaucagccaggugugguagcauacaccuguaguccuauaguccuagcaacuugggaggccgagguggaaagacugcuugagcccaggagguugagggugcagcgagcuguguuugcaccacugcacuccaugcacuccagccugggugacagagacucugucucaaaaagaaaauacuuuccaaaaucaaauuuaaaugugaaagugcuuuguaaugcucuaaguauuaccuccccaccacagugcuuccucagaaauaaugaaacagcucauaauggucccccagguaugcuggaacuaggaacuaauauggguuauuuccacaaaagccuaaauggagagaauauucuucggcagucugugauagggcugacuucauuaagaaggagggcucuuaaagcuacaacucaccagaagaaagcuguuguuauaagauucaggagggggacaucacguuuuucccucugaaaacaagcaaucuaauuuaaggacaaauaaagaaaagaucaccaaucaguugacaaaauuggcuuuuaaaaguuaggccaaggguaacagaggcauaaauacaaacagaauacgacagaaucacccugauucuuuguagauuucuuuuccuuucaagucaguagcuauuuggugaguaucuucugugugccucaaguagguggcaagcagccuucaacacuuagcagccagaucaugcauuugcuaaauggaaaaaaugacaagguccuaagcuuuggccaugcucagggaacagaccauauuggucugguucagauuuucuaaaagauuauuacgucaauggacuguuuuaauuggugguggagguggccuuggccuuuugcucagauuucuuuuucucaaacuuaaauccuuaccgccaccugcuggcagcaccaggcucugcucgugcacacacccacccucuguguuuaaauaaccaaaauuuaaagagucuacacuguuguguaacuacacggugugccucaaacuuuagccaagugucuacaauagcucugugcacacccgccuuucuuuugucugaugcuauuuauaaugaaaauaaacuugaacaguucaaaauucuaaaacaaguaucauucaucuuuguuaaugaccuugauaccaaagauuagguagugugguuagccucccaaccucauuuuguacagaguuugauuuauagggaagaauaaacagaaaggagaaagcgguuagcccuuccuacuuuguucagaccucaaucccaagucagagaaaaggccaccaucaucaagaggguuguugcacagcuuauuagaaaagcagcaagcuuauuuuccuaauugucuuugcuuuggacuaauguuaaauauaguuaacacuuccuugcccaggcuggucucgaacuccuggacucacgcaauacuuccuccucggucucucaaaguguugggauuacaggugugaaccacugcacccagccucauacuuccuuggcuagucggauuaaacauggucuaugaauugaacauccacagaguauauguauauagggugguguguguguguauucaaaaaaauuagcucaaguucaugaaaagcagaguucagcaguccacugacacacuuuuauggugugccagaaauauucaguucaacauuugaguaccuacuauggguuaggcaugagacaagacgcucgucuuacaaauaggacacagguuuuauuuucaaggagugcauauaacaguauagagaaucacuccaaauuucacaaaucccccuuugaaaggcaccaucuacucaucucuuaugcuucuuagcuggaauuacgggucccacuccgccacucuuagacaccugauuuucaaaauucauuaagcaucauuaauacuucaaacuccauucacacuagaaaagaacuuccaaugcuaaggaaaaucagugcagggcuccaaauaaauugugaagugaggucacuucaugugucagguuacagguacacaaaugcccauaacgcaaaggcuggggccuacaucuguccaagaagcuaaaaguuuccucaacaaccaggugucacuaaaaccacacuuacauccucuuuacuucacuugcagcucaucugccaaauuuuaucccuuucuucuuuccguaugaaacaugucaugcauuuuacacauuuauaauauauauguacaguucacagagaaagaauaaaaugaaacuaugugcccaccacgcaacuuaagaagcagaacacucccagggccuugaagccccacaugccccugcccagcuguaccccucccuccacuccaccugguaacuuaccaccauccuucuauccauuuuuaagauccauccccaaacucauuuucuuuugcucuauagcugcaaaguacauguguacugaaacuacaacauucucuguucuccaagccugauugaucacccuaugcugaccaggaaucagaaaaaagagacagaacaccaagagcaggagccgugucacacucaucccuguaacccagcaccuagcccaggcccacuuguuggugacugcuuguuucaucuacaccaagauucgcaaaacaaaaacauaaacacugcaaacgaauaaacagguaugccuggagagagaaacaaauguuccuuuccuuccuuaccucugcuucuaccugcugcugaguucgguugugguucucuuuguacugguuggcucucagaacuugcugcucgaugcccaguagaacugcuucacagccaucacaccuacaauggagaaaaccagcccugagcugcagaauggccugggaagucucuuccaggcucagaaauauucuuccccaacagcucuccccaguaucuuacagggaccuccuuuaauacucccucugccacaucucuugcccguucacuccuucccaaagacaagcacuucuaaauacauaaugcaggacauuaggagacaaauaugguagucuggggcuaguuucuuagaauacagcuuuaauuuucaacuuuguaucucauggaagaugguuuuguagcacauacgauuaaagaagguaggacaggccgggugcaguggcucccaccuguaaucccagcucuuugagaggccgagguggguggaucaccaggucaggaguucgagaccagccuggccaacacagugaaaccccaucucuacuaaaaauacaaaaauuagccaggugugguggcgggugccuguaaucccagcuacuugggaggcugaggcaggagaaucacuugaacccgggaggcggagguugcagugagcugagaccacgcaauugcacuccagccugggugacagagcgaaacucugccgcaaaaaaaaaaaaaaaaaaaagaagguagaauagauuuuauagauggcacugaguaauccuuuucucaacagaaaaaaaagauguucuaggccaggcgcaguggcucaugccuguaaucccagcaccuugggaggccgaggcaggcggaucaccugaggucgggaauucgagaccagccugaccaacauggagaaaccccgucucuacuacaaauacaaaauuagccaggccugguggcacacgccuguaaucccagcuacuagggaggcugaggcaggagaaucgcuugaaccugggaggcagagguugcggugagcugagaucgcacuauugcacuccagccugggcaacaagagcaaaacugucucaaaaaacaacaaacaaaaaaagauuuccuaaaagcauccuguuuugaagauuccgccuuuucucagaaguuuaaguuacuuccuaauugccauaccccuccuccuauuuuccccacuauuaauuuuuuuaaaaaugaaaaaguugaaagacuacaaugaauauccccauacccuccacuuaagauccaacagugugagcauuuugccauauaugugguagcccucagccuaugaauuuuguuucaaucuaccuccagugccuaaacaugaguuguaagaguuucuacuaguaaacaucccaugguaaccaguuagucuggcaccucuaugucaaacauauugggggcuuaaaaacaggaaaccagacuauggacauaaaaagcugugucagccaucucaaaaacagaauaggacagccaacuuuggcagguucagaaacuagauuuugugugccagaccauuuuuguguugggguauuucuaaguuuauuucuuauuuauucuaaguuuuguaagcuauugaaaacuuccacuuguggcagauguuguauagagaagguguuuggggcuauauuugggacagaacuuggggugaggggugagcaacacauguccugggguguaaaaguagcugaagugagggaaacucaggggacaucaggccccaaggagucaaaguggcacugcuccucucuggauaugcuucucucggggaugagcagagauucucucucccucccgaaccuguguacaaagcucaccgggucugcuucauggcuuccaacaugccacgugccugccugggaacacacucuccucaccuccagguauacucuaacccuggccuuccuucaaaacugagcuaaaacuucuccaaucaguccaucuggcuuuauaagccccaaauaauuuaaaucacuccacagugaauccucguagaaugugagacagcucuuacaaauaucaaauuccauuaaaacagagaaaacacaaaugucccaaugcuuuuuauauaccagaguauaguuaucagauauucuuuguaugagucuguauuccaaguuaaaaugacccacuccuugucuuccaugucccucacgguguuuuacaaacauuagcccaauauguuacugauuuugaacguaaguucuuuuauccgaagaaucuuauaaacauguuaacuucaacagggauagaaaaaauaauaaaaacaaagaaagaaucuuacaaacacuagccuuccugaguuuggucaaacuuugagcgugaguuuggaaagggcaggacuagccucacacagcuaggacacauaggcuccaccugcuaacccugggcauuuuauagcccacuuuuaaauagcucccaguugcauuuaaggaaagaacuauuuuacaaccaaggcaccaggaggccugaaaugacuccuguuaucacacagcugugaucacaaauguagcuccacucuccggcucacuaagccccagcucccagguagcuacaggcccaccccaaacccucagcugacaccagggaaucacauuuuugcaaggagaggcacaaaagacaugcuagauaucccccuccuccuuuuagccucaccauucaugcagggucuugacaauauuauugauauccuucuuucggaugucacggccaaugcagaaauccacuuccagcagcugguuucgcugguccagcuugcccuggaugaugucaguguagacagccucaaugauaaggucuucuaguucccggagauuccgcaucuccaggucuuucagcaacacggaguaggggauacacuguagauaaggccaugugaucauuauaaaaaccaucuggcaagcauuagcgaaaaugcagguauuacucccauagccaacagcugccucuaggcucgggaaacgcaggcuagugguaauuauuaauagcuagggcaacaagagguggauaaaugaaccaugagaccuagaagacccaacaucuaagaaagcaaccuccugguucucugccuccuuggcuucacccagccuucagauuucacaugcugcagcauacuuguagagauccuaaaaacuuguaccaguggagagaaagggaacuacugaguauaugccacucugccaccuucuggaagcuuucagacuuugcuagaucaccauaaaucuccaacagaucccagucacuggaaagagcuggcuacuugcccagcagagugcaaaaacaaacaaaaaaaacuugcaggccagcauaucuaccuauagguggccaauggguacugccagcucagaugucacccugaaguuuguaucuguuuucucagacacaaccaauaugaauuccccaacaauaguucuuuauugggcuguaccaacauucuuuacuacacuugagaaguccacaaucaguacaagaaaaaaggucagguccucauuucacaacaaaauaggccucccaccugaaaugcuaggcugagaaucagaaaugugccauuagaucagauaaaaugauuucagcaacugaaauugcaauccaagaacaaaaaaaccaagugcaguggcucacaccuguaaucccaacacuuugggaggcugagaugggaggaucgcuugaagucaggggguugagaccagccuaggcaacauggugagacccuugucucaauuuaaaaaauuuuuuaaguuaaaaaggccgggcacgguggcucaugccuguaaucccagcacuuugggaggccgaggcagguggaucaccugaggucaggaguucaagaccagccuggccaacgugaugaaacccugacuguacuaaaaaauauaaaaauuaugggcaugguggcaggugccuguaauuccagcuacucgggaggcugaggcaggagaaucacuugaacccaggagguggagguugcaguaagcccagguugcgccacugcacuccagcgcaggcaacagagcaacacucugucucaaaaaaaaaaaaaaaaaauuagccgggcggggugguccacgccuguaaucccagcuacuuggggcugaguaggggaaucgcucgaaucugggaggcagagguugcagugagcugagaucacaccacugcauuccagccugggcgacagagugagacuccgucucaacaacaacaacaacaaaaaaucuagcaaguccgacauagcaaguuuuuccuccagcaugggcauaguucacuguguacugagcaacagauuaagcuguuaacuugccuugagaugccuugcuauuugaaaaauguauaucuuuaacagcagucuccccuuaauauggcaaaaugaucaugccacaugcggcaccacagcaugccaggacuaagaccugcugagucaaucacuucugggcauacuuuuccuguauggaauggggaguacuuuucuacaccauuuuaucuuuuccucugucaagcaaauuuuaugcauuuaugaugugacucuccuaugugcagcugggacuuccuucauugaugucaaugagacagcugacuugggguaaggaggaagacaagagaaggcucaguaccguaccuucauucuugaugccaagcucacgaugguaagaugcuucagcuuguucugcugagcugugcucaguucuggcaggcucuccuuguuggcugcucagucccacccaccacaaaaaucaagacacaaaauaaaauuaggauuucuuuuauggaauaagcucaccaacuccccaaaccaaaucuacuacugaaucacuaucaugacuuugcacuuauucauuugacaaauauuccugucuucuuuggaagacuauguacuuccaaagaagaaaagacucaguuucuacaaacacagaguuuagucuccuaaaaagcaaacaagcaaaaugauguggcaauuaucuuaauggaguacuauuugugccccuugugacauucaauuaaauuaaacauaucuucaucgagcaucuguugugugcaaugcucuguacugagaagaaucaaggaugaacaagaugggcuuugccagggcugcugcauggcacaacuccagggccaccaaccaccuggaggugugcaacuucauggcccuggacuuguccucggucuuacaaucagauguuuccauagcuacaaauccaaggcagaacuaccagaagaaagguacaagcuacuagaagagaggaggagagggauggggaggagacagggguaagagaaagagaugaaaggggaggggagagggaaagagaacaguaucauuuggaaaguacagaagauaaaaagaaagaauucauggaagagauggaguuugaguugagccuugagaaagaggcaaaauuucaauaauaaccauaaaugauaauaacagcaagggcagcagcugcagcagcuaacauaaauagcaagcuuuacaucuuguggauugcauagauccacacguacauacacacauccaguucaucuucacaacaacccgcaagacuccaaguguccucaauuccuuaacgauaauucuggauuccaaaaaacuauauccaaacugauuuuuucuuaagcauggugcugaaauucaccuggugggaauuucuaaccuguacggagacaggcuuuuuaucccacuuguuuccacauuccucugggaguguuacauaaaaaggcaugcgcaucauauuaccuuuuuaaagucccaaaaauucuaaauucugaaacaucuaacuucgaggaguguagguaaggaauaaugggcuuguauuguuacucccacuuuacagacgaggaaauugagcugcauaagguuacuucauuugucaacgaacacacaacuaguagaaguggagccagacuggcuacaggcagucugcuaacagagucugugcaaugcugccucuuuaguaagcaaggacagaaaaacagaacacauucccuggaacaaagggaaggucagaaaaaaaugugguguaccaggaacuggcaaacuguccagucugacagcagcacaaaguagaagugaccagggagaaagaagaagucagggauaucgcagcgaaggcccugaguaucaggcuacagucauaccauuaaaaaaggguaggaaagccagaaaaaaaugcuuuggguagaagguaaguuaguguuuggacauacaaauaccucaaccuaauacuucagauuauaauuuaaaaugacccaaaugcccugcaacagaaaaugagcuaaguagauuaugaaauauuaaaaauauuaaaaagacuuaaaauauggauaaauguuuguaagugggaagaaacaagcaagacauaaaacuguauacauaguuguaccuauguaauacaaaacacaaacauaaggggcacaaaaaaguccagcauccaaaugucugagcaacauaugagugacauuuauuuauuuauuuguuuguuugacagagucucgcucuguugcccaggcuggaguacagcggugcaaucucagcuuacuacagucucuaucucccagguucaagcaauucugcugccucagccuccggaguggcugggauuacaggcgcccaccaccacgccgagcuaauuuuuguauuuuuaguagagacaggguuucaccauguuggccaggcugguguaaaacuccucaccucaagugaucugccugccucggccucccaaagugcugggauuacaggcaugagccaccgcgcccagccuaugagugacuuuuaaaaagucuauuuuccaaauuuucuucaauaugcugguauuauuuugauaauauuuaaaauguugaaacauucuacagguggguauucugcacuucacagcacuccaagagcccuacaaacaccaguccucaagaaucucaucuggaaaacaaacaagggcuacauuuguggaugagcacacacaggccccauuugacccacuagaauauaaaaggugagaaggaacauucccuuugugaggucacccaccgggcacagcaaaaugggaggcagccaggucaagaagucuccccacuaccccaugcuuuauaucucaaaccuugauggucuuccaaacugagcaacauaauuaacacaagucuuuugaaggaucuucaccaacucaccuauguaaucuggguaugucccauaggcaaacagguucaacaacugcaaauaagcagcauuagcuccuuccgcaagcugaagaggaaaaaaaaaguucaccacagaccaaacugucuaccaaucacuguaguguucaaacagaggacgggugagcaugugucaaagaugccauggcuguuuauucuguacuauuugauuacuuggccccuggggucucuaccaacucugguucuucgggaaaaaauaaacaagauuauuaaagccccaaauuuaauuucucucucucaggaauguuuuacuuucuauacagcaugcccaacgaacugcuuuucucucacacacacauacaaagcauuaagcauuggaaggaguucaaaucuucucaagauucuguuugcauuaaaacaaagacuggagcagcccuaucuacauaccagcuugguagguauggcaugagccaccaccaacccaaagugaacaaagcucaggguugguuccaaguuucaggacuacacguggacuaugaacccugggagagaccagcacaucauaagguaugacagaaagccaggcugggacagaaaaccaggguaucagucugccccaaaucaaaauguucauuaaaauuacuuacucuucacugaugcugauggcaaaaagccauguguagaagaaaaacgaaagagccacuguucugccuggaacuucucugcugucaauuacguuaacugguuguuguuguuguuguuguuguuuaaaucacaaacgugggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacuugggaggcugaggcaggagaauggcgugaacccgggaagcggagcuugcagugagccgagauugcgccacugcaguccgcaguccggccugggcgacagagcgagacuccgucucaaaaaaaaaaaaaaaaaaucacaaacgugcuccuguuacccuuccaacuuaccaagcccaguaaacucuaaacaggaauagcaagugguagucuacagacagcaauagcgauacuacucaauuuuagccauuaaaaaaaauaaagcuuccaagaaaugcaucuauaauuucagaucacugaaaggcaaccagcuuauucucagcucacauauggaaaaacgcaauguauggggagauaaagguggucugcuaagcacccuauggagaacuccagcaccauaauaccucaggcuacuuucucagguuaccacaaaccuccugaagucccugaaucagaaggggaagaaaccugguaaagaccauccaaucuagccccccuuuucagaaacauaauuaacaaaacuagccggaaaagagcauuuucuccagagcagauacuccaacacuucucccacuggccuaaaucaauaaggucuuucugacuuuacuuuccauccaucuccucuuagccaaucuuccacaguuacaaaacaacuacuuggcauauucaugcaggcuguucaugaaccugaaggaacauauuaccccuuggucaucucuuguguugaaaaaugaacucaguuuucugaaauuuucuucauaaaacucauuuuccacuucugguaaauuaaauuuuuauugaaagccuacugugugucaggcuacguauucagcucuaaagaaacaauggugagcacuacagaccuccucacagaguuuauaguucggcaagcaaggcugacauuaaauaaaaauuuacagugaaaaaguaaaaguggcucuucucaucucugaacaucacagguagaggagacauaauugggcaccugaaauggcuggacuguagggaacugcuccaguuuccccaucaagaggaauaggcagacacacagcaccgaauccaauaaacugaaggccggcaacuccuuugguuacaacuaacugauucacugaaacuccuguuaaaacugacuguggguguggagccaacagcaaagguguugugguggucaugaaggugauaaacugcccaacaaaagcaaaccaccuccuauaugcaaaucgccaccaccaagaacuccggggccacucucaacagcauccagcacaugcuccacaagaaguaccaucacccagaucuaugcauggcagcuuccacagagccagcaccagucugcauagccagaagccugugaggaugaagaggaaggggaccugccccaccaauccgccaaaagcuccugagcaccagccuccaccccacaaaacaauaaagaugcuuacagacuuuucucaauaagugaauaaauauaaauaaauaaaaauguucaaauuggaaaguagagguugagaaguauagauugcuuuacaucucuuuguuccuucuguucaauggaucuucucauuuuugaggcacaaugaccaaaacuggauauccaagguuuuaauaacaagcaagcaaacaaguaaaaugaacuauguccuagcuuuucaugucauaucuaacacaucuaacacauuuagcacaacacugcccuuuuccucaagaacaauacacuccuauucauguccaucuuauguucaauagcaguauguuucugcugugugucccugaccaaucuuccuuaucgauauugcacuggagguuucugguccuuaagaaugcaugaaucuacuccuauuaaacagcccaugcuuacagcacuacuuuucuaauuuaucaggaucaauuugacuuuuuuacuaucuuuuagguuauuauuagcaacaaucuaauuuuacccaagguaagauaaaaauacuggauaaaaggagccaaggauauucucucaaucucucccucugccccaccaauucccaucugucucacaauaggguaccucacagguucacaauacuucagcacugaaauucuuuggaaaccuggagaauuacagagucuuagaauaaagagaaauuguuugcaaaccguucuuaccuccugcacguuggccagcuccagaaguucuccaaagacauacacuccgggagccucuaagaccuggcuuaugagagcagugagggcugagccacugguaccuuuggcuaguaaaauaaacugcuccaggagauuacuugaggguuucuguuccccugccauucucuggccuugaaaucuguccaaaagaaaauugugucagucauucuuccuucuccuuugcaaagucugugccuauucagugcugaaucaaacaccagaauacuuuacuuuuauaguguugauaaagaaaaaacaggacaagugcaguggcucaugccuguaaucccagcacuuugggaggcugaggcggguggaucaccugaggugaggaguucgagaccaguaugggcaacauggcaaaaccccaucucuacuaaaaauacaaaaauuagcuaggcugguggcagauaccuguagucccaguuacuugggaggcuguggcacaagaauugcuugaacccaggagguggagguugcagugagccaagauugugccacugcacuccagccugggcaacagagcgagacugucucaaaaaaaaaaaaaaaaaaaacaguuccugaguccagaugcaaugaccaccuuaugagauggguggaguucaaccuggaguuaaaaggaucuuguccuaaauucugguguuugaaacacacuuuguaaaagucauuucacuuccaccugucccuccuccagaggcaacaccuucuaaguccuuaaaccugaccaggaccuaaagaaaaacacaugaguuucucagcagcuguuuuauauccaccucguuuauacauucugguuaagaaauggaggauacugccuauacacagaggcaccggauguaagcaaaagcaaucaguuacagcucccacugugucaucagaauccaaucuacagccagacagauaaggaaaacaaaaaaccagacaagaaagaugucucauuuaaucaagucaaguaagcacagauaaagggagacaucauuuugaaagaaaaguagcgauauauucaaacuaagaacauacaugcuguguaagaccauggggaaaaaucccuguauucggccuccuccugauacgacauuuuaaccaaacgugacuucagaauguguaaaaaaaaaaaaaccucaagaaaacgauaaaaagauuugggaaaacagugaaaauauuguaucagcgcuccgaagacauuaaguacaggagggucccucaauuguguaaucuaauuacacgcugaguguacaggaguuccagguaagauuucuccuccaagaaugauacauauuagagcagcgugacaaaaugaacgaaaaacgguauaguagagugcagcaaagaacaauuugaagaauaguuuggugcaagaggaacuaaguuuuguguuggcaggcacacagauuaguugcccuuucacaguauuagagaaacaaguaugucgccucacuuaggguuaccuaagaagguccggccagacacaggaaaaacaaugaagugcuggggaacaacgaguuugaggacggaagggaaagggaaaagagaaggggagaggauacgaggaagaaggaaaggaguagggaagaaaggagggucggugacgguaaagagggaaggagcgaaaaggcccuuccaagaggacccgugugaagagacagauggggaucucugcaaagagucccaauguuaggagguggggguggagaggggguagggaaauggagagaaacuucugucccuucaaaaaaucucggcuuaaggagcaaagccugugggcgcagagaauguaaagagacggagacagucgcuuucuucuggagugggagggccagaggcuaggcacagagcggagauaaauucccgucaggggagggcgcuauuuggauggacuggagaggggcaaacgagcagccuuuggggaugggagagcgaaagcagccacagcacugaagcugagggucgcaagcugcagcagaccucacggugggcgguaugcuccaagcagggccgcaggcguggagugaggagccgcgggacgcgcuccccaaggcgggggcggggcgggcacggccgcgggcuuccuuggcggcgggcucuaagccggaucgucuggccgagccuggagcgccggccccgcucggcccacccucucgcuagcuccuaccuguccacgccaccucucgguccucuuagucgcuggcucggccucccggcgccugcccgcagguugucaagcguccaugaucaccccggcguccggcgcuuuucugucuccgccgacccgucgcccgugcagcucccccggaagccucccaccgcugcacucgcguuccgcccacacaagguuccacccgccgcguuuacagccuucgaccuccgguggggaagugggagcgagggggcggggaagagucugcagcccgggaaccaggcggggaggggguggcuaggggcccaaggagaggaaugcggccuagacgguacugcagcccaaccgucgccaucgccaucccgggccccaaauccuccccuuaggcugugcuuucucucucaggagcuccccauggcuacugcgcuaccccugggcaccgagauacauuaagccuacuaacuaccacuuauugagcguuuuaccaugugccaggugcuguacaugcauuaucucguugaauucucauaacuguggcuuguauuauuguucccauuuuucaggugaguuaacuaaguccaaaagucagaaagugacaaagcuugcuaucuuugucaaacccaggcuaucugaggccgaagacgauguucuugaccucuauucagaaaauguuuuaaaauaagcaagagauggguuaagccaacaaugguucuaugaccaaaaugucauugauagaguugcaucuggugcuuaccaacuccccugggaagauggcuaagaaaugccacauaauugaacacuuaaacugauuccuguauacaccacagucuuucaggucuugaaaaugagagagaaaaacagcccuauuugccuaucgugcguuagaaugcagaaaugagacaggacaaaugcaaaggagccuagcaucaaccaacucauucauuuauucaaaaacauuucuuuagcaccuauuauguccugaaaaguuauaugaagauaaaacaaagcucuuacccucaaaagcuccaauguguuaaaugcuauggggaagauaugacaacacuuuggaagcacagaagagguuggggaagaaaaaaacagacaaaaaggggaaaaaagggggguagugcccauugucacagaggcucgcacugugcagcauauacugaugucaaaaagaaacccagagugguuugaccccaggguuuucaagagugagaaaugagggguacagagcuggagucaggucaucaaaggucuuggaauccacaugccagguacuggggaauuacuuaggcuuuuuaagcuaaggagagguaugaauaauugccuuguuagagugaucaugcuaggugcuauaggaguggauuggauguggagagaauuggaggcagggaaaaccuccggugaggugaccgauuuauucuagauaagagauuguguugccgggcgcgguggcucacgccuguaaucccagcacuuugggaggccaaggugggcagaucaccugaggucaggaguucgagaccggccugggccacauggcaaaacucugucucuacuaaaaauacaaaaauuagcugggcauggugaugcacuacuaaucucagcuacucuggaggcugaggcaugagaaucgcuugaacccaggagguggagguugcagugagccgaaauugcgccacugcauuccagccugggcaacagacugagacugcaucucaaaaauacaaacaaaaacaaagguaguggcaauuggggaugaaaaagaagggacacuguuggagacauuuagacuauagaaucuauaagacuuggugaccaguugaauauaaggagagggagggagcauaacacccaggauucugcgcugggaggccagagcugucuagagcuaguguuaagugaacagggcuauggaagaggagggacaaauaugagagugagaggaagacaagugaguuuagugugacuucauagaaauuccagcaaugccucuacuuccucuagaacaauguccagacuccauggcugcaauuuggauuuaguauuuugguuuuuuuuucccuuaagagacagagucuuacucugucaccgcggcuggagugcaguggcacuaucauagcucaccucagccuugaacuucugggcucaagggauccuaccaccuccaccucccaaguagcuaggacuagaggugcgugccaccacacccggcaaauuuauuccuuuuuuuuuuuuuaaagauggggucucacuauguugcucaagcuggucuucccugaucucaagugauccucccaccuuggcucccagagugcugagauuacaggcgugagccaccacgcccaggcaguggcugcacugaaagcccuucaaagugugccucccuccuaacuccagcuuugucgcaccccacccccucccccuucucaguccaaacucccaugcccggcacaacuuacacccucccucucagacaccacaccuaugcucaagcuugcucuuuuuuggaaugcucuucuaucagccuguaaaaaaccugccaacucuaaaagcaaagauuucugaaauccaaugcaaaaaacacuaaccauaauaaaaagcacggaacuauugcacuguguuaaaauuaagaauuucugcuugucagaugcaguggaguacaccuauagucuuacuauagcuacuugcgaggcagaggcaggaggaucacuugaucccaggaguucgagguugcagugggcaaugcuggugccugugaauagccacugcauuccagccugggcaacacagcagagaccccaucccucaaaaauauaauuuguuucaaaagacaccaguaagagagugaaaagacaagccaugccuuggaaaagauaucugcaaagcauauaucaaagaacuccauauccagacuguaaagaacuacaaaucaauaagaagacagcccaauuuuuaaaaguugggaaaagaacaggcacuucacgaaagaggacguucaacuagccaacaagcacauugaaaggugcucaacaucaggaaaaaugcaaauaaauaccuuaaugagauaccacauucagccagaacggcuacaauuaagaagacugacaacaaaacucuuguguugacaaggauaagaggcaccuagaacucucucauauugcuggcaaaggcguaaauugguacaaucauuuugaaaaacuggcaaugucuacuaucacugaucaugugcauacccucccuacacacuagcaauuccucuccuagaaaugugugcaagugucuacaaaaagaaacauguaagaaugcucacuacggcuuugcuaauaauaguccaaaaaauaacaacccaaaugcccgccaacaguggaaaagauaaauugugguauaaacauacaacagaauacuauucagcaauuaaaaggcuacacacaacauggaugaauuucacaaaaauacugauaaaguaaaaaagccagacacauacuguacauacuguauuauuauauuuaacuggaauucaagaacagagaaaacugaucuauggugauacagucagaagagugauuaucucaauauguaaggauguaauacugauugggagggagcacuaagugugcuagaaauguucuauaucuugauuuggguaguggcgacagggguguauaccuaugugaaaauuguucccauacuguauguuacaccucauuaacaaaaaaaaaacuuuuuuaacauggaaaaaaaauucaaguucaaaugccaccuuguccauuaaaguuuugccagcugcaaugaaccuuuucaucagggccuccuuagcauucugaugucauuucuuuaugccauuuuaucacacuccaucuugaaucucaguggagucuccuuauuucccuaaauauauguucaucuuccugguggcagugaccauguccuucaccuuuuacccacucagugccugacaaauaacaggcugaaaagauauuuguugaauuacauggaagaaaaaauugggugaguucccagaugggugaaaguggggacaggcagaggaaggaaggccaagagaaggacagaggagguuuccaaggaaaccguggcucacacuguaauuuuaccuacuuccugaaaucacauuaaaugucaccuugaguggcaaaaaacaaaacaccaaauccuaccuaggcugaaaauaaauaaauaucacacucccucacucgcaagaaauccaccaaauaaaugcuaccuaauucuggguguuucaacaguggauaggaaaaccguucaaggagaauaauucacauugccaugcugcuaaaaauaucaccuccuuaguguggugcaaagaguccagacugcaagucagccgacuuagggcugaauucuaacucugcccgaacuugcugugaucuguggccaaucccuucgccucucugggccucaauuuccucauacguaacaacaggggauagauuagcaaagucccuuuauguuuugauauucugaguauacaauccauagcucucccggugcaaaccaggaauacagcaaaaaacccugaaauacauguaaaaggcgccucagaccaacaaacaagcacgauuugaagaagucauuuuguucucuuucacgguuuaaucaguguuuuuguuuguuguuugcagccuuaccaugauuugcagaugucugaguuccauguaaacagaaguuaacucucugcgggcugucaucuucuuuugagggugagaagggucuucccguuggguuucaagucucgggauuccgaaacgaccaacucagcgggcggguuugugaauuugcgcacacugcgcggcacacuggagucuaaguuacagaggaaccgagugcagg

SEQ ID NO: 12789 - RNA, 5325 nt, Homo sapiens
ugggcuccuaggaguuaagggccaggugagggcugaccagggaggcggguaauuuugauguaagagaacggggucagaugauuugagggacaagaauucagugcccgggggccgaaaggcagcagaaggcgggcaccaaaggauaggcacccggaagguggacuccgaggaggagagaggacaggggucucucaccccagcuccuggucaccaugcugcuggcugugcugcugcugcuaccccucccaagcucaugguuugcccacgggcacccacuguacacacgccugccccccagcgcccugcaagguaaguccaggcuggcccgagagccgcgggguugggaggaauguagaggaagugggacccugggcgggcggggacagaagagcuugucacccccacucauaaggaccuuuggcuccuucugcccacccugcugcgagaaggggccaagaacugagauauaggugggagaggagggguguggcgggaaagggaaggggagcuguugagcaugccgaaaggaauggagagaaggccccaagaagcagagagaaacggcccggggcagcacccugcccuuggcugucccggccgaaggugggccacucaaacacagcuacuuucagucaauaaagcugaguucugcgaugucuguaucuuugggguggugucuuuaaaaaaaauuguuaaggaaaagcaccuuucaaagaucccaguccagcucaguugaauuagggagacaucuugggcugagaaccugggagcacgggcucugagugcugggcccagcguccccggggcucacuugccuccucauucugucccaggcuggugggucucccgaggcagggcucagggcuggggccaggaggaugaggcugaggcucuuccccaaccacgcaugauugugugcccccugucccagcaguucugucggcccaggggacucaggcguugcaggcagcccagaggagcgcccagugggcaauaaaccgaguggcgauggagauccagcacagaucgcacgagugccgaggugcccacccugccccccgugccccagugagcuugcugccuacccugggcccauucugcugccucugucccuucccuucagucuucacucuccucuugggggcagagacuguguugggccgcaaccuagacuacguuugugaaggucugucucuccgaguggaaaggacacgcuaggcuuggggcauggccugugcaaaggcagggaggcggaaacacucugggcuccuguggugaccaggagaaguucaugguugcugaaauagaacccgugugggcuggagggcugagcgcgaaaggagagauggggagagagaggcucggcccagccuggggugaggacaggcgagagggcagcagugagacucaaaggucuguuucucugcaggaucugggcgccccaggccucaagcucuccuccaggacccaccugagccaggugagguugaaaaggcucgagggggcaggccugagagccgggugggccucgaaggcgaggauggccagaacaugucccucgugacaccccuugccccuuucuagggccgugcggcgagaggcguccgagcacugccaaugugacgcgggcccacggccgcaucguggggggcagcgcggcgccgcccggggccuggcccuggcuggugaggcugcagcucggcgggcagccucugugcggcggcguccugguagcggccuccugggugcucacggcagcgcacugcuuuguaggguaaguaggacccccaggccuugcccagcugggguccccggcgcugggccccgcaccugccggguuguccggcgggcgacgcgcgggaaagguggucucugcugcccccuggcggcggccggccccgggcuuccccaucucaaggcgccgcgcccgccccgccaggaugccagcccggaggggguggcacggccgggcgaguucgcccccucugggacgggaccccuccccggcccgcccuccgugcccccagguggagaaagcccggcaugcgggcggaggggcagggucuccgaggggccugcggggugugccccuguccuuccugcgucucagcugccgcucgacccgcagcgccccgaaugagcuucuguggacugugacgcuggcagaggggucccggggggagcaagcggaggaggugccagugaaccgcauccugccccaccccaaggugagaaggcaguccccaggcccccaaggcugggcaccgcacccccacccgugcuuccuugacccugcgccgccucccccuccucaguuugacccgcggaccuuccacaacgaccuggcccuggugcagcuguggacgccggugagcccggggggaucggcgcgccccgugugccugccccaggagccccaggagcccccugccggaaccgccugcgccaucgcgggcuggggcgcccucuucgaagguacugggcgugggugagccggcgcguggugggaagaacuggggguccgagguaauagaguguagggaggccggguugccuuggaaaaaugcugccugcucuuucaaagggggaggaaucaagggggguggugggaaggggacccucaaggcggggcucuugcccuccaaaccugagccuuccaccccuucccugcagacgggccugaggcugaagcagugagagaggcccguguuccccugcucagcaccgacaccugccgaagagcccuggggcccgggcugcgccccagcaccaugcucugcgccggguaccuggcggggggcguugacucgugccagguaugaacccagucugaugagaaaaggccggcugagccuucccagggccacuacggccucuuuuccuuccacgucugucugucacucgacuucucugagccucucuguccucaucccuaaaauggacacaaguggcaagcucacaccugccaggcguaaggcaggcgucauagggggcaggugaaugcagcguccucucucuuggccccgcagggugacucgggaggcccccugaccuguucugagccuggcccccgcccuagagagguccuguucggagucaccuccuggggggacggcugcggggagccagggaagcccggggucuacacccgcguggcaguguucaaggacuggcuccaggagcagaugagcggugagcgcccucuuuccaaugccccguccccagugccccaacggacaaccgugggacaagcccguuuccacccggcccaugcccauucccagcucccuucugccucgggaaagccugucuccuuccggggaaggagugagggggcuagggccccaaacagagggugagcugaccccugucccgcccgcagcagccuccuccagccgcgagcccagcugcagggagcuucuggccugggaccccccccaggagcugcaggcagacgccgcccggcucugcgccuucuaugcccgccugugcccggggucccagggcgccugugcgcgccuggcgcaccagcagugccugcagcgccggcggcgaugcggucaguucuguucacccggacccggacggggggcagaggggagggggccuggccagccucugaccgccgcuccgacuccuguccgguccgcagagcugcgcucgcuggcgcacacgcugcugggccugcugcggaacgcgcaggagcugcucgggccucguccgggacugcggcgccuggcccccgcccuggcucuccccgcuccagcgcucagggagucuccucugcaccccgcccgggagcugcggcuucacucagguaccccgcgcccuccagcccagcccagcccuggcccggccccacccgcgcggcacagccacuuucuccgccgaggcgguacccuaacccugugccuccccaggaucgcgggcugcaggcacucgguucccgaagcggaggccggagccgcgcggagaagccaacgguaaugacgcccccugccgaccuucaggaggggauaggcugagggccuggacgaggucggaagcgcuucuacugcagcuccggaaagggcuuaccccauggggcaacaggguggacucguucuccccuccccgccauagagcguaugacucuuuuggaguacuugugguuuuagcucucaucagugucaaacagagaugcuuugccugguguuacugcuuaacuucuccgagccucaguuuccccaccuauagcauaagaggauaaguguguccccugggaggccauccugaggugcuggugggagugccacccccaguuccauaccgcaaccguucauuauucccggggccucuccucuuccuccaggcugcccugggcuggagccccugcgacagaaguuggcugcccugcagggggcccaugccuggauccugcagguccccucggagcaccuggccaugaacuuucaugagguagguccccaggcuuccagacuccuucacgauggccugggaaggcugagacccagcccagggaagaugcagagggcccagcccagauacccucccagcagccuggggucgccucugccccagcucuggggguagguagaggguccgaggggaagggaguggggccugcggagugugagccaggccacuggggguggugguggggagagugaguagaggggugggugggaguguccacaugagcgggaaaugagcaggguuuccaggucuaggugagaguuucuggggcccagggggagagggggugaccucugggguuucaacucaggagugaguuucugggccccugauccccacuccuccaucuguagguccuggcagaucugggcuccaagacacugaccgggcuuuucagagccugggugcgggcaggcuuggggggccggcauguggccuucagcggccuggugggccuggagccggccacacuggcucgcagccucccccggcugcuggugcaggcccugcaggccuuccgcguggcugcccuggcagaaggggagcccgagggacccuggauggauguagggcaggggcccgggcuggagaggaaggggcaccacccacucaacccucagguaccccccgccaggcaacccugagccaugucugggcccccagccccuggggaggaccuacugcucccaggggcugagagggguucgggagcauaaugacaaacugucgcugccccaguggcugggugugugugggugggaugggguggggguccugggccccccgugucuucccagguuuacaaucagagaaucacagcugcuuuaauaaauguuauuuauaauacac

SEQ ID NO: 12790 - RNA, 8510 nt, Homo sapiens
uaggcauaggcaugauuaccgugauguagagagcuauaauuagcauugaaaaaagaaaacaugagauacaguaaagaaaaaguagcugcauaacuggcuggguguauuuaauacauuaaaaaauggauaagucuuauucugucaguccuguuucagagaucugaaaauugucaaugcuuuguccauugauguggauauccaggucaguccuguuugggcuuuuagaaaccagaggaguuggaaauucagggacagucuugucaaaauucuccaucuugauuugauauucaccuuuggaaccucgggucaacagagaugcaaaacagugauguaacaugauuucagacgguagguaggauguccuccuuuggcauauuucuccagugcccuccugcauugcugaaaggaauacaacuaauucaaagugagaaggauuuucaugcuggagcagaguagccagaggacuugaugguguaauggagugauaguacguuaguggaaagaugaagaauggacauucgucagaacugaugccaucaagguggaaauccacacuggucugguagaguuugccauuuucucuuuccugauagaguacagcugagacccggacacugguuagagggcuaggucggguguuggccacuuggaagauaagauuagguuugccauccaugugagcuacuacugcugugucaguaaagcgaauugaaaaagcucgauuuuuuggccgggcaaucuucgccacaaaagcaccuaaauaagaaauuauugauuuuuuuuuagaaugaagacuuuaaauaucaauacuuuuucugaaugacaaguguauaucaaauauuuacacauuucuuggugccaugccuuucagugagucaggaauugaacucauuguuaauuuggucagucuuauuugccugaagcauuuuucaaaguacauuucuguuuaaaaaccaugauuucagaauagauaagcaaaaugauuuuguuacagagaaauguaaaacuucauccucuaguuucuuacaaagucaaagaauuggucauuuccuauauuccugccugugcuuaaaaaaaaguaauagaaaauaaaugcaacuuggcuacagccagauuacguugaaguagagacuagguucagaguagaaugauuugggauggggaggggaccaauagaaugagugauauuuuggccaggcauggugucucacgccuguaaucccggcacuuugggagcccgaggcgggcgggucauuugaggucaggaguuugagaccagccuggccaacaucaugaaaccccgucucuacuaaaaauacaaaaauuagcugggucugguggcacaugccuguaaucccagcuacucaggaggcugaggcaggagauugcagugagccaaguuuguagcacugcacuccagccugggcaacagaggaagacuccaucucaaaaaaaaaaaaaaaaaaaaaagugauauuuugaagaauuuuuaaacuuugaaacguauuuuuaaacuuugaaacucagaaaccuuuuguggggcaggggaggacugacuaucagguaauuucagugcaccuuucaggucuaucuuccuugugcccuaagcuauauauaagaguuucuuaaucaguuuugugccacagauuuuguuggcgggcuguugguaaggucuaagaaguaaguacuuaccagaauuauguuuuaagugcuuaaaaguaaaauauaaaagaaaccaaauuauugaaauucaguugaacauuuaagaaauguuauuauaguacuauaugugccuuacugauacauuaaauaacagucuaguggugguuuuaguacugugauuuucaaguauucugguuugauaugacaaaauauuuaugauuucuguuugaaucaaagcuacuaauacugcuggugguauuguuuuuuguugccuguaggagaugccaaauuucaauuagugguuagugccaagagauacaaguuuuucccauauaaguuuauagacccccuuaauuguaugcaaaggacugacccaguauaggaacucuuguuguagaaguuugugauuugcagguuauagagcugguugguagcacacugggauuucauuccagaucauucuucauacggcccaaugcuuaccuucucagauuauuauugaauaguauauuaaagccaaguuuucuuuugaaauuauguaugucacauaaaaagggcacuaguccuccuuuaaaggaaagaguuuucuguguucaugagcaaaauuucauaaucuuuguggacauauuuccagugcauuuugcuaagaauguguauacauaacuuguucucuaacauauaaugcugacugugguguucugggcucacuggcauaaaguaaauguugaaaagaugaacucauaggagggaauucuagcucagugaagaaaaaaaaccaaauucuuuuguuagguaaaaugacugucaaaauagguauugaauguauuuauuuauguauuugacaaaaugauuagcuucagugaaaaccuccuuuuaaaccuuuuguuaauuuuuuuuuuuugauaugggauauuucugcaauuuaguaucauacugaucucuuuuuucuuaaguaguuacaguaaguaaaauuuuggcauugagacagguuccuuaugcauuucuccuauuuuuuuuggcucuaaacuguuucuuuucuaucuuagacauuaccugcuaucaauauagauaaauuauucuguaacagcauuacuuauaacugacuauacccuuuccaaacaccuguaguuuuguuuuguuuuguuuuuguuuuuguuuuuuuuaagaacaaagacaaaauuaccugugauaaaagccucuagcaugaggccuaggagcauuuguauggcaaguaaggcgauugcacuuggacagucaccacuggggaacaugguaccauaaccaauugugaguugugucuccagggagaaggagaaugcagcugugaaacuggugauauacuugacacagauagugugguuuucagguggggcaucaugaucuaguuccagaucaccauucaucucagccagaacauaccagagcacugcaaagacaagccaguggacaacaaaagaagcagaaaagaccaacaucauccaacgccagcgcauguccauuaggauuccccaagcaucucgaagauaugcaagaccucuuugagcgccauccauuugaagugugcuguggccauccuuggugaccauccuccgguaucuuugacuuaggagaggagcaauaacuuugcaauuacugcuguccaucucaggcuguauuucucuaaaaucaagaguaaauuaguaagcucuuaacuguuuuauaguuaauguuugugaauuuggagagcucauggacuuucugcuuucuugggaaugcuucucuaaccacaacuuugccaacucucucgcuuuucucuucacguuagauggcauuuacuaagucauucauuugggagcuaauuguguguuaccuuaaaauaucucuucuauuguuucuuugaaugacaguuaaaacauuguuuaacacuuaaacauuuucuaaguauauuuuagaauuccuguagguagagauuauauaccccugugucuuccuugcacaaguccgggugucaagcauuuauugauuugaccaaauauuguguauaaagacuagcauuucauaguuaauuuauaauuaugcauuauucauaauuaaaagggguauguuuaaauauguaaguguucuucuguguaaauaauuagaagucauuuggaagcuuauuauuaaacugucugcaaauccuuugaagccagauuuaguauaggacaaggcuuacauuugugguaagcuuuuagagguuuguaguucuaauguaugcuuuauaauuagccuauucagaguuugauuuauugauuuguauuuuuagagacagggucuugcucugucuccuaggcuggagugcaguggcacaaucauagcucacugcaaccucagcaaauuuuuagaauuuuaauuuuuguugguacugggcucaauauauugccuaggcuggucucagacuccuguucucaagccaucuucccacuucagccuuccaaagcgcugggauuacaggggugagccaccauaccuggucuuauuuagaguuuuaugauuaggcuuuauuuguuuuugucacuuugcaaccauguucguggauucuuucuguccuggaugauggauugcuaucucuuugcauauucuaggcucugauuagauugggggguagaaagagaauuguuucuuggcaaaauaagaaauuccaggaagacauuucuggauagcauuagcuuuaaaaguaaguaaacuagaagaaaaagguugaauaguucaaugaacuaaaauaaucauuaagggguuaaauaagaauuuuaaaaagauaacauuaguauaauuaguuuucugcugcaaacaguuuucaucagugguuauccuuuucucaagguggugaguagaaaucuaaugugugccuuccuuguaaucauccuugcguaugacaaaggugucuuaagacuuuaguguagcaguuacuaggaacagaacaggaaaugcagcuuugcuucccuugagugagccucucuuguuugcuacaauucaggacuaugaguuuauauuugacuguccucuuugcuucuuccuuuagagguagauacccuugagagugcugcauacccacuuccugccuuuuaauggggcuugagaagggcacuacagacuuguggagcuagguuguugcuuggguuuccuaguuccuauaucucgggacuuugaggcuuuggagacugccuuucuguguuguuggaauuggauauuggccaccuggguauauacaacuuucuuuugcucugagguaacuuaacauuuauuggugauuagagacuuuuuuuuguauuuucuucagauuugagcuaauggaacacugggaugauuguucaguuuauuuagguuagauggcgauuucaguuucauaugauauagacuuuaaaaaaucuuagugcauuauuuuaauguuuuauaacuuauuacccuaacaaguugucauaaucauuuaguguauucuuuuuucuuggcauagcuacuuaaugacccuuauuuuguuagauuauuuuuaaauguuuuaggagaccugaucucuacgcuuuggaaacaacaaaaucuucauaggcacugugauaacugcuuucauacuguauuaucucuuaauucuucaguaucucaacaagauagccauuguucccauuuucagaugaagucacuggugcucagacagauaaaagaaauuuacacaaggcaaauaggagcuuuggauuauuuggaugguuauucaagucuagcuaacuucaaagccaguuaauuuuuuuuuuuaauacaggaagcguuuggugaaauaacagucuuuccaaaaaugauugauauugcauucucaagaaggucuuugauagccaaauuucuagcaccuuuaguagaugccuuucuugccccugaaacugucucaaguaucuguauuaaaccauuguuaacuuuguucaugauucuuuagauaguaaugauuaauaauauuagcuaauauauauauuguuuagcaugugccaggaaucauaccaaauacuucauauguacaaacugaugugaagccaguggcacagaguaagcucucaguaaaguauuaguugcuuuauuguuauuaaaaacgugucuggcucccagcacuucgggaggccgagacaggaggauugcuugaguccaggaguuagagaccagccuaggcaacguagugagacuuugucucuauuuaaaaaaaaaaaaaaaaaaaaaaaggugucuuaaguuucacaguaauaaguaucacuauuagucccauuuuacagauaacgaaagugaggaaccaggcauggugacucaugccuguaacacuagcacuuugggacguugagucgggaggauugcuugaggucgggaauucaagaccgaucuggccaacauagcgagacccugucucuaaaagaaaaaaaaaaaagaaagaaaaugagguauaaugagguaguaagugguggauaugaauauuauacauucugaguccagaguuagugccauauugccuccaaaacagauguuugacccugcuuagccuuugugaauaauacaguuucauuugauuaguuuuguucaagagccgcuccagaguguuuguucuucaguaauguuuauuggguucagaccuauuauuuguagguuagaaacagauauucaguuaggaaagacuucuuucaagacuugaagauuaucacagucugaauuauuagauaguccaguuguguuuugcacaucaguaaaauuaaagcaauguagagaggagaguuaugacauaacauugccaaguuucuguuuugccagaugagaagacaauuuuacaaguauaauacugucauuauaaauaaaauuaugaugacauaauaaaagauuuugacacauggaagaaggauauaacaaugaaaggauaguugguugccuucaaaauggugggugaacaacuuugucauucuccacuguuguugcuuccugccuaugugaaaaugccccucaugcuccuggacacuagugcuuguuccacauuuggagccacuguccuacugaaugcugcuaagugcuuaguguuucacaaaagcuugagaaagaaaaaacuccaugauucuuuuguauuuucaaccuauuuuaugaaaguucuaaaauuccuuacuuagagccuuucuguauagacuguagcuaacaaaauucaucauucucauuugggcuuuuucaggacuguuguuacuucuuaccuacaacuuuuguagcacucuuacucuaggcucuuuacaauuguauuuuuuuucucuugcaacuaaauacauggaaaaaccugugaacagggaagucaaaaggcugauaaucggaacaguuaagcagcauuuuuuuuuuuuuaaccuaagacugcuggauuugguuuggauuguguuggcaaguggaguaauauagagaaggaagauugauuucugauucccacuuaaccaauuacccugaauaacuauucuguggacucuuauagucagugugguuuaguguagagaacgcaggauaaggggauauggccuucaggcucuagcacuguugguuacauagcugugucauuuugggcaaaccacucaaucccauuggccuggcauccuuagauuaaaacaaagaaagugaaaaaagagggaauuaugauaauaagauuucuuaaagcucuacagacuuauguaaacaaacauauuuccacuuccuacaaaggauacaaguuuccuauaugauuucuuuuauuucuguauaguuugaugucugcucguaugguuuaaaaaauuauacuauuguuaccugauauuuaagucucaucagcugaucccaauagaaagugagguggaagguugggaagguuugcuucuauugcugugugugggcuguaaaauauuugcccauuuauaaauuauuuggaggaaaaauaguaccuauuaaaaaaugauaggcagcuucacugaucaucagaauucauucuacucauuggguuguagcacuuaaaaguauguauuuucuguugccaugauaaaaaauaguauaguucauacugaggaguuaagauaaaggcuauaacuaacaaacauuaaaugaagauggcauuacuauguauuuguucaugucugguguaaauacuuuaagacuauauugaaagucuuauaaugauuucuccugcccuccacaauuagggcaaacacuauugaguucuaacccuguuauauaagcucagagauucuauuuuaauuucucaguugcagaaguaucuauuaauuuccgcaauaauuccaugcuuaaaaauuuacgauuaggauacucaucacuuucuucuuagauuacagaaguaaaaacaaaguggcuuauucuuuuggcauuuguuuuuuuaugcucauuuuggguuuuugaaauuccuuccaaaagaaaaagacuuuuuuuuuccucaagccacugaauuuuuuuuccuaaggccuuuauccucuacugauauauuguaauagaaaauuaguauacauuuaauaaaacaguuaagaaaauuuccaguaauacauucaauauggcuguuauugcauuuuuaagauuuaagggaaaagaauauagaaaccuuacuauccuacacuauagauaaugucuuuguuuuaaaaaucuguuggaaguaaucuagcucuguugcuauuugccagucaguuucuuucccuguuucccauaaggaaagaagaauggauauuauugcauguacucaccaguucuuuugcugggucagccuuuaugccaagguaggucuuaaggaaauuuacagagucugccuuuuugaucagauaauuuuaaucuacaagucuaguuuguagguucucuucuuggacugg

SEQ ID NO: 12791 - RNA, 6203 nt, Homo sapiens
gccgagucgcgccgcggccgggcgcggccccuuuauucgcuucaggaggcagaaaacuuucucagcgcgacgaccacgagcgccagcaccacgcagguggccagcagggcggcgaucacgauggccgcgauagcgccgggccccagcgacccugcggaggacggaggaccaugucaccugcuagcccccgccuggccggcccuucuccccgcgccccccgccccccgccccuccuaauuucucccucuccccucccucccccgccccgcccguaccgccgcccugguccagccgcuccugcgcggugcuguccucggguccuggcgcgacggugggggcugggggaccgguguccacgggcucccggccggggcuggugcucuccacggggccuucucccgacggcagcucggccggcucguuccacagcgugggcacgggcuccuguggaacaucgucugcaaagccaaggagaggugcuggggccccaggugacggggccgacagggacgucaccccccaccucuagguuaagcaaguugccgguagcgcugugugaggggucugggcucagcgcugcacuagcccucacauuucccaggcuaagaagcugaagccagugcguugcugccucccauugggcagggccggugggugggcaggaggagugucuguucaguguaagggaggugccccccacaaagcccuucucugcuuauaggguugggaguuggcaggauuugggguacccagggaccagagagcagaaaggagacauucucagucccacagaaagcacaggcugagacgccugcaugauaacccccgcccuguauccucaccagccagcccaccccaguuguccuccccugaccaccacuccaacccugggccauccauccccggcaaccagacaggaugccccagaaacgcuggaaagcucaacauggggaugguaggucggcucuuggccucuccagcccagccagaccaucugacaucacaguguuagcagggcaggccugcccauguccuaaucucucucucucucuuuuugaaacagagucuugcucugugcccaggcuggagugaagugguacaaucucggcucacugcagccuccgccucccggguucaagcaagcgauucuccugccucagccugcggaguagcugggacuacaggcaccugccacuacacccagcuaauuuuuguauuuuuaguugagacgggguuugccauguuggccaggcugauuuugaacuccugaccucaggugauacacccgugucggccucccaaagugcugcgauuacaggugugagccacugcggccggccccaugcucuaaucucaacugggauagagacugugauccagggacacucgacccucaagccgguucccuggaugagcuuggggaugucccaacaccucaucucuuugacuccagcuacucuguggugugggaacugcuuuuauccccauuucagagacaagaaagccaaggcuuggggauaaggugccgugguggugagcacaggugggcugaaggccuuggacaguugcaggagcgguugugcugcccagaaacagugcagggaggcugccguucugugaacagacccugccggccagccggcgacccuagggcaccuuuugucccugcggguuccaucccugagcgcuggggcaagagucaagccagacacuugcccuccucauagguucaccagcacccagagaggcggaugcucgagaagacacagagguccuuccaggguuuucuggccaguuguguccaucuagggcaaaccacgcagaaacaucagccaacccagacucagggucagucuuaaaguaaaugggccuucccaaaugucaaaguuaggaaaaacaaagaaaggccgaaagguuccagaucagagacuaaggagacagcucaauguuccuggacggggagggacaggccugugaucggagacucagguccguuggugaaguuugaacaggguguggcuuaggacugccucagugcucacuuccugguuuugauagcugacucugguguguuaagagaauguccuuguucuuaggaagaauuuaggggcaaaggaacaugacuucugcaacuuacucucaaaugauuucagcauucagauagaggauucagcaauguagcaaaauguuggcaguuggcaagacuagguggauggacuccuggaguucauuggaguauuugugcaacuuuucuguaaacuucacaucuuuccacaauaaaauguuagcaggucccuggcuucugggccucucucaagccuggagaggucaguugcaaggcucagcucugagacagcuugcugaccuuucaccugaccugccacauuccccagggcuggcccaaggcagaaccccuuuccagaaaagaccucuggcaggaggccccauggguggaaggcccauuggcccccaacugggggaggcuucccucccgaggggcccaaggcugcacuguagcacugaugucucucuagccucccgcaaaccuugaagaccacccugagaggaggggaagugacccagccaggccucccaugucgcagccagaaaggcaggggucugcagccuugcaguccccauggaaggccccaggccccuggcgugcugccucaggcuucugggggcugggcagguaaaaggccugagugcgcccaccgccuggcaggcaccagggucuaggcucacugacugccugaacauguccaaagaaauggacaaaugacacacccaagacagacuggcagguaggcaccucccugcaucuggaggccgcggcagggcuucuggguaccaggcccagcugagccggguggcaucugcgggaaucagccgaggaguggcaggccuccagccccugagaaggcagggcucaguacccaggccagcccagcaggggugagcugccacccuugacgguacccucugagcagggcaguggggagccccacucaggcccuguccccaucugucccccgugacccagccugucucugcugcgcccaccaccagacauaccugcccuggccuccucccacuguacacagcccccuccuguccagccaggccaugaagcuuucuaaucaggagggcuggggccuauccuugcuccaugccccaauccaccuuccugaccuguaagacggggguucagacuaugcugucaagcaucuugcacaaggagguaacugugugaacaccagcaucuucagcugcugcgucuggccuggggugcgccuuuggacacaagcccaguugcuaugggucugcagccgcuggcugccacaggaaucccucacaggcuggcccaguacccaucugcacccaagcggccagggccccaggagccaccagcucccugccaaccuaggcuggugcccaaguggcagacacauaggcucggaaugacagccugcacucagccaccgauccaccaggaaaaggggugccgcugccagggaggggccgaggcacuucuuauccucaucuauguuucuagaauuuacuccaguaagaagggaaagcaaagcugagaggcaauucccaucuucccccaaauccauccuucugggaagcugggagcagagcaguuucccagcaggaguccugucuggggaggggggagauggggcaggagcgaagguguggaggacggaacucacggcgugccaggcggacagugaauaggccagggugacagaaagugagguuggcaaagaggugggggcacggaggaccccaagaaaguuccauggcgguaaugaggcccagacuccacugaccagaauuagccaugugguguggcuacgcgcucugacccagggaagcaggggcugguggcacugccacaagccugggcaccacgggcucucucccagccccacuggccccagccgcccugccuuuugguaaauaaguguguucugaccacagggcccugaggccaggcgccucugcucacagacagccuuugugugggccaugaagggccuuuucaucccugcccuggccuccugcccgcucagcccggccugcucccaccucaguagcugaggccacaggcccccaacagggagggccugugccucagauggggccugggccucagcccacaaggccgcuccuucccuuccugucugcuacaggaccccagcccacagagcccagggccguguacacaccuguccagagcucccagcccagggguggggucaaacgcucucgcaagaacaacagccagaaccccagagacuccgggguugggaaggccuggucuggccccugcggggggccugccuacucuugguaggacacauggagggaaguggggcagugaggccaggugagguccuggcuguccccaaggcauccugugguggcagaggaagcccacccgccuacaaugauuagggacagucuggccugggaacucuggccggcagccugggccaggagggucagccacacaggaguaggaaccugggcaggagccacaggcagcccaggcccagcaggcaggagccagggccuccccuucggcccacacggaccaccaggcuggagaagcagcuucuucccagugagggggcugcaaagaucacagccccaggauccaagccauggaagaugccaccuuccccuuuaagucccuuccccccauccugggaacaccgcauggcucgccuaggcuggcgccucuuccaccacaagggaggcuggcgcccucccagcuugcgggaggaaguagaguucuguugagaccacccugugccagggaggggcucggaccacagaauccacauucgcgcuaacuggauguggggcccaucccaaaagcuccgcacgucugaacucacgaggccucacagaccccugcaagugaggcagagcguggcugugucaccauccuacagaugacgagaaggcacagagagguuaagaaaccgcccggucaagacugagcacacccuggccucaagcuucuuccugggcguccagggagaagccaauagucuccggugcuccucgcugucacccagaccucccaggguguggccgagggggccuccccaggccugucgucccccagaagcucuccccaggccaugcucucaugacugcgguccaccuuucucacagauccacgggcgcccuccagaagacccaggcugcagggucccugaaccccgcuacugugacacagaagccagcugcccuuugguccaacucccggccaaaaggagcaaagaccaccuguaacccgucugcgcccuuugucucucaggcucugaagccagccugggccagucuuccccucuccacagggcccuugggagccugccagaggccucccucucgugggaccccagacuccgccacucugaucucaguccagagguccacaccguuuugcagagggaucuugggccuuguauucucucccucucuggagccuuuucccagauggggacaguaccuggguccucauucucuaaggacgucgcagaaaccagcagggaagcuuuucaaaguaaucagcaaggcucugcacuccucuggccccucagcugcuuguccugugccuggugccccagcugccucccagaccugggagacuucagauuuuaaagugcuagagcaauacccaugucccccucaacagcaaaacaucccugggccugccccccaaguuguccuccuucuccagaggccauuaucccuccugcuaacaauuuccugagacguccaucccacacagcugcugccagccggccucacaagagcucuucgcagaaucaccccaaauagucaucccaucuccugugagagggcuuccuccccagugaacguugaagaaucuggccccaagguaguuaucggcccugggaggcuagugguggcugagacaagggccuucaccucuuaccugugagcaccgcaggggccagaaccccggagaccagcagcagcgccaugcgcagggccagacaggaugccauccuggccgggagugagggcagcggcgggcgggacgcacggaggacugcgcugguuaacuucagggcagugagaaagaggcaucaaagggcugggaaggguuuucaucaaugcaaacucuguccuccugggacaucgugcccgcaccu

SEQ ID NO: 12792 - RNA, 2515 nt, Homo sapiens
aagggaaggucccgggaagggaggaccuucuggaacuguguguaucaaucuguguaugugugugucucuaaggauacaaauuuauuauaguaaaaauucuguuuuacuaaauguauccuggauuggauccuagaacagggggaagaaaaggacauuaguggaaaaacuggugaaaucagaauaaagucuagaguuuaguaaauaaccauguaccaauguuaaucucuucguuuuaacaaauguaccacaguuauguaagaugucaacgucaggggaaacuggguguggaguauacaggaacguucuguacuaucuuugcaacuucuauguaaaucuaaaauuguucugaaauaaagcauuuauuuaaaaauucaguuucagcagggcaugguggcucauaccuguaauugcagcacuuugggaggcugagggaggagaaugacuugagcucgggaguuugaggcuagccugggcugcauaguaagaccccaucucuacaauuuuuuuuuuuaaauuagugaggcauggugguacgugcuuguagucccagcuacuugggaggcugaggcgagaucguuugagcccaguagggggaggcuucagugagcugugauugugccacugcacuccaaccuaggcaacagagcaagaccuggucuccaaaaaaaaaaaaaaaaaaaaaaaaaaaggccaggcgcaguggcucaugccuauaaucccagcacuuugggaggucaaggcgagugggucaccugaggucaggaguucgagaccagccuggccaacauggugaaaccccgucuccacuaaaaauacaaaaauuagucagguggugcacaacuguaauccuagcuacuugggagacucagguagcagaauugcuagaacugccuccaggaggcggagguuacagugagacgagaucgugccagagucagacuccaucucaaaaaaaaaaaaaaaucaauuuuaaacccaauauugaaauucaguugaaacccaauuucaguuuuaaaacccaacauacaauauugcuuugggaguuaaucuagcaaaucugcucuuuuguucaauuuuuauuuuuuauugagguguaacauauaugcaguagggcacacaaaucuuuuguuuuguuuuguuuugcuuuguuuuuguuuuuagacagagucucgcucuguugcccaggcuggagugcaauggcgcgaucucggcucacugcaaucucugccugcuggguucaagugauucuccugccucagccuccugacuagcugggauuacaggcgcacgcuaccaggccuggcuaauuuuuguauuuuuaguagagacaggguuucaccauguuggucaggcuggucucaaacuccugaccucgugauccaccuaccucggccucccaaagugcugggauuacagguguaagccaccgagcccggcggcacacaaaucuuuuguguauagcacaucaaauuuuuacacacgaaaucauccacauaaccagccccagaucaagcaauagaacacccagcagccucccucuugcugugucccagucaacagcuccccuccaccaggagcagccacuauccugacugauagaccauaguuuaguuuugucuguccuugaacuucauauaaauagaauaauaagguguguacucauucgagucugauauccuucacucgucaugaugucugaaaaccauccaugcuaguguggagagcaguaguccacucuuucacuguuguguauuauaauauuccacuucaugaauaugcccuucuuuuuuuuccuuuuuuuuuuuuuuuuuuuuuuuuugagacggaauuucacucuuguugcccaggcuggagugcaauggcgcaaucucagcucacugcaaacuccaccucccagguucaagcaauucuccugccucagccucccuaguggcugggauuacaggcaccugccaccacgccuggcuaauuuuuuguauuuuuuaguagaggugggguuucaccauguuggccaggcuggucucgaacuccugaccucaggugauccaccggccucagccucccaaauugcugggauuacaggcgugagccaccaagcccagccccuaauuuacuuauuuauuuuacuuucuauugacauuuggguuguuuccaguuuaggacucuugugaaugaagcugcuguaaacaaucuucuaugugucuucggcagcuaugaacauucauuucucuuggauaugugcuccagaguagaacugcugggucauggaguauuuacauguuuuguuuugguggauuccaccaaaucgcuugccaaagugguugugucaguuacuuucugccagaaagauacuagaguuccaguggcuccacauccuuguugauauuugcuguuguuaaucuuuuaaaugugggcauucuaggagauaagucucucacaguuuuauuuugcauuccucugaugacuaaugauguugagcaauuuaggagccuuuagaauauucuccuuugugaag

SEQ ID NO: 12793 - RNA, 1142 nt, Homo sapiens
ggcucccacggugaagggaacggcugaaccuaauccgccccggaggaaaagcgcacugcagcaggaggagaaaguccgugccaaccggaucugccagagcugccccagggacccagccugcucgcagccaccuguccagccaccugccugaggaagcaguguucuaaccgggcgggcucaccuggagcaaaaaccguaagcuguuuucaauaggaagcacaaugggaaaacaaacggugcaacuuuccuccugcaaaaaggacgugcgucuuuaucuaacauuuagcgucaggaguucuccguggagaguugggugccaagcgggugcgcggucccggcuuugcugagagagacggucacugaacgcgcaucccuuccuucccuuuugggaugaaggggugaaggggugaucccucgcacccggguccgagcggacuucugagggcaccacagggaagucugcagggcacucgcgggacaccacccgaccgcuccugagaaacgugcagaaccgggguuuggggaccgcggacgcccgcggggcgcagccgggagcccccgcgugggacccgcucgguggcacgagcgcaguccccugcaucuaggccucaguuuccuccggguccucgcggcccaacucggcgcgcgccccccgcccagcgcgcggcgcccggggcgcccaccugcgcgccccccgcccggccccacagccgcccgccguccgucgggggccgcgcgcuccgcccggggcgccggcccguuacagcggcggggcacgcucgacaggggcggugacgcccgcgggaccccgggccgggccgagccgggccugggcggccgcucgggcagggccacgggccucggccggggcugccgcggcgugaggggcgcgcgcccgggccgccgcgccgcgggcucaccuucugucggaucugacccgacguggacaccuugcggaugagcuucuguggggagccgggcuccgccucgggcucgcugucggacgacuccucgggcggcggcggcggaggcgguugcgggggacccggcggaggggcgcccgccgccgccgccaugcugccgggccagcgcgcgcaccgcgggcgggggcggggcggggccggcgggaggggcggggccga

SEQ ID NO: 12794 - RNA, 1088 nt, Homo sapiens
ugagauguggcugcgucauaaggggcggcccuccaggcggcccaggucgccaagccucugaccugugcgcgggugcuggcagccuugccgcucgcugugccagugccccgcaggcucuuuggcaguccagcauaguggacuacuacgaggugcugggaguaccccgguaggccucguccgaggguaucaagaaggcguaccgcaagcuggcgcucaaguggcaccccgacaaaaaccccgaggacagggaggaagcggugagaagauucaagcagguggcugaggccuacgagguguugucggacgcguagaaacgcgauaucuaugaccgcuauggcgaggcgagggcggagggcggcugcgcaggcggcaggcccuucaaggaccccuucgaguaggucuucagcuuccgugaccccgccgaggucuucagggaguucuuuggcggccgggacccauucuccuuugaccucuugggaaacccgcuggagaauauuuuggggggucagaggaacucccugggaagcagaagcagagggucugcaccccuuuucucugccuucagugaauuuccagcuuuugagggugguuuuucuucuuuugauacaggauuucguuccuuuggcucccugggaagugggggccuuucuuccuucugcauguccuacgguagugaugggacaggcagcuucaaguccaugucgacuuccacugaaauaguugaugguaaaaaaaucaccaccaagagaaucauugagaauggccaagaaaggguggaaguggaggaagauggagaguugaguuaaaguccuucauaauaaacggcauagagcaguugcuccccauugacaccaaguaauuccaguccacauuugccuuuaagcacaucuggaggaauagcggacuuuuuuuaggauugaaagugaacuuuacuuucagaacagcuguacccaagaauuuauaaacacuuuaugccaaugccugucuuuauuguugggacugcacggauaggaccucuguuugucuuucgaucauuguaaauaucuguaugcaauuugcuauuuauuaaacuuaagccugaggcagac

SEQ ID NO: 12795 - RNA, 12418 nt, Homo sapiens
gaaccucuggcaggagcaaaggcgccauggcuguggagucccagggcggacgcccacuuguccugggccugcugcugugugugcugggcccaguggugucccaugcugggaagauacuguugaucccaguggauggcagccacuggcugagcaugcuuggggccauccagcagcugcagcagaggggacaugaaauaguuguccuagcaccugacgccucguuguacaucagagacggagcauuuuacaccuugaagacguacccugugccauuccaaagggaggaugugaaagagucuuuuguuagucucgggcauaauguuuuugagaaugauucuuuccugcagcgugugaucaaaacauacaagaaaauaaaaaaggacucugcuaugcuuuugucuggcuguucccacuuacugcacaacaaggagcucauggccucccuggcagaaagcagcuuugaugucaugcugacggacccuuuccuuccuugcagccccaucguggcccaguaccugucucugcccacuguauucuucuugcaugcacugccaugcagccuggaauuugaggcuacccagugccccaacccauucuccuacgugcccaggccucucuccucucauucagaucacaugaccuuccugcagcgggugaagaacaugcucauugccuuuucacagaacuuucugugcgacgugguuuauuccccguaugcaacccuugccucagaauuccuucagagagaggugacuguccaggaccuauugagcucugcaucugucuggcuguuuagaagugacuuugugaaggauuacccuaggcccaucaugcccaauaugguuuuuguugguggaaucaacugccuucaccaaaauccacuaucccagguguguauuggagugggacuuuuacaugcguauauucuuucagauguauuacuuuggaucgauuaacuagccccagauauaugcugagcaagcauucugagauaauuuaaaaugcccucuuuuguuaauuuuugacuccuagguuugagucugucuuuggcaucaucuucuggaugauuucuugguaucugagauuucgggaaagcauuccuuggacauuuuacucugugugcuccaguggauaguaaucaauuagaaacaacaagcuguuaaaugccauaggcacagaaugcuggguuuggggcacccugcagaaaacucaguugaagccugcaccuugcccuggauucagucaggcaggcaauguucaggacugaugaaaucauucuuugaugaugauagauccuggaaaugaaaguugccuuugugacccugguuaaagcuccaguuucuaaauauucugauaagaagcuaaauccugcaguccguucucuucuaaugagugaaucaccagacagucagguucugacaugauacagaaagguuguagguuucauucucaagcuauuagguuuauuuuuccccuacagaguuugaaguaugcaaaaaguagcauucacauccucaucgaaaucucagcagaggauagaaaagaacaggagaggcuccuucagauggagcguuagggaauuacucuuugaggaggugacauuucagagagcguucauucacuuauccugcaaagauuggcugaggaucuacuggcagcccaggcacuucccaggugcugcgucuggcucccauuaaggggacugauaucaccuucggaggugaccuuauuuccacuauaccuccaaugugauuuguauuuuauuuuuuuuaauuuucugugcauuuuccuucauagcacaucaaauauggcagccauuucacuuagauaguuguugauuguccgcuucacaucaugagccauguggggaccugugugacuuugcauuaaucacauccacuguaugcggcguccucaacaccugccaaugggucugcauguauuuggcgccccauaaaucucagcaccuaaggcacagaauaggcacccaccgaauauguguuacauuaaugaaugagaagaaaggugccaaccgaggucuaguuaaugggucgagaguaauccacaauagcucuuuuuaguucuuuguacuccagcuauuacauaccaauauguauauagaaacauauguaaaauuuuuugguugcuuuuucuacaaaauagaguaacaguguauucccacugcccacuuaccgauaaugucauggauaucacuccaguuuuaaaugcuauuacuuuuuaaacuaugaaauaguauuucaugguacuuguguaccacaguguauucugcuggagaucuagucuaguuccccacagaggaacauuacaauuuguauuccaggaguuuuguuguugugaccucaaacacuuccuuuaaaaagauaagcuauuuuguaguuuaaaaaacauuuguucuguuucuuucucauucaucuuuucuuaaguauuuuacacgguuuuuuuuuuuuggucacuacugugaauguguuauuuuuuugcauuucuaucucuagcugauuaucuacucauuacucagcuaucucaucaaaauauugauuuucauaauaaaaaauaauaggcagucauuugcugauaaagaaauuuugguuucuucucuuauaaauuccaugccaaauaucagggcuauugaauuuauuagaaucucuaaaaacaguugaauaauucuggcaauaggaaagaugcccgucuugcugcuauuuuaguggaaauugauuaucauuucauuauuuugcauuauguuagccauuguuuucugaacaggcuuuauugauuuagauaauuuccuucuuugcgugaggauguuuguaggagaggcaccgaacuuuaucagcugccuuucuggcauuuauugauauaaccauaaaagucuaaguggugaacuguguugacuacauauuuguuguugccuuguuuggugcagucaggcuuaggugugaaaauauguuuuuaaauuguaccuuuuaguaaccuguuuugucuuguugcauguuuuaaucugaaauuccacuuuuuggauauuaauauuaccacuucuguauuauuuuuguuuacauuucccuagcacaucuuuaguacuccuuugucuucaagcuuucuuccuuuuuaaacaacauggcacugguauuuuuaauccagucaggcaguugcuuuaauaagugcauuuugccuauuugaaucuaacaauuaauagauuugauuguaacucucucaguuuacuuuauguuuaguugacuuugccauucuccuuuuuccggauuucuacugguuggucaaguuacuguucuuauuuucucuuucuuccuuuguuaacuaaaaaugccacucugcacuaccauuccucuuguguugaugguccuauucucaauacucuugauaaaacuccugaacuuuaagaauaaagauaaaacuuuuauugcacaaagaaguccauagagaaagcacaaccuggcauuggcgugucuuuggugugucugaaggaaaagagauaguggaacaacauugggagaaaaggaaugaaacucaagaauuccaagauguuccuccccugccaggguaagauagcagugguucacagacaaucgcaaugcugggucugagaaaaauaacuaaacagaagauuagugaggaccaaggcuucgagauggccaggagaggaaagcuugggagcagggaagguugagauauauguggguuacugggaaugcgugauggugaagucacagaugacccacauggugucuaagugcuaaagaagaauucugggaaaaugaaaugcauuugggaagggaaaaucuaauuaaaagccuaaacuaaaaauacaaaauucuugguaaaguuuaggaguuauguuaaaugucucauuuuggcuggugaagucucaucagaacagggaaauucucucauucaggggcaucucaucuuuucuuugaagggaaucaauggugggggauuggaguguuauuuucaguuaauauguugcuucacucuuuggucauuccgguaacugugaagucagggugaaguuuaagggaagcuuugccaaguaggggauggacuucaccuuuauugagccucauaguagcuggcucagguaggaguuggccgugaugacaacuucucugcaguuugcccugcgugaaucuccagaugaacuuuugugccauuuaaacuuucgugaucuccugcuauuuaacuucgaauguuuauggaccuguggguucaauuuugugugaaucacauccugcugauugcugagugggcgugugggagggugugccuggaggagaacuuagacucggccuuuuccagaugagcuucaguguaagaguggguuucaugaagagcaaagguccuaggaaauuuaaguaagccauuuaccaacgcucagaagaaagaacuugaagagcacuuggaaaugagcugugucuccccaagaaagagggagagaaagaggggagagauguggugcagacccuagggaggaaggaguucagaaaaaccauccucaggguguucuugcuacaaaccaaaaaaugcagcauggugguggggaggaugacucuguccucccugacuuuuagaugagcccaagggaaaaggcaaagacaaagcccuuaagagccagaggacucacgagggccuggggcuggugagaguggcggggagagagggcucaccuugggagaaggauggucagugucuggggcuuuccuggucauguuccaaaucaggcuuggcaggaguccugcugugcaaauugcguuugcugagcccugucagaggucuccugugucucacaucuagggugaccagcauccuggcuuccucaggacuguucagguuuuagcacugaacaucacauguccuagggaaccccucaguuugggcaagcccugccacaucacacaaucauauuagugcccucaguauucuuugcaaacauaaaaccauagacucaguaaucccauuacuggguauauacccaaagaaauauaaauuauucuacuauaaagacacaugcacauauuuguuuauugcagcacuauucacaauaacaaagucauggaaccaacccagaugcccaucaaugguagauuggauaaagaaaaugugguacauauacaccauggaauacuaugcagccauaacaaggaaugagaucauauucuuugcaaggacauggaugaagcuggaagccaucauccuccacaaacuaacacaggaacagaaaaucaaacaccgcauguucucacucauaagugggaguugaacagugagaaugcguagacgcagggaggggaacaacacacaccagggcuuguggcggggugaggggugaggggaggaacuuagaggauaggucaauaggugcagcaaaccaccauggcauauguaucccagaacuucaaguaaauaauaauaauaauaauuaauaauaauaauaauaauaaauaaacccauaaagccauuugagagauucuugggggauucauuggaccacugaaaaucuacagugagaaaagaauugccauguugaugaaacaggaaaacuuuccuugucccccucacagagcaugugacagcgggaggggcucacuuucucagugcgccacugcucaaaccucuaggggagcauacagacgggcagguuguggggcucugaccucaccggcagugucuagagguggauguuuacagcuccugaagcuccagugggcguggguuauggccuucuuuuaguuuugcccucuauagucagcuuguguuaaccagcucaauuacacccucuaccuugucgcaaggacagagggcuuucuguauccugggggcuugccuugguguaccagaagaaucgaaucccaccugggcuuggagaaugagugcaaggauuuauugaguggauguagcucucagcagaugggggaagccagaaggggauggaaugggaaggguuuccccuggagucagaccgcucaguggcccgggcucgguggcccgggcucgguggccugggcucuccuccgacugccucagccaaacuccgcguuguucugcuggucaguggccugccggugccuguuggugaguucuucucaauguccagcuguccuugcgucccuccgcugaugugcuccucccgauguccagcuaccugugugucugccugcuagggucuugggguuuuuauaggcacaugaugggggcguggcaggccagggugguuuugggaaaugaaacauuuaggcaggaaaacaaaaaugccuguccucaccuagguccaugggcacaggucuggggguggagcccucgccagggaccacacccucuucuacccagcacuucccuucccuacuuccauaucauuuaaagggaccacgcccuucccagcucuucccuucuguaucacugaugccuugcucuguguucucuaaguggaauuaucacuguguguauguacaggugugugcaugugugugcauguaccugugcuuuucuuuuggaaaacuagcacauuaccuggauuuugcaucucaaggauaauucuguaagcaggaacccuuccuccuuuagaaggaaguaaaggagaggaaaaugcuguaaaacuuacauauuaauaauuuuuuacucuaucucaaacacgcaugccuuuaaucauagucuuaagaggaagauaucuaauucauaacuuacuguauguagucaucaaagaauaugagaaaaaauuaacugaaaauuuuucuucuggcucuaggaauuugaagccuacauuaaugcuucuggagaacauggaauugugguuuucucuuugggaucaauggucucagaaauuccagagaagaaagcuauggcaauugcugaugcuuugggcaaaaucccucagacaguaagaagauucuauaccauggccucauaucuauuuucacaggagcgcuaaucccagacuuccagcuuccagauuaauucucuuaauuggaaccuuagauuuggcuuuucccugccacuucccaacuauuaauccaaagguuuuuuuuguuguugugguuguugucauuguuuucaauuugacucucaaauacucuauuaaacuaugauccaccacacucagaaguaucauuuucucuaagagacucaaaaguguauuagggagaauuuauuuaaaaauaaaauaaaugggauauuguuucuucauauuaaauagaaguauuucuccaaaaagcuguugguuagaacacugaauuuaugucuuacauuucugcucuuauaguucugcauccacuuguuucauuaagcaaacuuucccuuaaagugcaggaaagugaaaaaauccuaagugcacagcuugauaaauuaucacaaauucacguagugcauacacccuuguaacuaaaccuccaaaacaagaugccggaaguugccaguccucagaagccuucacaguuacugauccucccacucuguuaaagacuguuccuucagaggaccccuguuuucuaguuaguauagcagauuuguuuucuaaucauauuauguucuuucuuuacguucugcucuuuuugccccucccagguccuguggcgguacacuggaacccgaccaucgaaucuugcgaacaacacgauacuuguuaaguggcuaccccaaaacgaucugcuugguauguugggcggauuggauguauaggucaaaccagggucaaauuaagaaaauggcuuaagcacagcuauucuaaaggauuguugagcuugaaaauauuauggccaacauauccuacauugcuuuuuaucuagugggguaucucaacccacauuuucuucugcaaauuucugcaagggcaugugaguaacacugagucuuuggaguguuuucagaaccuagauguguccagcugugaaacucagagauguaacugcugacauccucccuauuuugcaucucaggucacccgaugacccgugccuuuaucacccaugcugguucccaugguguuuaugaaagcauaugcaauggcguucccauggugaugaugcccuuguuuggugaucagauggacaaugcaaagcgcauggagacuaagggagcuggagugacccugaauguucuggaaaugacuucugaagauuuagaaaaugcucuaaaagcagucaucaaugacaaaagguaagaaagaagauacagaagaauacuuuggucauggcauucaugauaaaauuguuucaaauaugaaaacauuuacguagcauuuaauagcguuguuucaaauauaaaaacaaauacauaaaaaucuggauuuuuauuucuucuuuuuuuuuuuuuuuuuuuuuugagauggagucuugcucugucaccuaggcuggagugcaguggugcaaucuuggcuuacugcaaccuccaccucccacguucaagcaguucugccucagccuccguguagcugggauuacagguguccaccaccacgcccgguuaauuuuuguauuuuuuaguagagaaaggguuucaccauguuugucaggcuggucuugaacuccugacuucaggugauccaccugccucggccugccaaagugcugagauuacaggcaugagccagcgcgucugaccuggauuuauaaauaagauaauuuagagguuauuauucacuuuauaaaaggauucuuuaguuucuauauaauuuaucauauaauuuauuuagaauuuuauuucccccauuagauuuaaaacuccaauuuacauaaaaaguugccauaauagacaucugauccauaaguuuccugcacagaaagaaauacuccauuauaagaagcauaguaucuuuaagagaaaaacaacucaaaugcuuagaaguacagcuuuuugcagcacuggaaccugugagaaauuuuguccauggaguuuaugaaugaaggagcuauaagauaucacagacaaagucuuagaauaagagcaaaggaaaauuugcucaaauguggcccugaaaacgauucaaagggcaaaugauuucuggauuaaaguuaguauauuacugucaagcucacugguaauaggcuuauuagaaccuuaugggaagaagugguggccagugguagauuucauccgacaauagauacugugugcauaugugcgugugcguuugugcauguggcugugcucaugugugggugcacacgugugcauucauaugcgugugugugugugugcguguguuuaugagaguguccauugcuuucucccaugguuaccuccuuuagaaagaagcagcagucaggaagacagaugugaagagcuggagcauguucagaugagaggagacggaacacggggacacaccagcuugagcaagggacaacaggggaggacugaugacugacuucccaccuuugaggugcuaaugugugugugguggcacuggauaaaagaucaauguuggcuaggcaccauggcacacgccuguagucccagccacucuggaggcuaaggcgggaggauugcuugagcccagaaguuggaggcugcuaugagccgugaucaugccacugcacuccagcaaccugggcaacagagugagacccugucucaaaaaaaaaaaaaaaaaugaaaaguccacauaaccugagcaucaugugcccagagcguugggugguguggucccauuccuuccuuccagcggcuucuucuggccaccucaaugucaggauguccugcucacauaucaauaccauuaaaaccugacuucuuucccugcacuguugaagcuccuucuugaggcucacauuauggauauaauuuugauucuuucuucagugguauagauaacuacuuguaaccuaagaacaacuuggugaaaguccucuaauacauuauuuuuuaaaaaaacacaaaucaaugagcucaacuuauuaacuaacuuucaucuauucauuuuugagccaucccugucugauugugaaucuccaugauuccaacacucugagcuggggauagugccuacacaaaauaaaaagaaguggaaaauuuucaaacaucaguuuaugcugacaaccaggccauaauaggugcucaauuacuauugaaugaaugaaugaaaguucuggccagguacgguggcucaugccuguagucccaacacuuugggaggccgaggcagguggaucacuugagguuaggaguucgaaaccaaccugaccaacaugaagaaaccuuaucucuaccaaaaaaauauaaaaaaauuacccaggcauggugguguaugccuguaaucccagcuauuugggaggcugaggcaggaaaaucacuugaaccugagaggcggagguugcagugagcugagauugugccacuccacuccagccugggcgacagagugagacuccgucuuacuuaaaaaaaaaaaaaagaagguuccaagaaaauucaucuuaagguuuauguaaaaggaagaugauauuuaacaugauucauggccaaguacuaauauuacauuauaauaauguuuccaaauaacauuauagauauguuuaaagacaguguauuaggcuguucuugcauugcuguaaagaaauacccaagacuggguaauuuauaaagaaaagagguuucauuggcucguguuucugcaggcuguacaggaagcuuagugcugacaucacuuggcugccgggggaaccucagggagcuuuuacucauggcagaaggcaaugcgggagcuugcaugucacauggcaaaagcaggagcgagagagaguugggggggaaggugccacacacuuuuuaaugaccggcucucacaauaacucaugaaaacucacuaucaggaagacagcacuaaagcacaagggauccgaccccaugauccaaacaccucccaccaggccccaucuccagcacuggggauuacaauucaacaugagaucugaguguggacaaauauccaaacuguaucagucaacagcgaucauaauuaguccugaauaggagugccuuuuuuuuucuuucuucucccuuuucuuuucuacuuccuccuccuuuucccucuccucuucaaucuccucuucauuccuguagcaccaaggguugaagcaccuaacccguuuuggauugagauguucugauugggcaaugaacacuguccagaauaaacagaaauccauuuugcacuaaguggcugcacagacccugccucaugcuaaaucuagcacccagauaguuuaauguuucaaugacugaauuacaaauauaucaucaccuuggauuuggcacuuacaaauggcuguuaauuuggccagaggugguuguuuacaacuucaaauaggagacuauucauaauuucugacgugacauuuuccuuucuuuauuuuacuguaugaaaauauaaugaaauuucucacaaaauaucacuaaaaagaaaagaagaagaguaggaagcaagguuaaaauauuucuaaaauauaauuuuggucuuucuuuuucucccuuccuuccuccgucccucucuccuuuccucucucccucccucccucccucccuuccuccuuuccuugcuuccuucccuccuucucuuccuucuuuuucaagagaucaauaacauuuauuaagaauaaguuucuuaauuauaaccuuucaggugauaauaguaacacagccugggcaacacaauaagaccuuguuucuacaaaaaauuuaaaaauuggccagacauaguggugcaugacuaauuccagcuacucuggaggcugaggcaggaggauggcuugagcccaggaguuggaggcugcaguuagccaugcuugugccacuacacuccagcccgggcaacagggcaagacucuguaucuaaaaacaacaacaacaacaauaauagaaacagguuuccuuucccaaguuuggaaaaucugguagucuucuuaagcagccaugagcauaaagagaggauuguucauaccacagguguuccaggcauaacgaaacugucuuuguguuuaguuacaaggagaacaucaugcgccucuccagccuucacaaggaccgcccgguggagccgcuggaccuggccguguucuggguggaguuugugaugaggcacaagggcgcgccacaccugcgccccgcagcccacgaccucaccugguaccaguaccauuccuuggacgugauugguuuccucuuggccgucgugcugacaguggccuucaucaccuuuaaauguugugcuuauggcuaccggaaaugcuuggggaaaaaagggcgaguuaagaaagcccacaaauccaagacccauugagaagugggugggaaauaagguaaaauuuugaaccauucccuagucauuuccaaacuugaaaacagaaucaguguuaaauucauuuuauucuuauuaaggaaauacuuugcauaaauuaau

SEQ ID NO: 12796 - RNA, 23009 nt, Homo sapiens
ccuauuucagcugucugauguuucuuuuaguaggcacauccagaaaagugcagaggugaaacuaauuuucauguauuuuauuucacucaaauaacuaaaacaugaucauuucaacauguaaucaguauaaaaacuauuauugugauauuuuacaauuuuugggguaccaucuuaaaacccagggggcacuuuaccuuaauucagaccagccacacuugaagugcugcaggguuacacauggcuuguggcuaccauguuggacagcacagguucucuggucagaugggauaugaaaaauauaacugguggccagugguccuucacuugccagcuacucaccugcugugugacgcugggaugggcgcuugcccucucugaugcaucuuggugaugggaacacgcuugaugaaugacagcccauugucagggucucauccuccaaagcuguguguaucacuuacuuuuugcagacucggaaaaagccggcuguucucuaccgcuucuugcuagaaacaauggccuauguuaaaaauaacuugucaagaaucagaaucgcugcuugcaacuuggcaggugagcagagagacgucuccugacucaagauagacuuugaaggcccucuaguccaccccggcacucgggggaaggguggaucaugagugggaggcauguggcaagcugagaccagagcucaggucuaagcccugcacugugcuuucuaucccguuuugauuuuggcuuccucccugccaacgugggcucaacaaaaucuuucaucaaugcucucauaacguaaaguaaguaaaccacaggacgacuugccugcugaccuaauacucgcgugaugagcauuucuuuggcuauuguuuuaggaauuauuaugaagcagaugucuacacauuaucugaaaaagcuggacuucccagcauuacggaauugugaguaguggagaguguuagauguugaguccacgacucaccaacucacuaggggagcuuagagaaacugcuucaagggaagagccagaggacccuuugcugugggguuucgggggggugggagugcaaccagggcagagagaugcaccuggggaggccuuuccaggacgacagcuauugauggguggagucccuuucauucccugggcuguuucucccauucauagcuucuuaugaaaugcuuuuggccugaugcugcuaucagguucugugggugauuucugucccuguuagggugguuacugaagcccugagagcuaugauguguguugaaacagcuccaccugcaguccucugcuuucccacacaggaguuuccccgucugccccugcccaccuucugcggcccuugccugccaucacugcccagggcaugcagcaugugguccugacugggcggggccugaaccuucccucuuuguguucucucucagcccuccaggaacuacagcuggacccggaucccggggucaggagggcagcccuggagacgcucacagucuuggauagcuguagucagcauggguuucuggcuucaccccaaggaauguccuaggugguccaaacauaagacguaaacugucuucuuagugccaaaugcaagcccuuuuuaauuuaguuuguaagaaguuuaguuuguaggaaaaacacuauuguaaaauaacuaguauccuuuuguuuccuuccguugaaauaaaccuccacugucguuggaguagacuugugacuguaagguggugacagcccagaaccaagacaaugaggcaaagggaacuuuggccuuaaugagccacuucauuuccgauuuccccccaaguacguuugucugacagcccacuggcccaaagggucggaaacuagcuuugugucuucacucggaguucauccacacgcaugcugacagcgugccuaaggccaggcacugugccaagcggugaggggaggccuagagugucccaucugucuccagggacucuucuuuuuuuuuuuuuuuuuuuuuugagauggagucuugcccugucgcccaggcuggaguguaguggcgcaaucucggcucauugcaaccuccaccuccuggguucaagugauucuccugccucagcccaggugcgcagcaccacgcccagcuaauuuuuguauuuuuaguagagaugggguuucaccauguuggccaggcuggucucaaacuccugaccucgugauccacccaccuuggccuuccaaaguguugggauuacaggcgugagccaccgugccaggccaggacacuucuuaaagggaaaggcaccuaaccacaacacacaucagagggaggacugcagccagggugcaagugcuacaguggcacaggagggugggugugcaagucuggagacaauccagaaaggccgcauggaggaacugacauuuauuccaggcccuucccuuugcgacuuaaaguuaccaaaguuaaguuuggacuguugcaacuggagcccagugaggccuggaacagaauuuggcugcuggucaaaaaggagaaauuagccccaugucuaagaacauguaggggaagagaggggcaguguggggaaggcuuuugcuaugcucaggccaucagaauagucuagguguccccagagcagguaaaccaggacuuccaaacuguucccaguccaacugccaaaggaauucaccauccggggucccaucaacaggagagagcugcuaugcuguccaaaauccaacccgugcuaaagccuucucuggaacaguggucuucaaacuguuuuguggagcaaauggugacuugauuuccugcccagugauaaagaguauugcugcuaaacaagcuugaacaccacugaugcaguggggagagugcaccauucgauagaguacaaggaggcagcuguacaucuguacaauuggcucuccuuccaugccugugcagaaacauuuccagaugguuuauagaccuaaauggagagagcaaaauuuaagacaguacaguauuuuuuuuauccugagaguaugguaguuuuucuuuuaaaaguaacagcagaagccagaaaaaaggaggaaguuaucugccuuaguauguuuagcguugcuaaaacagaauacccaaggcuggguaauuuauacagaaaagguuuguuuagcuccuaauucugguggcuggaaaguccaagagcaugauguuggcaucugcuugguuucuggugagggccuugugcuaucucgagacacaguggaaaagcagaaaggugagugggcaggugcaaaggcaacccgcucucacagagagugagaacucacuccuucaagagggcauucaucuauucaugggguguccacucccaugacccaaaaaccugccacuaggcccccacccccuaacaauuacaugugcaauuaaauuucaagacaaauggcauccgaaccauagcauuguguuaaaauguaacuuccauacaauaaaauaacacaaaguuaaaugacaaaugauagaugauagaaguuaaaaacuggauuguuucauaucauuggauccagaauacauccaaaucaggaagaggcaaauauaaaaccaguguccugaggacauuuaaaaaaccaggacucccaggaagacaugcucaacaagucaucaagagaaagcaaacugugaagcaacacaucuuacaccugccagagcucagacuggcagcaacuggcagcgauaauguggggaaaagguaccucuuauauugugggacauugggcaaacuggggcagccauuugggagagcaauuuggcaauaacuauggaaguucaaggcacacccauccgugaccuguaauuugccucuaggugugugugugccacagauaguugacaguuaugcacaaggaucacggguggauuuugcacccguccgcagacauccaggacaauaaaccaccuagagaacucaaagugagaugcccacaucuaucagcucuugucauauucagucucuugaugaaacaaaacuguagcauauguacaguauuaauuuacucauauaguuugaaacagagagacuauaccauauauaguuuauggggcccuuauuggcagaucuguaaguuggcaagacccaugcccagauccuuccaccucaccuuccuccacuggaugacagaacaccggccuuucuggcagccaggccuggcccgggcagcaagguuucagcugucugcugggugugggggaaggagaggcacaagcaguucuggguugcagugaugguuuuccugaagaggaaagggugggucgcguuguccuuuaggaagcagcaggccugagggaaggcucuagaucuguaggggccauucuggcccuggcugagccugagccagcauuacacugccggccuguucuuugaggaaaugagccgucugugaggucugcagcaccuggcgagguucucggcucucagcagcgugcacccuccuuacugacucacaggcuauggauugaauuaugauuaaguccuagccccuggcaugaugguauuggagauggggcuuucuggaggugauuagguuuagaugaggucaugagugaggggcccuuaugaugggauuagugcccuccuaagauaccagagaccuugcucucuccagcauguggggacacagcaagaagacagcuuucugcaagccaggaagaguccucaccggagcccaaccaugcuggcucccuugucuuaaacuucuagucuucaaaaacugugagaaaauaaacuucuacuguuuaagccaccuggucuccagcauuguuauggcagccugagcaugcaggugcgcacgcacacacacacauaacauggucccaauguaagacgcaggggggaagagauauggggcaggguaugggggugauaccugacaucaggagagcaaucgccuggggcggcaggcgggaaugaaaaauguguaauuuaaucucauuuuaaaucuuucauaaaaaaaaaaaacccaaacucauauggccauauauuaacuauuuacuccagcaugaguuucaccaauguauucugaauaugugaaauauuucauuacaaaaacgucaccaugauauccugucaucaacagcuucaguaagaaucaugaggagucacaggcgcuguggcugcaggagcgucugggaccaccaggacuguuuauuuuccuucaagggucauugcaugcagggcucgaacuuacgucucacaagcaaacaauauucucgaaugaaaugggaaacaggagagaggauucucuggacauaucuaaauuuaaaaaagaacacacggcugggagcaguggcucacgccuauaaucccagcacuuugggaggccgaggcagauggaucacgaggccaggagcucgagaccagccuggucaauauggugaaaccccgucucuacuaaaacuacaaaaauuagccaggcgugguggcgcgcgccuguaaucccagcuacucgggaggcugaggcagaagaaucgcuugaacccgggaggcggaaguugcagugagccaagauugugccaccgcacuccagccugggcgauagagagagacugucucaaaaacaaacaaacaaacaaacaaacaaacaaauaacccccccccaaaaaaaacacacacaucagaaaaacaggccuaucaaagagaacccuaaaaauucuaauugagcaacuuuauucacauaauuucuacaccaagaacucgagguuaucucugauggaaccaauuucacuaauauuuacuuuaagggcagagaagucaaccaaguccucacagucucaagaaucaaaaacaaaacaaaaauacaaacagagagcaagugggaagauaaauaacacuccgaaauaaccuagcuacacacuuuuaguuuccaauuuuucuagcaugaaaucacuuuucucuuccauccuguaagacguguucucuccucuaggaaaaaaaaaagacaaagaaaaugauguuagcaaaauucuagaauucccaaugccagccacuaaaagguuaacuguuuucuacuuauuccauugcauguauaaaaauacuuauagaaaguggcauuacguuaaauaaguaaguuauguuaaagaaacaacaaaaauauaauggcaaccccccgacccugcuccccacacucccccagggagcacaagcugguggggaaguccacaucccacacccuggcccagcuagcgcugcugcacgagugaauuuaggaguucuaagacuuaagcuacuuuuccauaucuauuaaaaggagagacagccugccuauuggacagaaucgaucuaaucaagggguucugguggggaugaaagaagauaagacguaaaaacgguucagcauggccuggcacacagagagcacucagacguuaggcaugaaaacuccauauguaguugcagcucaugaagaauuggucucuuuccucaagaaaucuaucauuuaagcgggaaaagcagaaaaacauaggaaaccaguuaaacauguuuauauugugguuuaaaaugaaaccugggguguucaugauuugacuugcuaucaaauuccaggguagcugggagggcccugcggggccaccaagggcugaguccucaggauggucccacaauaaugcaaccucacaccauucucuacaaggccgaggucccuccuguguggcugggccagaagaaagcccuuuagacugagcaggugaaaaagcaaggcaggagccucugcacggagcacuggggcagaugucacucauggaaaggggucugcaggcgacuggcacggugccagaucauggaacaaggugggaaaaggcacgagacaaaaucccaggggcaggaugaugguaaaaggaagagcuggggcacuaucugagaaaaagcaguuagguuuagacaagcaggacgagcagagcagaggagcucugaugugugggagaccaggagaaaccucagaucucucucugggccggacaguuguuuuuggugaaauucuccccuuucaacugagaaggagacucuugagaggucaucuguuaaacagaacgcauaaacuuugccucaaagcagccuccaugaagugucugccaugaagauguagcugagauucuugaaggcuucacuaacuguggcugaaagucacccggcuggugguuuggucugaaaaagccccaagugggcacaggagugggcaucaggcacacaguuggagaccaagacccgagggaaagacugcuguuagccgugcacugccaggggaggagcuccgagggcccugcccacacagugccccugacccuagcuggggcccugcagagaaaaaccuuucccaucaccugaacacuuacguauguccauccucaacugggaagacagaugacaaccaaggcuuguuucaucugcuucugguuagcucacacaguaugacuuuauacacgaaaauaacuuugaaaaccaaaacauccaacaaaaccugggagcuucuagaacugagccaaggagccugagccgcuaacccaugagacuggucuguguccagacagcuccccacugcagcacccaccaugugcagccccugggaggguggggguuaccugcacggagcaggcagcugagcgguggguggagucuagggaggauguccgaggaugcaauagcaaagaacuggggaguagggggagaaugccagugaaaguucccuggaagggaagggcuguccuacggcagacccuggagcagguggcccugagcaguccaagggcauugggaagacagagugacagugagaaaggccccagggggcucaagccacaggaggccgcuggcggucugagaguguggucucugccaugcacaggcgggacugcaggcuucgaaggcaggcaccacagaaggaacaaggcauaccagaccuugguucugagcuggacgcacggcaggagccaguggcugagaagggcucgcaggccaggcggguccaggugggagaaacagaaaaugggacacuuauggcaggcaggguccacccaaaugaccucagagaagaggcacaucgccaggcuagggcacaagggaagaggauacuggagacacggccucaccugcuggaaccacaaacacacaaaacccaaaggaaccggccaaaucaaacccacagucaagucccguccaccuguggguuaagaaagucgcauccuccagauccugacuguggacacacagagaagcugugcuggggaauccaaccuuuaaugccaacaaagguacucacucccacugacccaccccaccccacugucucuagagaaaagggcacacgcagacuaaaacucuagcugacaugauucgcacaaauuaagcugcagaacaaggugcagaaguuuuaacacugagcacugagauaucugcagggcaccccucgcaccugugagaauacugugcucguggcucucccaggccacucuugcucuuucccuaccaggaauccagaaauaggaagucauucgcuuuagaucacuuucgccuuacaacagcuauuuucugagugucagaugaagagguuagaaaugaagguuugacaaagacgaauaaagcguaguaagugaggauuugcaggaaaaaagccucugaaugcauucuaauggaaagugugaaacuucugcaagagcacuuucugcuuuaccucgaugcaucuuacacagggacacauucuugauagagacgcugacuuuacaggaaggaaaagcauuugggagaaagcucagaaaaugaucacguauguaagaauucggcugagauucacuaaacguggcgcaaagauuccuaccauaaaaagccucuguccaaagagcagucacucacauaaaccacauucaaccaacagaaacacaccuaccucucuucugaguugggcugugaagagcugcccuggucucccggucugacgguguuguccaccccaucugaggcacccagggaauugcccuggcguccggagcccugggguucugauagccugggucuuuuugcagggaacugauggucccucgugccaucccucgugauggcacgagcaacacauguagaugaaggagccucaauugcaguugagcccaguagacuuuuucugcaccccaggggugaugauggcaacuucuggaaacccuggaagugagggucuggauuuaauuuuccuaagaagccuucuguuugauaucgaacuuccauacuugcuuuaucuguagacacuccaauacauaaaggcacugucaucugcccaggagauuugaggcaauacuuuugaugaagcuugucaaauucuucuuuaauuucaucguaacgauuccuuccguggccuggcacuucuuuaucugggacugaaagaguuuugcugggugacacugacuuucuaaauauuccagaacuauuucccugaacgugaaggucagaugucugcugcgggcgaguugcgcugugugugggguuggucuuuggaagugaugaagaugaaucgcucuugggcaggcaccuaccugcuuccagagaucuuuugccuagguuuucaaaagccucacuuaaacuuuuugcuuuugcuuugcuggaagguaaacucagccugcggguuucuaagcccugaaggccaccaggacucgcaggacccccucuguacauguucauggcccaggaguccgggaggcacauccggcgaggcugguuccugggacucaggcaauauucccgaugaagcugaucaaaucggauuucaaucucccucugacgguucucuccauggcccugucguauuguuggucuggaaacuauuuuuacaggagaaauuaaccauuuuaauguccuaaaucuauuuuccucaucaagauuauauguugcacuggagucgaaguaaaucaaggaagaauacuucgagggugucacuuugcgcuccuuccaacuuggaucuaacuuauggauuuggggucuguugacuucaagaaaagcuuuuuccaauuuuaaaccugucuuacggcaagaaacaucuaauacguucuugcaaucucuuaaugccccugucccuuucacaggcucagagcaggguaugaaguucuccuuggagcuccucugagaacgucuggcuccuuugcaauauguuuuguucauccugcucuuauaucugugccuccuccuggaguuccaguuuugcaugaugaacguuuugguggagaugaugcuugauggcuuugugcucaacagccggcucauggagugcagcaucccugcguacaggucacugauggucacauugcaaaugucaucaucuucaaagggcuggcugcuuaagaagcugcugcuacuggucucuuguagggagaggcugucauuucuagguacuaaggccaugucuguggaggaaggaugcaaaggaucccauucucugggagaugaagcugguuucgcugggucaccaggacucuuucuggagauacgacugcaguauccugggagaaaagauacacauaaaguaaagguguguuaccauucuaaaccauccaugugcacagaugacagaacuuaagauuggaucaggacuauguuuuuuuaagcaauagcaaaaacaaaaacaccacaaauguguaggaguagacucuucucagagauauuuuuugguaucaaaauuugauuucuacucuccaucguacauuucccaaaggugucuuccuuucccucuaggcuguuuagaagauggaugccuuuucaaaagcuaauuagaaacugaaaaaugacaacacuguuuaccuacauggaugggaagggguguaagacuucuaaacaaaccucuucauauagcuuugacuuuugcaucauguaaauguuuccuauauuuaaaaaaaaaaaaccaacagugaugggaaaaaaccauaaaauugaacacaaacaaaaaaaaaaucuguauguuaaauugauaaagagaaaaaaaaagaguccaaauacucugagugucugccucuuaaagagauauugucuaaggauaaaaagagcugcuuggaaauuuucaagcuuauuuaguagaugguugugaagagugguagcaggugcugcaaugcuagaguuauuuuaugcuguacaauugaccagaugagcacguguuaacucacugcggcuggugagaacugggagaggcagauauggcaucagggcaggggugaagaagugcucaaaaacgcaugucguugcacuacacgacacaaaagccagccugaaaggggcucccugacagcuaaaucugggguuacuugagcgucaaauugcauaccggcaauggauuauaacaugugaaucaaagaacaaaaagacuccaugaauuccuacugauccuaaaaaauaaaaauaaaauaaaucaaagcaugagagggaacuacaggaagcaaaaaaaagaaccagaggggagauagcucuuuugagcagaauaaugccaacugacgugugccaaggaacggcagagacagaaacaaccugggcggggaccuccacccaggcgauccgcauugcuggcuucuaagucacugggugagaagcuuuuagagaaaagguuccuaggagaucucaaagaaucacacauagaugacuccagggaaaaagggccugucgcaaugagaaacaucgaaguaaggucuuaccuuaacucaaugaccagccuaaaagucaccaagaaugggacagacugaccaaauguucugagaggacacgucaucccuguaguaauuuugccaaaaauguuuaacgugaaccuaaccacgaggaagcaaucagguccaaauucagggacauucugcaaaauuacuggccugugcuauucaagaaaggcaauaauaugaaaggugaccaugagggagaaaaugccaaggagccgcucuugauggagggagacuaaacgcaacggugguaccagccugaguggguccggaaacgaucaggcaaaccagaaaggcugcaaaggacgucacuggcacaauggguagaacaguaccgcaucaauguucaauuucuggccuguguuaagcguacuguagucauaaaggagaauuagccgauuuuuggagguaugugugaggcauuuagggauaaaugcauacacaaaugcaaauaaauacacacugugugugcacguguguggcagggggugauaacgcagauaugacaacauguuaauugugaaacaagugaaggguguucacuguacuaguccugugcuucuggagaugcaaaacuuuucaagcuaguaaacuggaauaaagagcagacguggaggagaaaacagcucauuuugaaacaucuuaaucuuccagugaaauccaaguauaucucuaacaaguuauguugaugaaacacaccaggaaaugauggcguggccaguaugagcagcucugaggggccacgcagcuccaacaaaagugaaggaaacacgcacuguucauacaguuucuaugucacacucaccgggggcaggcacggcaggugaggccagugaaggcagcggagucacacguacaucccuuccagcucuguuaccugcacacugaaaucagagccagugguuacaagaaaaaaguugccaggugucaacugggugcaaggagcuggguucuccccugacgaugcggacugugcaucuuagcacagccaugucgacaagcgugugaauguggugacaguggccagcuaggcuucgggcagugggaagaaaauauguccuacuaagaucuggacaguugauguggucuccaggauagcuuccagccacagucaccacucaccugccaguaacuucuuaccccaggggcgcugguagcuuucuuugucuagcauuauacucagaccacaagaacaccuaggggccaaccggacgguggacaaagaagacccaguagauccguucguuccuaacccuaaucuguucccuggaucaacacagcaaccaagaggacaccacuugcugccuuggguuaaaggaaaaagcauuucagguacauccacuaagucggugguccacaaauacaggcuuuccgcuggucagcagcacaguaagaaaacacauacaccccugugagauugcugccuuuuucuggagaugaauucuuauucugcaauguguacuuccuaaguauuugguguugcaauguccuuuauucuauggcagagggcacugaccuuaagagagggguuggcaggugagugugcccaccucucaugccaucacauccccccccucccaacaugaccucucagcaggcgggacaggugccaagggucagccuccucaccuugcagcugauucuagccugaucgcaccagggaauguggggacuauugcuucccuaacuaugcagcuucaaauccugguccagaggucagggcugcucuuaagagucccguguguggccccaauagauuuuuuuuuuuuugagauagagucuugcucuaucacccuggcuggagcacaguggcacaaucucagcucacugcaaccuccgccuccuggguucaagcgauuauccugccuuagccucccaaguagcugggauuacaagcacgcaccaccacacccagcuaauuuuucuauuuuuaguagagaugagauuucaccauguuggccaggcuggucucaaacuccugaccucaagugacccaccugccuuggccucucaaagugcugggauuacagacaugagccacugugccuggcugccccacuagauuuuucugugaguugccccagaacagugggcagagcaccccugccagggcucccaccuuccugauggcgcugcccugggggaccuggaguguuuauucaagaagagcaaguaugucagcaugugaauaaaacaauuuggaaaucauuacuucaaaugcucuuuauggguucuguagaaaaaacaaaaagcauaauaacacuguaccucaauguauuuaguuuaugaucuaauuauauaaaaacaaacaacugggaaacagauuaccucaaaauacucugcaccuuguagcaguauauccacuugggucaaguauuuccuucuuaauucauuuuucaaagggcuuugaggcacugcaggcugaucaaaaaagagaagucagaauuuuuaagagcuucugaguauagcugaccuuuuggcuucuggaacaaacuggcaagcucauuaauguacaaaucuuuacaugauccuacucaaagucacuuucaccuccaugauguuauucaaagucacuuuuucacuuccugcuauguuaauaauccaaaagaauguaaaaagacacacacacacaaaaaaaccaugucuagagaaguuuaugacagcauugcuagaccaggaaaaaaaaaaucugaauauucauaggugaguucaggacucaacuacugguaauaacuucaaacugguaaguuuauaagaaauucagugcuccuggcugggugugaugggucaugccuguaaucccagcacuuuaggaggcugaggcagguggaucacuugaggccaggaguucgagaccagccuggccaacauggugaaaguccaucucuacuacaauacaaaaauuagcugggcaugguggugggcgccuguagucccagcuacuugggaggcugaggcaggagaaucgcuugaacccaggaaguagagguugcagugagcugagauugccccaccgcacuccagccugggugacagagugaaacuccaucucaaaagaaccaaaaacaaaaacagaaauucagugcuccagcucaggaggcucuccuaccccuccccugcuagacacuggaaauagagggcgucacccucuauccucugcugaguggggcuggcacuuugguucuugacucuugguaccacccacuuccccuuuguuccaaucccuacacaaucucucagugagcauccacuuucuuccccaggaccacggccuuuuucuuagucacugaaagucacacaugggugcgugggaaacccucugcacaaaaguagcaauuuuagaggaaaaccaugcaucagguauucuggcaggcaacagagugugacacgggggccaggaaagaugcuggagcugguuaagcucuguguaaauucgcaucuaucccaaccaaggaggauaagaagcacaucccauaagaaaacgggugguuucugugacccagggggcacucugggaaacagacauauagaugacacuuacuguuuggguuagugacggcugcccaaugaggcgaccuugugacuuggggcauuugaggacagaccuggaaauacucccuagaacaccucucuuuuuacccugccccuguaggggagacugaccgagagcccagcuuuccugucgugugcucauccaggcagauggcgcccugccaaccacacugacagcuuuaucugcagagugaaaaucaucgugaaucaggcuugcacuggggguagaacuggcugccaggugcuagacugagaggagggccuuaccgcugaagggaaucgacacgaggaaauccgagacuuggaaguagcaaaagccagccucaggagaggacuuccagaaaagugcaggcagcgcugcccgccucaggccacaugggcuuugauggaccccugagcccccaagcgcccccucuguccauucauuacuaaaggcagcacuuacugcuaaggcccaagcaacugacucuuccuggucugacguggcaucgaccucaccgcuuuuugaaucuaaaagucaaacaaguaaaucucaaucaggauuuucaggaaggagugcauuuuccucucaaggaugguuuuggcaucacuucgaguaaguuguacaguaaaaauccccauugcuucaagggugcacccacuggagccaucuacggcugcccgugguucuuaguaacccagagaaccccuagaaugggaaacugccuggggccauggagugaggaaaggcagauucugcaccaccuccagcuuuccauggccucugagccuggaaguugagacgcucaagcccagcacugcucgacagaacuuccggugaccauggaaaguucucugccugcuguccuaggccagccacuagccacaccgggcuacugaacagcugggauguggccaguaaggcugaggaaauggauuuuaaauuuuauuucacuuucaacuaauuuaaauaucauccagagagggcuggugggugccauacugggcaguacaucuaucaaauaacuauuuccugugauuucaagcgguuggggaaauucauggaccuaaggauuuauaguuaaaaucuggauuaauagcaguaaacacauagcaccacagguaaauauccucaugaagagcuuuccaauucuacucugaaagaccaccagcuucccuuuagcgacucaacacccaucacuaacuauugguguaggcaaggugccaggaaagggacugggcagagggggacagaggcugcggaaggccaguguccaggagagacagguguuuaaaggcuagugacaaaacuguuucgcaagcagaggaacccaggucuaaagagcucagauaagagugggggucuguuccagccuggggaucacaggggcuucccgggggcagcaaggaggccaugcggucaggcaggacuucaggccccauucuggguucuggccuuuuaccccaaaagcaaugggaagccacguguugcaucagagaagcggcuugaccacauucacaggggcgucaguggggcggagggagcccgggugggguuggaggcuggugcucagcggggacaugagagcuaacgaagcacaaggcacaggacagggaugccuuggccaugaggaaugaggcagaggcugagaugaagauccuggguuucuggcuaacgcuagagggaagacggcaggggccuguacugaggcgcagagcagaagauggggagccugucugucgggcugagucuuagcugugccaagucuggacaugaaguauugaagcagaggggcugcugggcaguaaaacgcccccaguugaguucuggcuggagguuacagucagcacacagagaagccauggcuccaccugggggaagggcaaaggcagcucaaacaaacccucuagaaagggcauccagcagggacgggaggcgagcagacugcaggcuuggaaggacgaagacagaaggaggaaaacuggaggagcauggggccgaggagcagggggccacagaggcccaggccagaacuucuggaagguuuaaaugcaauggagagcgcaaaacccaaagaauaaaacccaaagaaugcuaacaggauuuagcaaugggguugugagaaaccucacccagaguugggcuuuagagauggagccgaaaggagucgggagaggaggaacacacgggguuggugggguagggaauccauggcaccaaacggagcagguuauuucacucuggugguaaagggaacugggcaaagggauguggcaaggaaggggcccaggacaggggagagccacgaagggucugauguaucuaacgugagucugagcgcaucuaaauaccgacggauggauccaggggacagagacugaagacagaaggaaggggugagggacagauucccuagaaaagaggacaggaugggggugggcagugagacuggccuggggaaaaggaaggagccuccuaggaggacgaagugggaagcugcccuauagaagugaggguucacaacaccacccuguaggggcaaaucuuaagucuuacuaaaucuggauauuaacuuuucacauggaggggcauguuuauuuacucaaaaaacaccugaguaccauucauaugucaggcaccggauguaacugugggcaaggcagagcucagaaggaaucaacaggguacuuuaacaugauuuuaguuuuuaagauauaccuuagaaaaaauaaaaacuucacuacugaggaaucuaggcuuuaagcuguuguaacaggugcgucagaccuggucccuccugacuucaguucucugacgaaggcaacacucaccggcucccaggacugugcggugcgagggaagcucaggaccccaggcugcagcuugcacggagccaucuguccuguccgcgggcuucauggaggaguccuccaagugcagaagccaauaaaaacaugguuguuugagugacagcacauuucaaagucaccgcaaaauaauaaaacugcaauccuucuguuaacacaggagacagcaagagccugccacaaggcuucucuucucccugcauguccacuuuauaagaggccucaagagcguaggaaggagcugaggcuccccuggguugcagcgggggcugcuacuuaaaaagccacuuggaaggagcagggaaagucaggggcccaggcacgagcagauaagcucacaccuccuaacaguggcccagggaugacagggacuggggcaaacaaaaagccaaauugaaacagaacaaaauuguccugaggucaucagcgagaacagagaaauaggcaaguggccccugggcaacuuccugugaucuuuaaagaauaugcuggaguauuuaaggcggggaggagccaguuuaagcccaagcuaacgcacagaggcagcugcuuguccugaccaggagcucauaccuggugggcagagguggucgggcggccacacuccuggucaggccugcuucagcucuccagagccugcucuauagcaggccccacgaauaaucccagagcauggcaucgguggguucucaguaaugaaauucaagcauucaggauaccagauuggcugaaauauuaauauuuuaggaaccacccagccuuauaaaaacagggcgugagaagguggcgaggccuauaccguuagggaugguccucaggugucaacucugaggguucagaggacuuggggcuacccaggagcacuacaggguaacugaagcccacuuccagaauaucagaaccuuugcuuccagugaaaccgucacguaagguggaguuuacaggguuguuuuguggcugugucugaggcagaaccugguuugagaaucacagagaagcagacgaucuacaccaaccccaaacuaugugguagcucugguagcuacaaacagaacccaggcauuguguuauaaccaacccagcacaggucaacacccggccugccagggcccacagccucccccagccuccagggcggcaggagcaccaagucgucugggaaaaggugaaggcggaucuggacacugucaccaauagcaauuacagugaagucagagauguccccgcugaaaucucaggcuacgcccaguuuccuaaucccaagaaagggucugaagauucuggagacccagguaggguuccuccuacauuuuaagcaaaaaccuuaaauaaaucuuuaaaugaaaacuuuuugcuaccaggaccauauuaagcacuggucuaaugaguggacaucuguauuaugcauaauucaaagaguauauauacuuuaacccgauaaucccacuucucagcauuuaucgaaaagggggacuaucaguauugggaagagacaaggaccgggauuuucucugaaaaccauuucuaacagaggcuuuauaaauaaaguuuuauuggaacacugccacguacacucauuuacauauuauuuucggccacuuuccuccugcaacacagagcugaguaguuacaacagagaccauagagccagcaaagccuaaaauauguaucauccggcccuuuguggaaaaagugugcugacccuuauuuauuaauaaaggaagccacaaauagcuaauugccuaucaacaggagagcaguuaaaaaaacaugauuuuuuaaauaauuauauaauuuuauaauuauacaacaguugaugaagagaagaguuugccagauguauuaaccggaaaagugagggagaaaaaaaugcauuuauaaagauauguauuauagggaaucacauuguacuaaaauagcauuagugaccaucuuugcagagaggaaucagcucauuuauguaguuguauguacuuuuaacauuuuuaugacuagaauaauuaaucaagaagauuugauuucaaauuugcuguuaauaucgucacauugaucuugauguuuuucauucuuucauacagguuccuugaccugugaccacagagaggaaccauguggcaucugagaggcagugauuaacugaauaccagauaaccuggcaaaagccacuguggcaaaagggcuccuggaugcccccguagaaaggccaacagcaccuuccacuaaaauaacgggucucagagcgacaacacccucggaucaacuaggcagggaagccagggucuuccgaagguagaaaaaugcagaaggaaagaugugugauccuccaggcugcaccucuccucaucucucuuccuccccuuucaaaacaggaagagagacauucuucuucccuagaaggaacuggauuugguauuuucuguaaggacccaaacaaagugagugccucgcugggcuggcacgugaccuuggggaggguuacccaacuggcccagccucugcacauguauuaucagagccccucagccugugacacaggaaacacagggugaugaaaaaggccaaauauuacacagugacuccuugcacuugacaagcuacagaagaaaugcuucuaaauccuuaaaaacagaaagaguauaaucaugagaaaaagugccccgugguggccucugcguaagcucagagguugggcauacccacaccuuuauucauaugaauacuccuccacagcaagguuauuuggcaauaaaauuugacacuaaauaccuggaucucuccuucguuucuuuccuuuauuagucuuccaccccaaauucucaauccugaagaaaagaaacaaaaaugaccauuuacauaauccugaacgcugaacuucugcucaaucuguguucaccagaugccaaagugacaggcaaaaaaaagguacaauauuaaaaccaagccagguuucugauacccugcgauuguuccucuuuguaaaguuucagguuuuuaaggcaaauucgucauucauggaaaucucuccuaccuacuagaaaacggcucaucaaauuacaucauuagcccaaaaaguuaaaugaaaacaaggaacauaugacagcgacuguccuuaaaauauauagagggcaaucuauauaccauauagagggaguaagcacuuuucgcaggcaaucucuacaucccauauacugaaugaaugcuuucuaagggcaaucuacauguuauacagagaccaaaggguagcagaccugccacuggaauauuuuaguuucugccuguguaaacuuuucacccaagaugugucuggauuggcuauaaaggcagaaagguaggauuucuuuuaacucaaggagcagaucuugugaaccuucuguguccguuuaaugcaacauagaacuugcucugagguuuguuuucauuaagugauacugaguuaguuauaaagcuauaugggaggaauugaccccagccagugcaaagugucaccagcuauuuaccaaaaagaauccacaagauuucaguccguuuacauuaacuauuaaacggaaugccuucuccucccuauucaaguacuuggagccucaaggaagacaguuacuacuccaaguuaaacagggcaaacaauagucaaugugaguauucacagugcggggcgggguacuguucacaguuucauagggauuguacgugacuguuacaacacccacgcccaggagacauuauugucaucauccuucccauuucacagaugaagacacugagaccaguccagcuaagcaacugccccacgcugccaugguggggagguggccagcggggaugccaacccgguaagccggaggcaugugagccaggaggcaccuaugucucuucaggaauuguucuaauaaguaauucaaguaauuuacagguuuaagggcaccaauguuuugguuccuauuaguuaggugaacaauguuuacuucuuaagagagcagggacagcauuucaacuacuccauucacacucuucacccgaauacucagaagguggggaagacccuuacccuguggcgucucguaggucagcguggccauuugcaccaccgggguguccucgaagggcugguuguacugcggaggaggaaggggcuuccugucagguuccagggccacgaggggccccagacccgggaggaggcggcgccagcccgugagaggccguuagucuggccuggggcgccccaaacgcggucucugcagcggagcccccaacuccgccucucucgucccacucaggagcacccccagccccaccaaacccuccucucugcacccgagccccaggccugcuuccccacuccccguuccggaggccccagucuuuccuccccguccccgcaccgaagccuucggcgcugccuccuuuuucccucuccggagcccccagcuccgccuccaccuucucuccgcauccaagccccagucccgcuuccccaacccccgcuccgaguccucagagccccuucccuucccguccuacguccccucccagccucacuccgacacgcaggccuccccucccggcggaccggcgggggccgcaccuucucuaucagccgcugcaugcgccucuggaagcggcggcgacuggcccugagcuucugcagcagcuggucgucuuccacguccucgcccuccauggcgcgcagcguacccagcaucggacccagccaguacccaagcgccaacccggacugcagggccucgcgcgccacaaacucaaauaggagacuccgcccucccugccuuccucucgguuuucuauuggcuagagcggagaagccgggcacugauugggccuuucaaacaaauuugcgucccaccuuccggccaauccacucccgaguuuccagccacgccccaauguccggcggaa

SEQ ID NO: 12797 - RNA, 3135 nt, Homo sapiens
uuucccccccucucuccuuuuuauuauucacaagacugaaauuguuuaaaugucauaacuuauaagaaaauaagcuacauugaaauaaauuaacacaacggagacgugcuucacauggcucagauaggauaggcaaccccaggggaaaccaaagccaggcaaaagcaaagcaaagcaaagcgaauuuccaggcugccuaacaaugucugcuuuucagucaacucaaaaagccagaacgcaaaccaaaaucaguuuaaaccccagugcuuguucuuggguuucacguuuaccuuuggaaaaguauggaaagguggcugcuaaccgcgcagauuacagcagagguuuuguuuucuucuggaaugaguggagaaauuacuggguaauuaaguccuauaacuuucaaaauacugcagcugagauccagucuauagagauauuuauguacaaaguaggauaguauaauaaauauuuagcgugucuucugguguggcuguaagccccuucaaaagcagucuuuuaagcccauuuagugaauauauucucaauuugcuugggauggccacagcugggcugugacuuuguugcuucaaacacaguggaguccaccauggguucccucgggugcgggggcuucuccaggugggugccaggcccuggcccuucuggacccucagggccgggccuguucuagcugcugaugcugacuucugauagcgaaccugcugacguggacagggauggggacgacgaucuuaggguuccgggagggcuccccugucuuggaauuggcauugccugccuucacccguuuccacuuggcccgucgguucuggaaccagauuuucaccugcaccucgcugaguuugagggcgugggcgaucugcgagcgcucggucaaggagagguacuuuuugcaguggaacuccuucucuagcuccagcagcugcucgcuggugaaggcaguccgccgccgccgguucuugcccguagacguggugcugcccgcggcgccgcugcucggcggggucuccuccagcgcguggcccgggucuuccuccuugugagcugccuggccagucagauugucauccgagcuguaguccacaucgcucuccagcgagaagcucuccuccuugcccuucgggucgucuuccaccuuugacucgucuuucccuugcccucggacagccccgacugaaagcaaaaccaaacggcauuuuauuacauuucgcacacuggccuuccuuucuccuucccaccgucauuuggacauuccgcgccccccgccccccacccuuuagcggauugucuuucuaugacauuaacacauugugauuuccuggccuuugagggguagaggagggguggggggagcgugagaaagcucaaaggagaggaggcaguacaggcgacggcccuuugcccagaaccaucacucaaagggccgccaugccucccccgcacccucccagccucggcagcgucaggagaaguagcaggaggcgcgaggcccaagagauugcccgcuuugucccugggguggggacugguugaggacugauggggggauucacgauucauccuccccccaccgccaccaugaaaauguagugaaccucaauugcuuccuaaccggaguggaggcguagggacgugcagaucccagaccaucuuuuuugagacagacaacguuggucaaagggauguuuuguggccuuauaaguucccaccagacacccccaacacaaacacacaggcacagccucccagcaguccguuucucccagacaaguagcaagaccagcgaagggguuuaaaaagucugggcgccccugggcacacgcacggcugagacgcgcagcccaacccgucuccccuagaggcugcaaccuacccggaaccccaggucaccgcggagcggcagaggcggccucggccaaacgcaucgucagauagauauguggcccagggcagcagcuggucgccgggcgcuaaacgcccccccucccgagaccccgcuuguuggguggcucugaaugucccccggaggcccagcggcacagccgggccucauccuccagcuccucccgcgggggucgagcgggggcgcggccucgcccccuuggucucccgcgggaacccggcgcuggcccgcccccgccuccucccgcccccucgucccggcugcgcgcgccgccgacucaccgagcgaagccugcaccgucucggccgcggagaaggcgagcagcgagcccucuuuggccaggaagccuuugccguccuccgcgucagccugcagcgccuccgccuugucgaaguuaccgccgccgggcagcggcugcggcgcgaacuugcgggccgcugccgccuccuggugcuggggcgacgcggagaagccgccggggagcguggccaugagcguagaggugagcgccaugcccugcgccaggcuggagcagaagccugugggcaggcuggggaucugguggugagggugugcgggcggcagcgcuggcugcagcgcggccuggggcagcgcgggcggcggcggcggcggcggcggcagcacuaccggccgguagggcaugaacaugggguagccgguguagacgaaauggccggggcugggcugcggcgggcugccgaucagcgagucuaugcugaaggcggugcuacuccccagcgggcgcugcaucaucaucagcgacggcgggaacgcugcgcucauagacgcgcucgguagaggccagcgagaggcgaaaaguccccgcgccgcgccgccgccgggaagcccgccggacgccgggagcaccgccgggagcgccgggcaggggccgagcgggacccggagagcagacgccuccgccccucaguccugggcccgcugcaugccgggcgggugcagggggugugcggggugaggccgugcgccccggaguggagagggcgcccgggccccgagggcucgccggagcccccguccgccgcuugcccgucggagcccgcgcgcuucgcggguuuggcccucggccccgguaagcugccguccguccguccgucccgccguccgucgccucccgcgggccgcuggggagcgcgcgaagccggcguacuuaucuccggcgggcgcagcca

SEQ ID NO: 12798 - RNA, 3135 nt, Homo sapiens
uggcugcgcccgccggagauaaguacgccggcuucgcgcgcuccccagcggcccgcgggaggcgacggacggcgggacggacggacggacggcagcuuaccggggccgagggccaaacccgcgaagcgcgcgggcuccgacgggcaagcggcggacgggggcuccggcgagcccucggggcccgggcgcccucuccacuccggggcgcacggccucaccccgcacacccccugcacccgcccggcaugcagcgggcccaggacugaggggcggaggcgucugcucuccgggucccgcucggccccugcccggcgcucccggcggugcucccggcguccggcgggcuucccggcggcggcgcggcgcggggacuuuucgccucucgcuggccucuaccgagcgcgucuaugagcgcagcguucccgccgucgcugaugaugaugcagcgcccgcuggggaguagcaccgccuucagcauagacucgcugaucggcagcccgccgcagcccagccccggccauuucgucuacaccggcuaccccauguucaugcccuaccggccgguagugcugccgccgccgccgccgccgccgcccgcgcugccccaggccgcgcugcagccagcgcugccgcccgcacacccucaccaccagauccccagccugcccacaggcuucugcuccagccuggcgcagggcauggcgcucaccucuacgcucauggccacgcuccccggcggcuucuccgcgucgccccagcaccaggaggcggcagcggcccgcaaguucgcgccgcagccgcugcccggcggcgguaacuucgacaaggcggaggcgcugcaggcugacgcggaggacggcaaaggcuuccuggccaaagagggcucgcugcucgccuucuccgcggccgagacggugcaggcuucgcucggugagucggcggcgcgcgcagccgggacgagggggcgggaggaggcgggggcgggccagcgccggguucccgcgggagaccaagggggcgaggccgcgcccccgcucgacccccgcgggaggagcuggaggaugaggcccggcugugccgcugggccuccgggggacauucagagccacccaacaagcggggucucgggagggggggcguuuagcgcccggcgaccagcugcugcccugggccacauaucuaucugacgaugcguuuggccgaggccgccucugccgcuccgcggugaccugggguuccggguagguugcagccucuaggggagacggguugggcugcgcgucucagccgugcgugugcccaggggcgcccagacuuuuuaaaccccuucgcuggucuugcuacuugucugggagaaacggacugcugggaggcugugccuguguguuuguguugggggugucuggugggaacuuauaaggccacaaaacaucccuuugaccaacguugucugucucaaaaaagauggucugggaucugcacgucccuacgccuccacuccgguuaggaagcaauugagguucacuacauuuucaugguggcgguggggggaggaugaaucgugaauccccccaucaguccucaaccaguccccaccccagggacaaagcgggcaaucucuugggccucgcgccuccugcuacuucuccugacgcugccgaggcugggagggugcgggggaggcauggcggcccuuugagugaugguucugggcaaagggccgucgccuguacugccuccucuccuuugagcuuucucacgcuccccccaccccuccucuaccccucaaaggccaggaaaucacaauguguuaaugucauagaaagacaauccgcuaaaggguggggggcggggggcgcggaauguccaaaugacggugggaaggagaaaggaaggccagugugcgaaauguaauaaaaugccguuugguuuugcuuucagucggggcuguccgagggcaagggaaagacgagucaaagguggaagacgacccgaagggcaaggaggagagcuucucgcuggagagcgauguggacuacagcucggaugacaaucugacuggccaggcagcucacaaggaggaagacccgggccacgcgcuggaggagaccccgccgagcagcggcgccgcgggcagcaccacgucuacgggcaagaaccggcggcggcggacugccuucaccagcgagcagcugcuggagcuagagaaggaguuccacugcaaaaaguaccucuccuugaccgagcgcucgcagaucgcccacgcccucaaacucagcgaggugcaggugaaaaucugguuccagaaccgacgggccaaguggaaacgggugaaggcaggcaaugccaauuccaagacaggggagcccucccggaacccuaagaucgucguccccaucccuguccacgucagcagguucgcuaucagaagucagcaucagcagcuagaacaggcccggcccugaggguccagaagggccagggccuggcacccaccuggagaagcccccgcacccgagggaacccaugguggacuccacuguguuugaagcaacaaagucacagcccagcuguggccaucccaagcaaauugagaauauauucacuaaaugggcuuaaaagacugcuuuugaaggggcuuacagccacaccagaagacacgcuaaauauuuauuauacuauccuacuuuguacauaaauaucucuauagacuggaucucagcugcaguauuuugaaaguuauaggacuuaauuacccaguaauuucuccacucauuccagaagaaaacaaaaccucugcuguaaucugcgcgguuagcagccaccuuuccauacuuuuccaaagguaaacgugaaacccaagaacaagcacugggguuuaaacugauuuugguuugcguucuggcuuuuugaguugacugaaaagcagacauuguuaggcagccuggaaauucgcuuugcuuugcuuugcuuuugccuggcuuugguuuccccugggguugccuauccuaucugagccaugugaagcacgucuccguuguguuaauuuauuucaauguagcuuauuuucuuauaaguuaugacauuuaaacaauuucagucuugugaauaauaaaaaggagagagggggggaaa

SEQ ID NO: 12799 - RNA, 3111 nt, Homo sapiens
cgagcgaagccugcaccgucucggccgcggagaaggcgagcagcgagcccucuuuggccaggaagccuuugccguccuccgcgucagccugcagcgccuccgccuugucgaaguuaccgccgccgggcagcggcugcggcgcgaacuugcgggccgcugccgccuccuggugcuggggcgacgcggagaagccgccggggagcguggccaugagcguagaggugagcgccaugcccugcgccaggcuggagcagaagccugugggcaggcuggggaucugguggugagggugugcgggcggcagcgcuggcugcagcgcggccuggggcagcgcgggcggcggcggcggcggcggcggcagcacuaccggccgguagggcaugaacaugggguagccgguguagacgaaauggccggggcugggcugcggcgggcugccgaucagcgagucuaugcugaaggcggugcuacuccccagcgggcgcugcaucaucaucagcgacggcgggaacgcugcgcucauagacgcgcucgguagaggccagcgagaggcgaaaaguccccgcgccgcgccgccgccgggaagcccgccggacgccgggagcaccgccgggagcgccgggcaggggccgagcgggacccggagagcagacgccuccgccccucaguccugggcccgcugcaugccgggcgggugcagggggugugcggggugaggccgugcgccccggaguggagagggcgcccgggccccgagggcucgccggagcccccguccgccgcuugcccgucggagcccgcgcgcuucgcggguuuggcccucggccccgguaagcugccguccguccguccgucccgccguccgucgccucccgcgggccgcuggggagcgcgcgaagccggcguacuuaucuccggcgggcgcagccagcaccuuuaaaucgcgcuccucuuucucauucacauuuugccugccgccuggcccggcucgccucacguggggcugggcgccucuggccauuggcugagcggggcggggguggggcgaaagcggggccccgcccuuuccacccaagcuggccucgagcgggcugcgggcgccaccgucggagcgcgcgggccggggagccggagccugcaugccuagcccgugccgcgcaaacuugagacgggcggauggcaccuccaaggcucggaccuuggggcccugcagccuugucgaggccaccucgaaggguagccuccggggcccgcacccccacggcugggccgggggcgcuuuauuucuuuuacuguauuugccauggaaccaaccugccugcggcucacuccagcgcugggugcuccggcugcgccugggguccgggcgaggguccuggaguugggggcaggguccugccccuccggagccacccccggggcgaaggcugggagcuggcagcgccugcccgccgccagaaacccgccggguugcucgcuguagguccgcgcaccggguggggcggggaggcugcugcuucccccaucccgggcugggcccucccgugagcgaucccgucucucauuuuucaugacauucuuaaucaucgcaccuauuuacacacuuugccagcgcgcaccaaaauaacaaccacgauaauuaugauaauaaagagaguccuuuaucugcuccauccucggggaggaaggggggaguugcugugccuccagauuguauaacgugagauuauccugaugaaagcuuuaugauguuugcucaaauaaaagcugcguuuuguaaauaggcgcuaauuaagcacguugcgaacgcaaggagugcucacccuggcgccgccgcccgguuuccagcgcgaggacucgagggcgcgcgguuccucuuugcuaacugcaggauggagccgauccccucaggauguuuccccuguucucgacaacgguaaagacccccaaauuugaaaguaagggaauuuugggguggagggaaacuagggacguacuuauccccucuuccauuuucaaacaaaaaacuuucagcucuugucuucccuuuaaaaauggaaucacuucuugacaacggcagaccgugcagagcgcaccagcgcgagcggggcuuccucgagucuccaaggcccgggcuucaacuucccgggucuagacgucagcccugaaccgccaacagcaccggguuggggagaaggaaagaagggcauuguuaguucggucauuaaaaaucagcucacgccgaggagcuagugguuggggaguuggcccguguuggacguguguuauguaucacuuacaagcacauuuaauugggagauaaagauaaaucgaucuuuaugaauuuaucgacccgauucuuugaagcucuuuuuucgcguucuuccucuuucucucgcucuagccccaaggccccccgggggacgucuuaaucccagaucagcuccucugccaggagucccgccggagacccacugcccacccagcagaccuggaggaaagaggggaggguguguccuuggcgccccgggacgcugggaaaacucgcugguccgccgccagcccucuccuccuccucgccuccucccucccuaccaccacccggacaaagacgucucgaucgcguuuccccacuccaggccgcaguaauagaucgcuccggcagcaggcgguuugaaaggaauucauuaggacgcugccuggauugccuccccugacuucacgcccagaccccgagguggcuuaggcagugugaggggaaaugaauucccuuugggauccauggagaaggaggugucugugggaucuccaggcucuaucccuccuucuucacucccagaaaagaagaaaaagaaaaaaaaaaucgaagcccagggcaaaaggcugauaucuuuaugagcauaauaaauacucccccucauuaugagauaguuacagugacacagccuugggugccauuacccuguuuuuugaauacuaagaaacgcuccauuccuuccuugauuuacguggcuacagccggggcccuuccggcuugccacugacaugccgggggaagcuguuauucauuuuaccuaggcagguuugccaugcacuuugcuauuucgccgc

SEQ ID NO: 12800 - RNA, 3111 nt, Homo sapiens
gcggcgaaauagcaaagugcauggcaaaccugccuagguaaaaugaauaacagcuucccccggcaugucaguggcaagccggaagggccccggcuguagccacguaaaucaaggaaggaauggagcguuucuuaguauucaaaaaacaggguaauggcacccaaggcugugucacuguaacuaucucauaaugagggggaguauuuauuaugcucauaaagauaucagccuuuugcccugggcuucgauuuuuuuuuucuuuuucuucuuuucugggagugaagaaggagggauagagccuggagaucccacagacaccuccuucuccauggaucccaaagggaauucauuuccccucacacugccuaagccaccucggggucugggcgugaagucaggggaggcaauccaggcagcguccuaaugaauuccuuucaaaccgccugcugccggagcgaucuauuacugcggccuggaguggggaaacgcgaucgagacgucuuuguccggguggugguagggagggaggaggcgaggaggaggagagggcuggcggcggaccagcgaguuuucccagcgucccggggcgccaaggacacacccuccccucuuuccuccaggucugcugggugggcagugggucuccggcgggacuccuggcagaggagcugaucugggauuaagacgucccccggggggccuuggggcuagagcgagagaaagaggaagaacgcgaaaaaagagcuucaaagaaucgggucgauaaauucauaaagaucgauuuaucuuuaucucccaauuaaaugugcuuguaagugauacauaacacacguccaacacgggccaacuccccaaccacuagcuccucggcgugagcugauuuuuaaugaccgaacuaacaaugcccuucuuuccuucuccccaacccggugcuguuggcgguucagggcugacgucuagacccgggaaguugaagcccgggccuuggagacucgaggaagccccgcucgcgcuggugcgcucugcacggucugccguugucaagaagugauuccauuuuuaaagggaagacaagagcugaaaguuuuuuguuugaaaauggaagaggggauaaguacgucccuaguuucccuccaccccaaaauucccuuacuuucaaauuugggggucuuuaccguugucgagaacaggggaaacauccugaggggaucggcuccauccugcaguuagcaaagaggaaccgcgcgcccucgaguccucgcgcuggaaaccgggcggcggcgccagggugagcacuccuugcguucgcaacgugcuuaauuagcgccuauuuacaaaacgcagcuuuuauuugagcaaacaucauaaagcuuucaucaggauaaucucacguuauacaaucuggaggcacagcaacuccccccuuccuccccgaggauggagcagauaaaggacucucuuuauuaucauaauuaucgugguuguuauuuuggugcgcgcuggcaaaguguguaaauaggugcgaugauuaagaaugucaugaaaaaugagagacgggaucgcucacgggagggcccagcccgggaugggggaagcagcagccuccccgccccacccggugcgcggaccuacagcgagcaacccggcggguuucuggcggcgggcaggcgcugccagcucccagccuucgccccggggguggcuccggaggggcaggacccugcccccaacuccaggacccucgcccggaccccaggcgcagccggagcacccagcgcuggagugagccgcaggcagguugguuccauggcaaauacaguaaaagaaauaaagcgcccccggcccagccgugggggugcgggccccggaggcuacccuucgagguggccucgacaaggcugcagggccccaagguccgagccuuggaggugccauccgcccgucucaaguuugcgcggcacgggcuaggcaugcaggcuccggcuccccggcccgcgcgcuccgacgguggcgcccgcagcccgcucgaggccagcuuggguggaaagggcggggccccgcuuucgccccacccccgccccgcucagccaauggccagaggcgcccagccccacgugaggcgagccgggccaggcggcaggcaaaaugugaaugagaaagaggagcgcgauuuaaaggugcuggcugcgcccgccggagauaaguacgccggcuucgcgcgcuccccagcggcccgcgggaggcgacggacggcgggacggacggacggacggcagcuuaccggggccgagggccaaacccgcgaagcgcgcgggcuccgacgggcaagcggcggacgggggcuccggcgagcccucggggcccgggcgcccucuccacuccggggcgcacggccucaccccgcacacccccugcacccgcccggcaugcagcgggcccaggacugaggggcggaggcgucugcucuccgggucccgcucggccccugcccggcgcucccggcggugcucccggcguccggcgggcuucccggcggcggcgcggcgcggggacuuuucgccucucgcuggccucuaccgagcgcgucuaugagcgcagcguucccgccgucgcugaugaugaugcagcgcccgcuggggaguagcaccgccuucagcauagacucgcugaucggcagcccgccgcagcccagccccggccauuucgucuacaccggcuaccccauguucaugcccuaccggccgguagugcugccgccgccgccgccgccgccgcccgcgcugccccaggccgcgcugcagccagcgcugccgcccgcacacccucaccaccagauccccagccugcccacaggcuucugcuccagccuggcgcagggcauggcgcucaccucuacgcucauggccacgcuccccggcggcuucuccgcgucgccccagcaccaggaggcggcagcggcccgcaaguucgcgccgcagccgcugcccggcggcgguaacuucgacaaggcggaggcgcugcaggcugacgcggaggacggcaaaggcuuccuggccaaagagggcucgcugcucgccuucuccgcggccgagacggugcaggcuucgcucg

SEQ ID NO: 12801 - RNA, 13716 nt, Homo sapiens
ugcaagucugcagccagcagagcucacaguuguugcaaagugcucagcacuaagggagccagcgcacagcacagccaggaaggcgagcgagcccagccagcccagccagcccagccagcccggagguaaggaaacggugcucgggcagcagcucugcucggaaagaaggcacggcuucugcucuuaagccaaguggucuuuucaaaggccuucuuuaaaaucgcucagaugggugcuuuugagucugcgggucugguuucugaaaacccaggcugcacgcagcugcauugcaaagugcuuuugcuaauucggagggcuucaccuuucucuucagaaagcaaagggcaguuuucuuaagucacuugcagaaggaaauuuccauguguauuuaggaaucugguguuuauuugcuguguggcuauuuaagcuccaguaagcaggggaacuuugcaagaacacagacuauccauucugccugaccaauuuggcauggggauuagcuuggcacccacuguuuaccuguuuugcuucuaguauaucaguuuggaaacagauaaaauuggcaguaaauacguaauuccagaaugaugaacacuuuauuaagaggcauccuuaaauggagcagaaaacugcugagaaucuuugugaguccaagauguauuugaauucaguacuuugggggauuuaccagagucuguaaguccggaagcuauaaacgugaauguuaaacacagcccggucuucucuucucuugauggcacgcuugcuaaucuaauuugaguauuguucucuuagaagguguuaaguccaacuucaauugggguugggggaagcacacacacaaaucuacuauuuugcaauuuaaauauacucuucagguaaaauguggauuuuguucaauuuuguuggcaugugcaaagauucaaggagugacugagagaacuuuggagugaggucagggaugggugguuagccaagacuuguaacuuccagggagaaugagaaguuguaaaagucagacuggcugucucucuuucucucuuccucuuucuuucuuucuuucuuuccuuuugcucacaacaggauuacuuaguguuucaaaagugggagagagccuccuuaaaugguuuacagcccuuugaauguauuuggugcagugacauccccugaaacuucagucugcaaagucucaacaugguaacuuuguucuuuucuuuuuuaaaggcagaugcugcuuuuagugucccuuuauuuauuccaggaaaaauguggacaucagcuaggcacgccuagcaaagaaaguggaggcugcugguuucugugcuuuaacuuuccauagauuuuaaauggauaaacugcuugcccuucuuucaucagaauaugagcuuuccccagauggaaagucuuuucuaaagcaaaguugcacaugggagcucuagcuuggaaacaauuugcucuuuuuuccccagucucugccauaaacacuugaaugugcacacaacugcagagcuuaaugccacaaccuccaggagauuggggggaggggaaagcugcccaggaugggggugggaaagcgaaggaagauggagaaauggcugcaguuugcugcccaucagcuuuucucuuuuaaggggcagacauugcagacguaguuuuaaaaaaguuccauaaagcaucgccaaggcagcaugccugugcgacacacgcagggcuuuggggguguguuuuccccguauuaacagcaagucguugaagcguugagaagguauuaugauuucuaaucaggcccagaacaggccaaguauaggcuuucugaaugaaaaaaaaaaaaaaaaaaaaaaaacccaaaacaaaaaacccugcuuaaucaggaacaguggcuuuuugugugaucauuuuagggcgagagcuccuguuuucaagucgacgugagggaaauugguugaagucacucaaaccugaggcugaagggcagucacuuuauaaaccuuaagaguaaccgaggggaaagaaaaagaccucaaagauugcaaaacuuuagauuuuuuuuuugugauuuuguagaacaugaggggaaucuggggccagaaggcauuuguaccuuuaaaccaggcaaucaaauaacuuaguuuuauuauuagaagcaagaauaguauuaaaacgccuucaauuggauugcacguguguaggcauaauucaggaagaaacuaaagaucgugucaugucaaguguuacuaaaguucaggaaggaaaagacaaagcuccaggacacguauuuucuguugaaauaaaagaaagcaagccagaaauagacagaucaggacagggaggcgugcaggcgguggcccugauuuugaauauuugaugguuuccuucagggaauguuugaugcuuuuaucgacuaauuuggaauugaaaaaaacaaaacaaaacacuauugcuucaauauuaaagugaucagggaauugcauaauuuuauggugacaauuuuaaagagccacagguaguuuuggaagcagacuguguuuuguuccaggcacugaaaaaguggaugggggccgagacuaucucagguggccuugaaccacuguuggcaaagggacagauaacgagcccagggcagugugggggacuuugcguuuugaagucugggucagccagauaguaagcaucuuuugcuuuuccugcuauaacagauauguggccauccucccucaguuguauaugcagagccuaaguuugcacaguguccuccugggaaccccauugugucuggcuuagggcgggggugaggaggcucuccuagccuggcugaccucccacugccucguccuaguccuaagcugggugggaaucagggcucugguuacacugggccggcccagacggcagccuuugugacgugggaaucucuggaccugcucuuguggguauagcuuugcuucccugucgggcagcugagcacaauagaccagaucagguuucuggacgugggauuuauuugaucccccaaauccuuaaaguggacgagggugucccacguguucaugugaaguaugucuaaggacccugggaagagguggacuguaucugaaucaggauauagaguuuucuguaguuauuauuuuuugcguucucaaguaauucaaagcaguuauguacuugcauaaaauaagaucacucacggucacuagugaauguguagucaagacuguuuuccauuugcuggcagcagaggggacagacagcuacccauucugcuaucagcccuagcagauagucacagagagucugccugggccaaagcuccccuagguuacuugguugguuuccccauagauucgauguagcauugguuaaaaacacacagacacacagacacacacacaugcacacacacacacaccccacucaaugaugcgcaguugccuaaugguucuucagagguaguguggauucuccugaucuaacuugcaggcucagcguaagcggggcuggccugguggaagagguguuaucugcucaaggagaccagagcguuugcuuuuguagcaugauucccgcuggagagucccuggagauguuggaaaggggaagagaacucuguucuuagccacaagcgcaccauaacccagucucuucacccggccuggccucaguuuccaggugugcaaacagugagggccacugucccagcucuugucugggacaauaccaaguuucuucaugaaauucccuuguaggacacaggucucacacugcagaaagccagugaaggaggcagaaguccugcagggcccagauggccagagggucccccuuuucggagcuggucccggggccccaggccuggccugaguuaucuuaucuauaccacuguagaggagugauguguguguagcagccuggucugcacccagcuaccagaccaccccacugcaaagcugccugugggguucguaucacuuccauucucaaagccuccucugcuccaaagccauggccuugcucuagacuguccuggcuccugcauggacaagcccuggucauauuccuugcccacccuuuaaggcccaacucuuaccuccauuugcucuucguggagaguccuugccucagccaggcugggugacucuacccauggcugugccuuccuggaacauccuugaucaccccuaccuccuugaagucccccauaagccaccagaguagaaaccccucauuuuccugcugaaggggcaugcaccaccuugcucaugccuggggggugaugggccugcgugccuucccaauuagccggcggggucucggggguuggggggagauguuucugauuuguuguccucacgugccccagagcagugccuccuggaacaagaggcucaguccgucaacaccagcucggugacgauuucagaaaagucucuccuggacgcccgucuccgcugcuggccacagucgcuggucuugguggggcacgauuaacugcuggcucauugaguaccuacuaugugcagcuguagcuguauagcuguauagcuguagcuacacaaaguuacagaagacuugguggggggugcggggccugguaggaaugagguggaggggcaagaaaccugaacaacgugaugguacaaaagccauuccagaauagagaugugcaguguggggccaggagaaggugggagaaucagaagggcagagggcaucaguugggaagagucugugguuggagacugcaaacauguggaagggaguuuggagggacacuggccaggugccugaacacguggcauucucuggaaggaacuaaccagcgugaggacaugcugauugcauacucagccaccacccaugaaggcucuaaaccugaguaccuguaauuccggcuucacccucagcuugcagagugagcucagggagaccauuuggauguggcuaaauaccccaggcugcuugcugcagcacggucguugucaaggauacuugguugaugaauaaaacaucccagaaacgagaggugcaucuccgagaaaguccugcaauugacaagaggagccccaguaccaucugggcugugagugacagaggagucccuuugcaggccauaggcuggcagggauggagggcuggacaggugcuugcccaccgccggccacgggaaaguucucucccugucacugcaacgugcgacagggccgcuaaaaaggugaccccuguacgaaggaaugaaugagauaaaacagagcaagcgcugggaaaaagggaaugaaagcugacguucacugcuuuuuguucucccuugggucucugugguccaggaaaaugcaacaugaaccucgauuguucuguggaccauuccucccucuaugaaaauuuacauaauucuugaugucaaauuucaaauaacacagaaguuuauagaguaaaaacuacaagucuccuuuuguucccuccuccuaccuucccagccccaaguuuuauacuuacugcaggucuuuuucuaugccuucgugcacauguauuuacauauaaaaauacacaaauguaauuuuuguguuucuuucugcauagcugggguugugcugugugugcgugugucugggguugugcugugugugugugugugucugggguugugcugugugugcgugugucugggguugugcugugugugcgugugucugggguugugcugugugugugugugucugggguugugcugugugugcgugugucugggguugugcugugugugugugugugucugggguugugcugugugugcgugugucugggguugugcucugugugugugugugucugggguugugcugugugugcgugucugggguugugcugugugugcguuucugggguugugcugugugugcgugugucugcguauugucuuucacugaacagcaugucguaacucucccugugcaugaagggaggccucccucucacagcuguauuauauuccagauggcggagacaccaggcuuuacugagucgugccuuuguugaaagacauuuacguugucuccaguguuugcucguaaauaaauacugcuuuaaaaaacaucuuguguacauuuggagacacaugaauauuuugaggagagaaacguaugaauuuguaucaucauagaacuggaaagaaacgucuuuuguucugcacccccuccccuuccuucccccuggaaucuuuuaugcagaaaccuuagaaccuaagugucagaagugggucucauuccccugccugcccuggcaugggcacugaggcccuagagacgcaggcagugggcagguuugauucacacccagacauguuucuuagacccuggccucaagcgggaauggaauugcugguugauuccagcagagggugacuggucuaaguggaugucuccuucaggcccuguggcuaucggccuucccaacuucccagcguaaacagaccccgcacaggcugagaggcauuaagaauguauacaaggacccgagggcuggcccauccagaucugugcggaaugcagucagcucuuucuguaugggaugagguaauccccugcuuuugcuugaggggaccugugauuucugugcagggcccgcuggggguucauuagaggccucccucccucucuccacuuucagauuuugcagggagcuuugucaccaggcuuuugagaaccaggggcccuggguacacauuucauaguuugcucuaugaagcuuuuguuccuaucagggauucugagagugucacuuauuaagaucuaagcagguaauuuaggaagauucuuugcuccaauaguggacgcacaaccaucagugaaugguggucaaugaaagugggcccugcccacccuaaacguccugcacgcaggcuggggcggccagagccuuugucgcaggccaccuuccauguuacacggcaguucccuauuuugaauaaggggauugucuuugucaaauaauaaucuguuugcuggagacagcucuuguuucugaaaccuaaugcaugaaaaauaccgaaaugacaaaaggguaagcuauaguaugacauuuuuguuuuucuguuuuuuguuuucuuuagcucccauuugaauuugcagaggacuugaugacugcacugucugcuuaaucucccuuuucacuguacuuuccuuccuaucugaccccuggaaccuuugguggugggaagggagaggcccguccaggccccgagaggaaagcagguggucagggugugggccucuggcuuuguuuccuggccagccccagugugggcugcuguuccuugggcugacuggugguuaaugauugaggaucggugaucggugagugaugauagguggccggugaucgguggggcagugaggagcuccagccuccgcucucucauucagcccuugggcagcaacagccaugcccuuguuggaaguuucccacugugccacccgggaggggagaagcaaggacagaggcgaggacggcugagcggggaagugccuaucucagaaauacuguuuuugacucagaggaccaauggucccuaaaucaaauuuucgucacccaaagaggcaaagguagaaagccaagggcuggaugggggucccugagcccuuuuccaccucucagucccacucugggcucugagaauacugaaggcugcugguagcucaaagcgggugagugucuauuuugugcuaagaguggaggaacuggaaggaaggacacacucgagaugugggaaccaggcgucuucucacugagugacccugccuccugcuggggccuguccaugcugagcaguggccaggcgccuggccagccggcaucugacaugucucuacacuggagggcaaguaagaccugagccagaggaaugucaccauggugggggagagagguggggcggauucgggauccaaguucgggcgaacaaagacugagggucauuucuuucuagccccugugaauggcccaaaccccaggauuuauggcagcuucugcuguguggcugugccaguggggacagagcagggagcccaagccaggcgccagccgagcucccucuggacccagcugcugucccugcugcugcccagcuguggggcgguccuccauucaagcuccucugcuccccgggacucuggggucagaugagaucaugggggaaaguguuuuggaaaccaagccaugaugcaaauguguuucguuuuaaggaaaugggagaaaggaacaaggauuguugcaguagagccauguggggagagcaaaggugaaauccuugucuccuggcaucacgggguggagaguggaacgucagcucugggucauuugguggccaaggaaagauggcgauaguagcuucaaggcacggccugggguugcccguccacccuggaggcagucuggcaggacaggguguccucagcucccugcugggccuacguccuuuuggaguucuagagcugcgucuuaggacaagugugccaagccuccugcuuugaguuucuguccugaccuugaccuggcucaccuccaugggcagccucccaugcuugggcaucagggcuugucauaaguccguggucacagggcuugauuccuccuagugggugacucugaggacggccaggccucccgcugcaggaccagcgugguucccuccauggaaggcuuucagaguguggaggggaugcggcugucuugggaggcccagcccuuucugucagccguggaggacacugagucagguuaggucacgaggaggggaccccacagucauuuacaucccgcagagggaagugcccagaagcccgcaacagucuccgcuaagugggguucacgccagguccucugcugugaauguggaggcuguggagccgaggccgcgaaauuucucacuuuucagggauucuguucaaguugucccaaaggagaagcccaucaaacaacccagucucugugcgagcucccccgggggcauuuacuacucagccagugagagccagguuuccaggggaauagaauuaaacaagguucugcuuuuugcugaagggaaaaaccgcucccuuaggugggagaauccccaggguucuuucuuccuggccagggagggagaagggggugacguuuuauugagcaucggcuagggccaagcucucaauuaggcccuuucuucuuucuucuuaggguaucugugagauaggugcugcuguccuggggagguagaugcagacagauuaacucucaagguaaaugcuaaugaauagaggagccagaaucccaacccaggaaugucugaucucggagugggcggcuucccagcuguggcuuugcauaccgcuagcguagccacccggacccugauccccugacccuuguccuugauccuccaggaaauucucauauguaaccuggaauccacuuuaaaugaacucgguaaauaaugucuugacucuaggccagucauuaccugggacaggugagggggaagggcaaccaccugacuaugucacugucaacagugcauccuugggcugagguuuucauuuuacagugggguucaggcagggcuaauugcugacccaggacuguggccuggagggauuucagggccuucccaugggcggacugacaguagaagacagccccugucagucuaucugaagaaaucagugccagauaacaaugguaccccguggcugaauucuggcugggagugaaauggugauggaguguuggucucaccucaggucagcagggaaaacaguugggaaaauggucagcccuccugaaaugcagcagguggugauuuuuguguuuugagucuuggcacaccuugcuguugaagcaguugaacaaauaaaggaauggaaaaacaggugcugacccaaagcuugagacagcugguugguugcccuucguugaaaaccacacggccaacccagagucuucagguuuggggcgcaguuaagcuguggggcacccugcguaggcucacuguguuuccagaggcuuuaugacugcacacuggggccgccugagacccagguuuauaugugaauuuagcagacaaguaaaaagugcugagucacauuauaaaugcaaauuuggaggaggauuugaaaugcuuucauuaagacaccaaagcaggacacuuguaauacagcagugccaggagaggacaacccugccauucuuuggggaccuagauaaaauggcuccacuguccccugcugagagugagcaggccaucagcaucgcgguggccggggcucagcugccugacguuucuuuggccccuguacuguguugauuucacacacugggcacagccaugcuggcggugucuugagaacacagccaugaaaagauggagaaagcaaacacaguuucugucuuggagcaccacauggauuuagauucagaguaugauuuauuuuguuuuggagaguuuuauuaugaauuuuuuuucucccuucuuugcaaagacauuacagagcuaaacccaaacagcugagccuaucagggccuuggaaaagcauuuuugccugaaacuugaguuuuuccuaaugaagugacuuuccucuuccaucuuuuuuguuugcuugguuuucucauaggucauuugauugcccgccucagaacgauggaucugcaucucuucgacuacucagagccagggaacuucucggacaucagcuggccaugcaacagcagcgacugcaucgugguggacacggugaugugucccaacaugcccaacaaaagcguccugcucuacacgcucuccuucauuuacauuuucaucuucgucaucggcaugauugccaacuccgugguggucugggugaauauccaggccaagaccacaggcuaugacacgcacugcuacaucuugaaccuggccauugccgaccuguggguuguccucaccaucccagucuggguggucagucucgugcagcacaaccaguggcccaugggcgagcucacgugcaaagucacacaccucaucuucuccaucaaccucuucggcagcauuuucuuccucacgugcaugagcguggaccgcuaccucuccaucaccuacuucaccaacacccccagcagcaggaagaagaugguacgccgugucgucugcauccugguguggcugcuggccuucugcgugucucugccugacaccuacuaccugaagaccgucacgucugcguccaacaaugagaccuacugccgguccuucuaccccgagcacagcaucaaggaguggcugaucggcauggagcuggucuccguugucuugggcuuugccguucccuucuccauuaucgcugucuucuacuuccugcuggccagagccaucucggcguccagugaccaggagaagcacagcagccggaagaucaucuucuccuacgugguggucuuccuugucugcuggcugcccuaccacguggcggugcugcuggacaucuucuccauccugcacuacaucccuuucaccugccggcuggagcacgcccucuucacggcccugcaugucacacagugccugucgcuggugcacugcugcgucaacccuguccucuacagcuucaucaaucgcaacuacagguacgagcugaugaaggccuucaucuucaaguacucggccaaaacagggcucaccaagcucaucgaugccuccagagucucagagacggaguacucugccuuggagcagagcaccaaaugaucugcccuggagaggcucugggacggguuuacuuguuuuugaacagggugaugggcccuaugguuuucuagagcaaagcaaaguagcuucgggucuugaugcuugaguagagugaagaggggagcacgugcccccugcauccauucucucuuucucuugaugacgcagcugucauuuggcugugcgugcugacaguuuugcaacaggcagagcugugucgcacagcagugcugugcgucagagccagcugaggacaggcuugccuggacuucuguaagauaggauuuucuguguuuccugaauuuuuuauauggugauuuguauuuaaauuuuaagacuuuauuuucucacuauugguguaccuuauaaauguauuugaaaguuaaauauauuuuaaauauuguuugggaggcauagugcugacauauauucagaguguuguaguuuuaagguuagcgugacuucaguuuugacuaaggaugacacuaauuguuagcuguuuugaaauuauauauauauaaauauauauaaauauauaaauauaugccagucuuggcugaaauguuuuauuuaccauaguuuuauaucugugugguguuuuguaccggcacgggauauggaacgaaaacugcuuuguaaugcaguuugugacauuaauaguauuguaaaguuacauuuuaaaauaaacaaaaaacuguucuggacugcaaaucugcacacacaacgaacaguugcauuucagagaguucucucaauuuguaaguuauuuuuuuuuaauaaagauuuuuguuuccuaaaaaugcaucaagucucaguuuucaaaguguguuuuggcacuugaauagcacacaugauaauaauucauggauauauauggcacacacaggccaccugcaugaacaugcucagaaaaagagugcugcuguaaagcaaaagcuaccagguuaacuuguuugaaaugauauaaaaagaaaaaaucauuugagcacacugcaugguuuuuaaaaaaauuuucaggcaauaguguuuuuggugugggggaugauugcuaggguccagcuaggagagaaggcuggcacagagaaggugccacuugcuucuacuuccugcuggccagagccaucucuguucugaaccugucugaacucuccguccagacaggagaguuucagggugcaggacugguguccucaucuguaccaccugugugcuuccagggccaguggcacagccccuuaaaucucaucugcuaagguaaacaccuccaggggcaauauuuccuauugagaguuuucauuuaaaccaugccaaucagcuacccccuugaggccacacaaugagcgaauccccagcuugcgcauguccuuacuagugguuggaaagagugcucucagaauggccaguuccugcugugcccucucuaacucuaccuggagccacaagaauggcggagacuucaacagacgagucagcugggcaggggcucagagaggggcugggcucccagcacugcccucaccaccuccaccucugccaagaccucucugcacagagagcuguuugccaacccaaaggcagacccagaugcucgucugaccugugggcuugggcgcugcugcuagguuggaaagcaccuugugcaaguccuugccccacagacccacaaugggcagcccugcaguccccaggggcccauagaccgagugcacuacaggggaauccuauuuccugcaaaggucuucacagcuuagaguuuugaaacuagggcuguaacuuacuggaaauauguucuugauacacauguacauccucaggugcauauauacaccuggucuucagugggauucugguccgauaacaaugauguagauagugggauaacagcauacaagaggcaaagauaccaagaagaagggaaaauaagaguagguaggauggcaacauggaaucgggaaaguucu

SEQ ID NO: 12802 - RNA, 2103 nt, Homo sapiens
aagucugagcuucccagaggcaaaccaaauagagaggucaguaauggugcaaauccaucuuaggccuacccugugggugaacaucuugggaaacaugaucuuaagagagacccugauggagcaugccuuucaaggguuguaagagauggcuguagggaaagucgcaugacgacagugccuugcauugagugcaacggaaaacauuugcuccagaggcaccuaccuguacuguuaaauaaguaagucuuuuguggggggagagggggaggauaugguuucuucugugaauguguauuuaucccuggcuuggguggcauccaggcaaauuauuauaaugcauguccacccaucccaaaaaauguguucaacauaacauggaaaaauuaagucauaggagacauaugagaugugugugaaccaauuuaaaaccacucuaggaagagccugagguuauggauuacaacugauccgcaagguaccuuuuuguaauggagaggcaauuaggccuguacaacuggcuccacuaaggagagccagagcaggaggaaauuccgugugaacuguggagcucagcugccuccaaucucaugugaugacgccauuauguaggacagagggaccugcaaaaaaugaagauguccaacacuuguggagccucauuacaaugaguggcugucaacagcuucuuagaaagacgguuccuaacaaacacccuggagaggcagacccugccguaaaugcccaggaggugagccagguuggcauccuaaggucuuaggaaucuugcagcgguuaagcuuggcuacagaaaagaaucugaaaaucaguugaauaaguuaccuuuaaguaaccauaucucaucuucaaguuaaguuacaagguuguuaaaaggucucaaaaucuuucuuaguucacugagcauuuccuuguauggaagacucaggaguuuccuaagaaugcuuugcauaugugcauuauuuuuuaccugcccacuccacuaccaagguaccugcaggaggcagagagaaagggcuggucuuggaggucuuaagauaaacaaauaacgugcaaaaagaugguaaagaaauugaguuuuggguucaaguccaccuggguuuuaguucugacucccccucugugugaguuugaaaaaguuauuuuaauaccucggagcuuugguuuccacaucuaaaauaauuuggggauagucgcguaucuucuucacgggcuggcuuugaggauuaaaucagauagcguggguaaagcguauggcauagugccugguaaccuugugcacucaagguaggguaauucuuaccagcagaugcuuagaaguuauuugucucucugggcucuguagcacuuugacuugccuucuuuuaccacaccucucuccaacuagagugagccugaacugggaaccagauugucccuguacacccaguuuucagcagcucgccgacucuuugccaaguacucaaggcauaguuguugaaugaaucaaugaaugaaugagcaaaagucagagcuucuaagcccuaagcucuuugcguugccuugugcugccuuuagaguuaaugcagugauaacaaacacugugaaagcuggaacaugaucgauuuaaacugauuaaacaauugucucacacuccaucgucaauagauacauuccaaaauuauuacagagagagagcuagaguccaccaacccucaucuuaucaggagacauccuuggaaucgguccucucacgaugucagaucauuuccugcucagugcccugaaaacugagcuagcgaauaguauauggauuuucuuuucuuuuuucugugaaagaaaaauaauuaucucuaugggcuuuuacuuauaaaguaguaucagaccacaaagugaaaagaaaaaaaaaugaaaaggugacuauguucuugguacaaaagcaggcgcuccuggcagucuuggcuugagcucuggguauuuugaagcuccaggaaugccaccagacuggcccacuggacacagcugauuggaagucccuuauguggaccucggacuggcugguuuugaagucacugccaccauccggggugacuccagauaaagaaauuc

SEQ ID NO: 12803 - RNA, 13111 nt, Homo sapiens
ggccagguccuccagggcaccgagaaagccggccagaacggcggcgcccuaucccggccgcagcgaugucugacggcgccccggaacugacggucugguacgcaggggcgcucggcggcaacggcggcuuuaaacgucaucgcgggcgcgacgccugagggacagucugggguuuggcuguccggacggugcagcggcgaggccggccgcgaagaugccaguggcggugauggcggaaagcgccuuuaguuucaaaaaguugcuggaucagugcgagaaccaggagcucgagguaacccuuugcgucgcgcugggagaaacugcggaguagucuuaggcccuggggcggcaccaguuuccaggguaacggggucugaggcuagcgggcuuugggagcucacggggcgggcgugggagguggacguguggaucccugaccgccgcaaccugcuccgaccgggcccggucuccccgaacucgccgggaccuuuuuguuaugugucuucagcuugugagcccgaaaacccugugcgucuuugcuccagcaccuaccgaugagcucauauuaauuaggcaucuuuccuucccaguaucggguugggagaggguaguaaaguggguuuuauuaaagaucuugguauacacacacacacuaacacacacaccgcaacucacacgcacaccaagaaaaaugugaccauuguaaccuuuuuuuaacucacaaagccuuucucguaauguugucaaguuagcuugccauuuugucuucaguaagacagaugaaaguuaugcagcuguuaaaguuaauguuuuucuuagacacuuaaaaaggguuuauaucauuaguuuuaaaauuaaauaaaggagacaacauccagaagcagcagcucacuaauagauaauagauacuuuccaguugaguuaaaauggaaagaauugucuuugcaacgcagcuguggugauuuucugucucuuauucaggacgcuugauguaaugggcagaaucagaaugcuucaggaaucugucgaauuuguuucuuauaauaguaagaucauuuaaaugggaauuugagaacuggggaaggggauccacuuacauauucuugaauguauaaagaaacugaagcccaaagggagauaaaucaaagcugaugacgaauauaaacuuaauacucagaauuuucguguuugauacuucucuaagcuguuucuaaaucuauaauaggacuauaagauuacuuauagucuuagacuaaaaaggcuuacuuuuaaaauuagcauuuauaaaauauuauuuuaaaaaugaaaguuaaaggguaaaugagguuuuuaaaauuuuguguuguuuuguuuuguuuucauuuuuggccuucuaggccccuggaggaauugcuacacccccaguguauggucagcuucuagcuuuauauuugcuccauaaugacauguaaguauguuuaaccuaaagcuaagagcaacagguuucucaaaguuauauggaaauauuucugcacugaaguagcaccacuaaacauaggcacaacgagcuaccuuuuuuauuacaguaauuguuaacgucuauuuccuauugaaucauagguuaaugaauuaugauuaggucgucauugucuuacauauacuuucuagaaaacauuucaauuuauuaugacaaauuacgucaguaaauucauuuaaccuuuuugucuuuuuaagaaacuuuuaugaccucuauuuacuuaacuucauauauaaucaauaaaacaaaagaagugaaaagagaagauugcagccaagaggaauucguuacaaacauguaugagauuuuuuaaguuuuuuuuguuuuuaauuauuccuauuucacguucacauggaaaagucagaaagcauaacuacucuaggccgggcgccguggcacacgccuguaaucccagcacucugggaggccaaggcaaguggauggcuugaguccaggaguuuugauaccagccuggggaauauagugaaaccccgucuguccuaaaaauacaaaaaauuagcugggcaugguugcgugugccucuaaucccagcuaccugggaggcugagguggggagaaucaccugagcccagaaagucaaggcugcagugagcuaagauugcgcgacugcacucuagccugagcaaccaaagugagacccugucucaaaaggaaagcauaacugcaaaaaaaaaaaaaaaaagucuccuauaguucugugacucacugaugauuccugauaacauuuuauuuuaaacucuuccaaaaccuuucuuuuauaucuuuuuaaaaacuaaauugaaauuuuuauuacacauauguaagguuuuuguuuuuguuuuguaaaacugucauuauauguuuguuguaguucaagccuccaaacccauaaaaacuccugccucagaagcugugucccacugguaggaggggcuguaaucgggagagaaguguuguguaccaggcuuauugucagggaaugcuacagccuugauaguacauaaauuuguuuacuuuuauauccuaauaaauaauuugggccgucuauaaauccucguguuuuuagugugcuguugccuaaauuuaggauauggauuauuauuuuuaaaaaauucacuagaaauggcaaaauauuacuuugguaaaaauauuucauguccuuuuuaucuggaaaaccacuauuguuuccccaaaacaaauucauauaaaacuaaauuuuacuuuguguuaugugaaguauacuucuguauguuuggcuugggaccugguaguuuuuaacauuuccugagaugauuauguuuuuaauugauuauucuucuuugugguggcguaaauuaggaauaaugcaagauaucuuuggaaaagaauaccaccugcuauaaaaucuguaaguauccuuuaaaccuauuuuacugcuuuaauguaaugacauucccuuaaauggcaaccuuuuauaagcuuauguuuucuaucugacguccuaguaauagucaucagauugguauuaaggauucgaaauaaaucuucagaguccucuaaucagaaauuugaauuuugcugggaugguguagaauuucugcucaguuccuacugauuagauuucuugagacgcuuuuaugugcagcuucccuaguuaaacagcugagccaguuuagaugaaggaagcuccuggagguggcggaggcagcugaggugauuuucagcugguuuauguugcuuccuauaaugguacuuauuuugaaacugccaucguuuacaagaauacucuaagaaugauugacagcaauaagauuauuuuuguuaauuaggauuuuaaauuucuuauuuugguugggagauuagaagaaauagccugugaaaagguucuuccaaaguggaaugaaguaaaauuuuaaugucaaaugauuccaugugucuaacaugagugucaagugaaauuuuuaacauucucgggauauuaccaagaauucaucuaaacuuuuguuuauugauauucaucaagagaucggauuaguauuuuuacucuuuuuuuuucccucauacauucuguucuguuaaguaagauuggaauauuccucagcuucuuuggcuaaauaaagaaguacuauaaaucaugcacauaaguuucaauggcguuaguggaaacucaauccuuagagaggcuacaauguaugacaucuuagauugagagucucuauuguuaaccauuuugcuauuacuuuugaccuaaauauauauucauaauauaucuaugaaauacaaauacaacaucuuuaaaaacaauccuuaagcuaauuaguccccaggcuuaauucugaaauguuuuuugacuacuuucucaugccuuaauuugcuauuguaauaaauuuauaucagcccuacagauaaauuuuaccuuacugcucauaguguuuaaaaaccuuuugauagugauugggcugaaaaaguaauugcaucuuuuaaaauaaauguugaauuagguuuuaaugauguagcuaacaaguuuuuauaucauuucugguauuuuguuuuaagauacaaucauuggugcauuuacagagugaauacccucuaaggcaauaauauuuauugcaggcaaauucugaacuugggggaauuuggucaguaggacaaagaaucuggcagagagauuucccugggaucuauacaaccaucaacgcucaccaguggucugagacgguccagccaauuauggaagcacuuagagguaguguuucuuugugguuaaaaaugaaauuagaugagacuuagucccuaagugcugcaguguugaaguaauaaaucagugguguguguuuaaguagauauuuuugauaggugaaaagagcaguuuucagaauuuuuuagauuugcccuaaucaugcuucuucauuuuuuguugcuugagauuacauuggcugcugugcuuuuguuguuucuuaauucuagacagaaauugcucgucaguuuuaagaguuuuuuuugcuauuaaaacgagaucuuguaauauucuaauaaguuuaagguauggguuuguagagaugugaaaauagagacugcucuuugaauuuugucagccucagccuuugauagguguugucuuaagcuucuggauuuuauaauuuaucaguuuaauacauagaugcucaaauguguuuuuaauugcuuugaaagauuacaagccuggugugacagagcacugaucccacaauaaaaucucauucccugccucucuacagucucucaccccuagcauuugcuuccaguccuccugguucacucuuuauaaaauuauauaaucuuguuuuauguugucauguacuguuauuucuuauuguuacccuuacuuccauaguuaauauccaccuucacuguaugccuuccugcuguggaggaagucagugagcaggaauuuuuuuaauaacuguucaucacucugcuaagggauaucagcuuuacagggcagcagacagcagagauuguuucugaaaugcacauaauucccuuggaaugguaaaauucuuagcagcauaaaacauaacaauguaagugacagaacaggaggcagcuacuuuaaaugugaaugaaaugagcagaguccuaaggcaggcagauagaugggaagggaggaguguggaagaagauugcacagguacagcaggggcaguuucagaaaguagcaccagaaaccucuucauauaagcccugaggaauuagcguuauaguggacuuccauaguauccucgugauucagccuugugauugugguggggcggucacaggccaugugccuuuucccaguguuuuacagcggguugauuggcaggacugggcuugggaacuccuuacucguucagcaagcauucucuugugcaccgucggguccguaguuuuauuccuucccggagccgccucucacugaauuccaugagauugagaauuccuggcaagcaguucaguagacccaggaaaggcuauauagcguaccaugcgggaguuuaagcucuggguccuugcuuccggaguucaaauucugauucugucacuuacuagggugacuccucagugucuuauuuuccucauuugugaaaugugauuagaaauaguacuuuuucagguuguaaaugaguuaauauauaaacauguaccuuauucuaaagcacuacaguauuccugaacauauccugagacuuuuacaaaucuccagauucaugaaugguacugugguuuccuuuguaaaaugcagccaggucaggauagucucuuaacagauuggucuuacugaugaauuuaacauuuugcuucuuaacuuauuagaaacuuauuuucuaguugagaacaaucacuuucuuagaucucuuuccauucucuucuaaauuaggcacaguccuauuagaaaacugaaaaugacuuaagagaagcuagugaaaacuauuuuugcaggaaacaagggcugaggaaguacuuagaaacuagguagacaguagccauucucaucugaggcuugaaagggcaaggcgaggggccaguguuacuggggcugccccacaggauggauacagaaggucagcuggagcaaggcagggaaagggcauaggaagugaauucccugaccuuccuucccagccucugaccugauagagccccaauucgccaaagcaagagagcucaggugcaacaggcauuggcggccaaccucccuggcacacagcauggcugggaaagacagaagaggauucgaaaggaugggagugacuaguucaucuucccuucugucuccagcacuggcagugauggaugagcagcacuugaguauuuguugaacaacugaguuugcauucuguuagcauuuguuuucaccaaaaauguguuccaucaacuacugccacagauauuaggugcuggcucaauuuauuccaccuuccagcgugucauucuagggccugagguuacagauuucacaacuugaggaucacagagugacuagucggaauguagaugugauucgugccaaguggauauugcagcuucugagacagagaacacuuagccuuuauuuuugcuuugucaacucacuucucccaucacauguuuuucuuuccuuuuccagugauaucuuuuuacuuuucucucccuuuuaucuccuccauucuuacuguauuccuguuuuauuccccacucugaaaauauggccagaauauuugaacugaaguaaauguuuuugaaauacaguugacuuaccaaaugaauauaguuuuaugguguauacuuuuacuucucuaaaaaaaaaaaguauacuuuccauuguuggcucuuuuccauuguuggcucaguucuuuuccauugaauguaugcagccuuaauagaaaacguuucuugguauugcaaagucuguuagguuacaggcugguugaaggaaggaaggaaccuacaauaauaaguguaaagccacagaaggaagagcagacaguggcugagugaaagcuggagaggaugucgggcucagaugaggggaagggaugggagugucggcaguuuuuaaggaaucugagaaaacaaagccuaaguguuggagucgugccccauuuugguccucgugaugccaucaacaagcauguauuuggcauauauuucacuggagaugcuagguguuugggggacuuugaggauaagagauaccccuuccugucgagaaguuuggaauauaauugaaaagaaggggauagguggaacagugucugccguaguggaaaguugcuuguuaaaguagaaguguaaacaauacugcugaguuuagagaagggcagagaucguaaugaauuauaaacagacuuaggaaugguagagagcagacaggagggcauuucaggccacgggauagcauaaaccaaaagccccagggggagaagguguaagacuugucugagagccaguggacucguuuggcacaaaggguaucugggggaauugguguaguuugacaaugucccaggaauggagagaagauuuuaaauauguuaggguguuuguuuuacauauguacacuggccuauuaaauauggaaaguaaaauccagaauauuuccuaagcauguugaccaccagguggaggagcucuugcauuaccaaugagcaaugcccagggagaaaggccagcugguuucacagugcucaacucuaccguacuccugaguuuauuuaauuggguauggaagccuggggacaauccuaaaugccacuuucaggaaaguuuucguugcugguauuguuuggcagucccuucuuagagucauucuuucaaggugggaauuuaggauuuugaaccuuaauucagucaagaguuugaugcagacuuggaagaaugcuccaguuacaagauuuguucuguaacucccaggugugguccuguauuagagacguuuuugaaaaggacagcugauuacgcaaaucaguuuucugcuccuuugauuccagcauuuguaaaugaaauaagauaaguaaaauuuauauccccauugcauaaacauacugcauuuucuuaggguuagagccuuguguuuaguaaccuuuuuccaucuuuguaauuuucauuaucugagauuuuucauccaagaggaaguguaagaaauguauuuuuuuccagcaauauuugaaccccccguacauacugggcauauguauuuguaucuauaagcacagaaaucuuuggguucaucuggccuugcuuaugaaaacuagacaaggacaguggugugauuuaacaaugugcuuugaaaaugcugcucccugguucacucucugccaacccaccacucccacaauagaugcaacaaggagacgcgccuuugcccuggucucucaagcguauacuucaaucaucgccgaugauuuugcagccuuuguuggacuuccuguagaagaggcugugaaagguaauuuuggcuuacuuuuuacuuauaaggaaaauggaaaauagaagugugaauuguagguucacagucuccucugaaacacuuggaacagaauaugcuuuuggaguccaggcuguguuuuuugagaggugauaugaaacagguguuguggaacacccagcaggcacccugcagucaagcauauuaauaguucuauagcaagcaaaugugugaguauccacacaguugguuacaaaaauaugucuuaauuggucucuuuacucauauuuggaaauccuuauuucacccuuauuugauaaaggcagcaucauccccacgucccuuuucauuuucccugccauuucugacccauacccuaggcgcuugcuugcuccccacucauaccugcuggucucuccaaauguaacuuugcauuuucauuucucagcugaugcccagacuaauccuuccuguugcucguuguuauagaauacuguauacaccuggccaggugcaguggcucacaccuguaaucccagcacuuugggaggccgaggcggguggaucaugaugaggucaggaguucgagaccagccuggccaacauggugaaagcccgucucuacuaaaaauacaaaaaauuagccaggugugguggcaggcaccuguaaucccaacuacucaggaggcugaggcaggagaaucgcaugaauccaggagguggagguugcagugagcugagacugugccacugcacucuagccugggcaacacagugagauuccauaucaaaaauauauauauauaucguauacaccuuguugcauuguuuugccaugauugacauuuuugauucuccagcuaaaauaugagcaccaucacgcacuacauccuaaauuuccagggccuagcauaguuguagauacaugaagauagguuaaugaaaguucuaaguuauuacuuuuauuuacucauacaaacauuuauuucuuuuggcucuuaaaauugguccaucauuuauuuucuauauauaacauacuucagagcucguauucucagcugaccaccuggaugugaaugcugguaccacccgucccugaugcuaguggcuaugugacuuaggacaaaucacuugaauuucccucaacuuuauuuuccauaccugucaaacgauggcccuauaucccacuucauagaguuguggugauuacauaaaaucaucccuauaaaagcacguagucugguaccuacagguaaaccuuccauauauggaagcuguuuuuauuauugccaucuuuguuauuacugauaugauggucacaaaaggcgccauaucaguuuuccuucuguuuguuuuaaauaauacugauuagguuaauacuauaauauauucuugacagaaaacuaaccaucuuuuaaugauuauagcaaccuaauagaguaaaaugaggcuuugauaccuguuucagaaauauuucaauaauaaguuuccaugcucuuuguaauauaccuuucuaguaaaaaugcauaugacggguuauacuaaacacaucaggucuucuguacaacuaaugucauggacaaguuguggauuuugugggguguuuuauucuuuccggaucuuuauguguaauauacuuuuuuaggcauauuagaacaaggauggcaagcugauuccaccacaagaaugguucugcccagaaagccagguagguggagcuuucacccauuuacgcagcacuggacucuucuaagacugcuucagguuuucagucuuugguuuuugauaauuggauguaaaauucggcuauacuaacacaauggaaauaacucauuuuaaauaaagcguaguagacgggguagaaaggaucaccuaguuuaaacucuuaaaaauguauuuccuguauauaaaugauuuuacguagguuuuucaugguccuuacaccuuaguuuuuacuaaauauuaaucuccauccuuuuauggagccauuuguaacugagcuuauccuucauauccaagcuguugucuguauuaaaaaaaaauguuuaaauauucaacugccccccuuuucuguuugcacucaagucauacaggcacuuuuccuguggcuuccacuuucacagaguuaacuucucuagcccuccuuuuaaggccuuaauuucuaugaccugcccucauugucuuuaucugaauucccagccccucagucuuccuguuggaagugagccacacucauucccgccugauaguuucucuuccuccugcugaccaggagugucuuuucugccaggucuuuagagccaagcuuaaugcccacuuccauaaacccgccuucauccacgucagcccaaauuuccuuccaccuacucggaaugccuauguuuagacauugcugaacauacaguaaaggauucucaaugugcucagcccuuugaguuacaaagagugagaagacaugaucccagucaagugagauagugggggaagaguaauauaauaaagaauuauaauggagcacaguuguuaucccuguuugagaaauaaauggccguuaaaugcauguugugcugaaaauagcauguucuaugaaagaucuuuacaaugacuucuguaaauugagcuguacauuuuuuuuuugaauuuaguugcaggggcccuggauguuuccuuuaacaaguuuauucccuuaucagguauguauuuucauaugcacauuuuuuaaugucucauuguuccuaauuucuuuuuuguaguauauauguauaugugugugugaguguguguaucuauuucuuaccuuguaaacagagguuaaauuucauaaaugcguaguaauacaucugguuacaagagugaaacugggcucccccagagcuugccuugaggcggugcccuccucugggccagcugcagagccuucuuauucucaugucagggaggccugccagagcuguucaccaguacuguuauucagaaggcguccccaggcugacguguaguaauuuaaauguuggaauguaaauuccuugagguucuuuguggguuuucuuuuuuuuuuuuuuuuuuuugguuuguugacaauuuaauauucuucagugaugucuggggcaugggaagcacucuauuucuugaauuuaauguugcauggguaaggauguuuucaagaagagcugugaucuuuuaaaagacauguugcaugauaaaagugucuuuaaccuuuacauagaauacuucaguaacaacaacaugagacaugccuuuacuagcaguuagguaaaaccauacucauaaaaguugcaacuucuuggcuugcuuuucaaaaauguccaagccucuaugauguaagauuuugucuaaaaccaggacaaaucuaagaaaguuaacuuacuguuaaaaauugaaggcauuaggggagguagguguuggggccaaagcuuuguuacugugguauguaacaugaaguguguuuguuucuuuaacauacagagccugcuccaguucccccaauacccaaugaacagcaguuagccagacugacggauuauguggcuuuccuugaaaacugauuuaucacucugaguucaagauucaucuucagaauccuguauacugacaaacguagaaauguaaaguuuguauuuucaauuuauuggauggcuuaagcaccucagcauuccuuacuaugugauaaaauacauauagaauauaagauauacuauauacauuuuguccauaaacguuaugcugaauaguuguugaaacaguucucauuuuguaguauuuaauaaucuggauggagccugucaguauuacaguuaguuuucuagugacucauaaaauaagauuuccuguuucauguagaauaguguuugucaacugucuuuucucugucccagcacaugccguacucuuauauguaccauugguugauaauuauaaugauucauuuggacuugaagaaagauuguccccaggcacaguaucugaaucacuggggauuaugauucacccucuuuggagaacaugcucucuuuucaccccccaccuccugagagccacuaauguaagauacagaaacauagcugaggaacaaauagaccauuuccauacuaaaccaguuuguuaacuuuagauuuuuuccaauagugugaguauauccauugcuggcaguggagggcuugccaugaaaaugcaacuuauuuaagacauuuaugagacauauuaacuugugcugucgccuuuuagaaggagaaacuuaaguguggaaugcauuauaugggcaaagaagcuaugaagauacaugauacacuuuguacaacuauccugcagcccauugguugcuuauauuuaucgcuuggcucaaguucugcccuuuggagaaauacugagcaagucuuucauucucugugugacagcccucugaauauuugaaguuguuuguuguaacuuaagguuauaacagcccuuaguucauuuacucugcauuuguucaauaaauauuuaacugaauucuucaauuauuucaucuaagauaguuucuggaaauuucacucucgaucuuucuguggacacaaucuauuuugucauugugucuauaugaaucucuuaaguagaaaugaguuguauggugaaucuguguagugauaauuauauaauuuauuuauuuugaaugcauuuuaguggcu

SEQ ID NO: 12804 - RNA, 90166 nt, Homo sapiens
cccaggaaacuuucaauauacuuuauuaaaaaguuucuuuguauaaauuuccuaaacauuuuaaaauuaaaauuaaauccccucccuccagcacacacaaaaaaaaaacacacaacauuagaggaaugccaaaaauauucucuauuacaacuuuuuuaaauucuuuaauuaaggcauuggucccaacggugcacauagauuaagggauuuugcuuccuucugaacuagaucauuuguuagaggcuucagaaaaagaaaauuagcuugaaaucuagucugggaaauugggggcagggaaugaaaaaguuggucucuuguuucuccacgauacacaggcuucccaucuaaagucaugcuuaacuaaaagggaaaaaaaaugaaccaagcaaaaguauauagaguagccgugacauuugcauuauuuucuagacuuuacauuugccugcaacaggcauaacaugaaacuccagagggaauuuggauugauaggaauguucacauaaacaccagcaguggcuaacuguuacacaacauucaaaguauucgagagaacugccuggagacagagagcgaggguccacagacacauuagcaccauacugauaggucaugcagcaggauguucccucccgaguucgaguguaaaucaaagcaugaaaugauacagugcaagggaaucuacacccggagcuucuacagagacaaguuggcgauggcugacuccuucuucuucaagagguauaugauguuggccacccacgcuuagguucccaucacacugaugacuccggguuuggcgagcacugagcgucgagagaggggguggguggggugaggugaggagccgagagaagagaggaaaagccacauuacugacccaaaagggcacugucauuaucaugacacagucccgcagccucugguuuccaucaccugucccacuuuucuacucaguaccaucaaaggcccucugugacguucuuggccuggggccccggggcccagggaugucugggaaaucugaucccauucuuuugcccugcaccaucuaccaggccuuuauacgaacugaacucuccccauucuggcacugaccccaggcucuguucaaaguguuuauuuuauuaccaguugaacugcacaauauaauggagauacuggauggccccagugacaacauuguuauuuauaggaagcaaaacuauuuaaaagauaaauuuguggggguuguuuaucuuuggcguuaucuguaguuguucauuauauuaucuucccaggaaucauuuuuggugcaauauuuuacaaauaacagcaacuuaguaacauuucugaagaaugacaagggacaauauguuuuuagaaacccaaaauaggaauucaaaaagacauuucauggguuguauuugaacgucuuccuuaucugaggauacacuuuaucuucuuuuucacauguaucauaaucauugcacuucuaauauuuuucaaggugacuuauugaccugaaucucuuauuugcagaagccauaaacacaaggaagaaucacuuaccaggagcgcaaaccuuuucacauucuuucugugauccaaauuuguuuucguuuccaccacaaccuccauaccagaaucuugcacagcuuuugguguuuggaucauaguaccauuuuaauaugaaaucccugcaaguuccuucgucuuucggcaacuugcauauaucuuuaauaaaaacaugagaaaaggauauuaaugagaacaugcguguuacucggcucccagugcuggggcugacagucugaugacccuacuguggcagaaggaaaaaaaagaagagcuuccaggugaaaacucccuuaaccugcucaaaucuccauuuccucacugccauauggacauaggaauugcuuacagccuugugagagauagaugaaauuauaucaaugaaagggcuucauaaacagcacucagaaucccaaaugcuggcaaugguuauugaauaauuuuaaaugaaaugaauuguuuuuccccuuuccaaucacugggccauuugcccuccaaguccuuccauguuaaauccccagaaaagaaacugaauuuuaaaaccucaggguuuuauaauucuuggcaaaauggaaauucgauucuguugggauauaguucaaaaauaaggcucuaccuuucauuacaagccaaguagacugaaaauuaaagguaaagcagaaaagaaaauccuuuaugaguguguguguguguguguguguguguguaugcacguaugugugguagccaagagccuuugugaccugccaaaugaaacacguaaaacaaagagcuagcacugauguaaaauucaugauggcaaaaaugucacauagcagaacuauuuugaagacagagaagcauucuuuucccaguuaaggaaguuuauguuuccaaugcacacgucugauguagcccagcugcaaaguaaagcaaagguccccucgacgccuggagagaagaguuuacaguucacacacagcacgacuccuguuuacagaguuuucuggcaaacuccagauuguucugggaaagagaagcauugaugucaacuguuaucuguaaguuugaaaacguaaaccuucuuucuccaaaacucccuggagccaauaauucugcauguuccugugaguagcuaacaggcuggaauuauccagcucuccccuacaaagagaugcuucuccaucuccuuuguccccagcgaggcaggcugcucacagcugcggagguggugagcaucugugcuucagauagauaccaaaaaggacaaggaaaaccuaagucuucaguggauaaucauagcuuggaucacccacgauggaccagacucaaaggugcacaggacugaggcucagaauuggucuaaaacauuuccugguugcugcugucacccaaauuccaggcugguggcugguggcuccacaguuacaacaccuccuaguugcagacgcucucagggcccagaaagccagugguccccacgagagccuuugaagacuccaggaagucagaauaaaaugaagacaauuuacaaaaacaaccuucuuucucucaaauaugccaauaacugaaggaaaaugccuggcugucaaggaagguccuggagagaacugacaaggcaagguaauuuaaccaucaaaauuuauuccucauuuacugguggcuucccuguuagcgugaggccggcgucaaaugaucucccuauucuuccuuccuucccagagcguuggccaauggacccuauuugcucuauuuuauuuguuucaagugcacuucaguccugaccaucuguguuuagcuguucaauucccaguccccugggcucugcugaaccagucacgagaggucugcccagagccacggacacccagcccaugaguggccucacagcagcacacuccacuccccgucugauuggcuucuccagcuuccuuggcccuccacccuagcccuccaguuccacaccacggcacugguguuuucugcccuuauuucagugagagucacuacugagacccuguaagauuuacuaguggaaaauaaggacacuguuacuguggacaagaagauauuuggaaaaccaagagaaauauauuagugaggugagaacccggcacuauucaaagacaaaaaccuguacuucucuacuucugaagcaugaaaacggaggauuuuauguucuuaagaaggcuucuaaugcaaacuccacauaaucuugacuucugagacaugucguuuuggcuggacucuacucagcuaugagugcauauguuaaagcaacuguuuuaaagcaaaaaaaaaaaaaaguauuuaaauguccuggaguaccaagggagauggcuggcccucguugaacuuaaccuggacuuuucccuagaacgacacgucuuuggaugcaauaguuguucaucuuuucccucugaaaucagucugccccccagguauaaccuguaggaagcuagagccuucucuuuaugugagaggagcgcauggcugagucuuccuuaauuugcucuucuuuauuauugagaaccuagugggagccuaaaagacaauggggacugaaaauuauccacaaccuuccccggcuuccuaaccuagaauaccaauguaacuaaguuugcuuggaaaacagagaggggaaaggcugccugacucagaccacugucugcugaaacuuccuuacuauuggucacugggcuucaggaaaguaaccaaauagaagagaggaaauggaggcaagcacaauguuagguuaaaacccuguucugggaaucccaccuguucccagaagccacaggugccuaccuagaacauccuaaaaacaaccauucaaaaacacuggggcgcaaggcacccuaagccccacaguccauuuuuguaauaaugaugugcaggaguggaugugcaugugcgaugcaugcaccuucccacaagcaauaauauucauagaaaaaaauaggaaggcuaugcaucgggucacuauugguuuucaucaaaagccagcaaugcugucacaaugagaaucguguaauauauuucucuguaccuccugaaugcuugacaaugcauaucuguuaacuuuauaaucagcaaaaaauauauguauucuucaaaguggaaaacauauugauuggaaaaucuugucuuuuucauaguuugauauucccauaguguuucaaugcauuuuuaaaggcaucagcuuugacauuucccaaacauauugauuuccaaaucacgauguaaguacuuccuugagcaaacugaaggaagacagacugagagguguuuaugcugcaaucaucaacauguuccucaucaguuuaaugguccccaaaacaagaaaauucaaucaccuucucacucggcauuguuguuacaguauaaaguacuuccauaccuuggaugcagguaugauuugccugaaugaaaacacuuuccgccgucuacauuuugagcauuggucaguucaaaggguaccaaggaaacuuaccaaauuuuuaacuuacuuaauuuauuuacuuauuuagauacugagucucacucuguugcccaggcuggaaugaagagguaugaucucagcucacugcaaccucugccucccagguucaagugacucuccugccucagccuccucaguagcuggauuacaggcaugagccaucaugcuuggcuaauuuuugcauuuuuaguagagacaggguuucaccauguuggccaggcuggucucgaacuccugaccucaagugauccuccugccucagccucccaaagugcagggauuauaggcaugagccaucacacccggccaauuuuuaacuuuauuuuaaaauguagcugugguuaaauuuuacucuuucagaucuugaccaacagacuucuauuuuuuaagacuucaagauaaaaaacacuccuuugggcucaucauaacccacacaugacaacuaaccagaaaacauccucacacagcgaugaacaacagacagccuggagaggaccauuuccuaaaucccuguagcuauuuaacuuacuucagcugugggauuaguuuguucuuuaaauuauuauuaacauaaagucagguauuucccccaaauauaccauuuuaugcuaauugaugauauauauucacauggaacauggccaaccaaauacuguauuguauccaauauaagagcucuuaauuuuaugaugcaccauuauuuuauguuccacuaaguaacacaaaaugcuaccaauaaaccaugauauauugucaauucuaagucacauuucaguuucagaagugucccaaugagaagaaaauugugcaucuuagaaucaauaaguaaaacguuaguaaacacaaaaugaugguuccuucagggcuauacaauuggcccagucaugucuacucggacaaaaugugaucaguucuacagauugcuaauuucaagaauaaauaauaaaggacauggugauuuuguuaguuguuuugucuaguuucugcauugaaacuucuuuaacacaggugauuaagccaauaauuuaggauucauuuugcaauacugcaaaaaguaaauuuuaaguuagauuuuuguuguuguuguuguuguuuagaaauucuagacagucuuagcuuuaauaguaauaugcauagaaaauaucuauccaaagcuuccuuagcuaaaaaugagaagggagaagagggaggugguaacaaaagccugaaaccaaaauuagcaacuacguagcacugucaaaaucagcagcgacaaagcagguggcagaaaggcccagcacacccaugcuuucaggaggccacgguaacgaaugaaagauccacugcugcucacugccauuuacaggcagcagaugugugacagaaaaguggcuggagcauaauucuuuuagaugccgagcaaagcaaaaaguggagugagauguuuuuguggggguucauuugguuuuauuuaaaaaaauacaaauauuaaccacugaaaaucaaaucauguaauauuguaaagcuggaauccugagugguugcuaacgaugcccuagguauauuaauggaaucaaggccuguuaacagaaucaaccuucaucucaaaggcgagagucucccugccacauaccaaacagggccagaucuuauggaggacaaaaaaugccccaaccagacugcccucgcauuacaugccugacucacauuccugauaaacaagcaucuauucaaugugacugucaaaaugggcaaacauuaacauaugcaaacgaaaaccaaugguaacacugguccucuccucuuccccugccuuaggugcccaggacuaggaaccuuuucauuucagaguguuucuaccuacaaauuccuucacagauucaaacacaggucaccagguucccagaaucuaacaugauaaacuaugaaaaauacagauucuuaagacagcaucuuuuauucacagaaguaaaaaagcaaacaguagcaucuacuauuuaauacuaagaaagggacccaucucuguaaacauguuucuaauuaauggaugcugcagaaaguaagaggaaugaaaauggacacauguaaauauaaaaaauauauuuuuaaaacuucauuuugccugaauggucuagaaaauguauauuuggagaaauaaugcauaucguggucauuggaauuuggaugcaaaauauacaugcaacuacugaguaagcaugcaguuauuaucuuuuuuuaguuauuuaauaaagagugguucauugucacuccuuuuccuauauccaaauauauaaaaaccauuaaaaaauuuuccccccaccccaggggaaauaguuaaaaugacaauuauaggagaaggugaggaggggagggagagagguugguagggguggggaggauaaggauuccucuccuaauucugguuauccauuuugaauuuuagacauuuuuaaguaaaugucccauuuauuaggucggugcgaaaguaauuccaguuguugccauuacugucaguggcaaaacugcaauugcuuucgcaccaaccuaguaauucaaaaagagcucucaaaaaugccauaacuguguguacaccaacauauauucaucaggccaaggcagguuaagugcuuguuuguuacuaugaagucauuaaguuuaagagaucagagaucaauuaugcagggccuuguucuuuuuuuaaaaaaaaaaaaagguaauuuaugucuucacccugggaaggaaaacacacauaugcauguguacacacauacauacacagacacacacacaugaaauggugagaggacauucacauccugggucugaggguuaugccccaauuaguaugaaggagaaagguuuuauuuagauucaucuguaucaacuacuugcagccuugaaagaaacacaagccccaauuucaaaagcucuuuucucuuuaucacagguagacaggcgaucucaguguuaaaggucuggaucaaaagcaccuucuuaauucugaaccucacaacucucuccccccaucucucucucucucucuacauauauauauauauauauauauauauauauauauauauauauauauaugaaaagaaaaacaaaacagcccagccagacccuugcugaaagacauuguuguuuauaugaauuaggcacuguuuauacaaucuugucccuuuuggaccacacauaagagaaucaaaaacauccccaaaucuugcugucuaguuuacucauuauugaucucugaucucuaguuuacuccaagucuuuuucucucaaugaagcacuaaauuggcuaaaauuuuucuauuucccacacuguauucagggagaaguuaaccaaugagugagaaaugacauacacagauuucagcaacuuugaaguuagaguugaaucuguccugacccacaccuuuggggaaaaucuacuguguucuuuguggcuucucuuugagcucaagcaccaugguggggucgccuaacaggcucacucaacaaacaccuuuaaaaucaauuacagaaaugagcauugugaagagaaaugcuuuccuccuccugacaguagacgauacaccaaaaaauaaugaauuguccccuaguuagcagaaagcuuuugcuucagguguauaaaacaguauuauaucuaaauucccauggcauuuccauuuuuuauguuaguaccaucauucuuugcugaacacucuuaagcaaagccuaucaacuauuuuaauaaucaguuucucaccgaugaacaagccaaguccacauucugcugaaugagagauuccaggucucucagaguuucacugcccaagaacaaaagcaaguaacagcugucaguuccugaauuacaccuaaccagucacuaacuuagcauagacuaugcacacacucugggguucaagcacaugagagacaguaucacagacucacacacuaagcuggggugugugcuuaggauguccggaccagaacaccccaugggucagauccaaacccaugcauuucauggauuccagccaaauuugucuuguguucuucuaagcaguuuuuuuauuagauuaaaucacugaguaaaugaaacgccaaucuucacagcaucacagaccacaaaucaacucgagucccaguaugaggcacaggagaaaugucuaauggauacgugaauucuagugauagccccaaaagcaccucccaucaaauuuucacugagucugaucacagguaaaguaagacuccauuuacaccugggauuaugcagaauaagaugauguugggcugcacagagcugacguggaccuuuucccccauagaagucaugccugggcuaagacuuagaacccaggaaguuaaauuggaaucaagauggguauuuucuuagugccauuaauggaccuaauaguuucacaacucaccuguuucagugagagccaaugguucugugcucaccauuagauugaugguugaacuagaagcugaccuugcuggcuguggaggugggggcugagauuucucuauaaaagaaaaauauaugcaacucguagguaaaucagaaacaggagggcuugggaauccuuagugacugauauaagguugccugcugugauuaaugucuuauguuggggaguggugauugaaagacacagauccaagacaccucuacauccacgacuuaugcugugggcuacaaguuggauccaugagcuaauaagcgacgggaggggaucccugaacuucugaacaaauccucucacuucccagacagccucuucugcugcuguccaggaaaauagagcccuaggguugacugggucuuuggacucauaucucuaugggccuaauccauggcacuggugggaauucccuuuccucaagcugguuccuugaucugaauagcauuggccugaagaaaagaggagccuucccuucacauuccuggagcagugggggucaagaagaaugggaggggggaacccagaagaauuuagaaagaugagagaggggaccaugaauaauuaagaaaagcugugacagcacucaagugcaggccucagugaaaugggggggccccuggggacaacagccagccaagggcagagcccaacuauggugagaucagggcagggagacucagcuaucgacauccuccacccccggggcggugagacuucagggacaccuccauuacucccuaaggagccagugacuggcugguguuuuccugaacauggaaaccuggacgggguggugggcaaccaggagcccucaccgggagacguggccaucuuucccgggugcaauguuggaaagggcugugcucaggcgacguggaucuggcuuccuccaaaaaguagcccaggacccagagggcaggacugcaucccacauggaaucccauuuccauucuguguuuuauaagcuuaggcugccaccaaagcacccaggcugaguuguuuuguuguuguugcuguuguuguuuuuugaauuugugguuauuucagaauagauucaauaaguaagugucuccuuuguguccuauuugauacucuacauagaaaucagguaccgacuuguacugaucauguacuuacuuguacugaaacuuccgugguagguggcucugaccugagaccucagguagcagaccacagccacaugguaugucugcccagcgagcaggccuccaaugacgcgguccgugaccgugagguucugcuucagaaccagggacugaucaugggcugaggugacggugaggucauaaaaauaaggaccggggggcucagcccucucccaguggaguuuggcgcuguucucuguuaucucaaacaccuggacuucacgggacaucuuaacugaaagauagaucagagcgugaagauaaaaaauaaaauccuccaugacuguagugcaugagcgagagaggaaaucugaaagggauguguuaacagacaaauugacuugaaauuuagcugaggcggggaacuaauuucuuguucaagccccuaaaaaacauugcucuuauaaucuaucagcauacaugaaaugugaaauucacaguaaugaaaaaucucauuauucaucaacuuuuuuuucuauuaaaaaucucgccuguuaagaagauacuuuggaaaugcagcauacuaauccuaaguuguguuugcuacaaaaugagccccauaauuuaaaauauauuaagucauaaaauuuuaggguaugacaugaaauucuuuuaaaggaauucugcuuucucucucauacuguucaucaaaugaagauaauuuccauuuuaucaugagccuuccuuuacagcuugugacauucgguagugucuuccaguaucuucuuuaggaaaaugauaaaauaacauacucuuggucucauuaaagccaucuaccuuuuguaucuaauucagucugaaauauauuaaguuggugcagagucauugugguuuuugccauugcuuucaauauuuuucucauggucagcaugagcauagauuugagccuuggggaaugacugaugguccaggcucugacuuuucaagcugcuggacugaacacccaguauugccacagcacacagcuuagggccccuuuucuguggguaugaggcagagacaaaguuugcaguugcaaagggcucccccagaccuuuucaaggcauguucuaagguaggcgaguccggcuccauacaccagcccagaaacaucugccuugcugccuaagaaccaacugcagcguuuuucuuucugucucucucacucccuaaauaggagcuaaaaccuuauuucaacacggaaacuuuucccuuuaguuuaagacaacucaauuuucaggugaggugaacugugcccccacugacauuccagagagaaugagagcuucccaucccuaucgcaagacaggauugagggcacaggauggggagugggaggcuggaaucccuaaccaacaccucuuaaaauacaucauccagguguacaagcccagaucaaggacuguauucugaguguguuacaugcaggcuuugaggaacacacccuggagcaggaaaugaggaugucacaagauggcagcccuagcaagggcuuucuuacccaugggcuuagugguggcuggcuugguggcagcugguuuggcugccuguggccuagggaccucaggcuuggucgccacugguuuugcagcagcagcagcggggggucuuacagcugcuggcuuugcugcuacaggcuucgcugccguugcuggcuucaccgccacugggggucuaacaguggccaucuuuguggccacaggcuuggcagccacagguuucgcaggggccggcuuugcagcggcuggcuucacagauggcugauuuauaauagucacaggcuuuguuguggugguuacaggcuuuguugugguggucaccggcuucgucguagucaccggcuucguugucgucacuggguuggauguaggacuugaaguaacguuauucggaacauuucuguuaagacaaauuaaauauuaccucuacuuuuaccugcuaucuaaaauaaauaaagacauaaccccaugagcuacauuaaauuuguuuuagcaaaaugcaugcaauaguuuuuauagauuauguauagcagugcauauauuaaauuccuucuuuuaaggaucugugccucccuaaaaaaagauauggaacagcauauugaaaaauagaaccauuaaaaaugaagcuuauauuguucuacaaaaacaucuuucaauuucuaaaauaaaggcagagagaaaauaagagacaauaaugaauaauauccaacaauguucucauuauagcaauuaaccaaccaaaacauacaccaaaaauuaaaugaaaucaguaguuagcuacuuacauuauaagaaaauauccacucaaucaaaugcuauguugagcuggaaaauuauaaaguuagcauguacuauuuugcucccagggcuuauuacugggaguauauauauuuuuuauuucucuuaauuuuuguguauguguauuuuuuuuuacaauuucuugaucuauuaccaauaucuagagagaauagcagccuaaucaaacagacauaacaacaaggacccacacuucauagcuuucuugaucuuagaagaaaauauauuauuuuauagucauaucuugcuacuuguccuaggaaguauuaauauauuuucaaguuaauaucauaagacuucaaauacuagguuacuucauucauucuguuuuccuaaagauaaaaagguugagccaauuucagggaagguuucagagaaaaaauacgaaucauuagagccuagaaaaauggaggcuacaaagcuaaaugaagcauccagugccacgauaaggguccuaguggccuuagcaaugauauucauucuugcuaugcugagauuuaaagccacuccuucugaggucaaaagaaagagcugaaggacuuaaguggugauagacagaagggucugcaguaggaagagaugggcucucuuuccccaucuugagagucagcuagucguaagccagauagucauuuuucaaggaucauuugcguucacaucucaucuguguacgaaguucagaaucugcagaaucugcacuucccuccaaagcaugacacacugugacauucucuuaaggagcacacauugcugacacgcugcaggggcucaguucuugcagccacaucaccccagcuagcccucuguuacaugcccccacugcccucuuugcuccuaggguuggcacccgagauggagcagggcaugaaacacggcacaugggccaggcagcagcaucggcaugggugccacaguccugcccacucccaccccucccgucagucuucauagaacaugcacaugacuuccuauuauuaccaucauuacauguuaucacagcauuaauaauuuuaagaagacauggagucuauuuuuugauguauccaauccuucuuuuacguaaucauuucacaccagauacgguaaauuguuuggaacuauggucucaauuaucuaccuucucucugcccaugcccuuucaauguaauguggcaaguccuuccaucaagccuaguuuuccauucuuaaaucuagguuagccuuuggacaugcuuuggucaauagaacguggcagaaguaacagugugccaguucuaaccuaggucacaagaggccuugcacacuugucuucucucagggaacccugccaggucaccuggugaacaaacccaagcuagccugcugagaaugagagaccacauggagcagagaugagccagcccaucugagaccacucuagaccagcagcucuauagcugacaagcagcugaccacaaacauaagggauccaaggagaaaacagaagaaccacccaguugagcccaaacaaaaauugcuaacccacagaauugcaaauuaaauaagugguuguuggccaggcccaguggcucaugcuuauaaucccagcacuuugggaggcugaggcaggcagaucauuugaguucaggaguucuagacaaggcuggacaacauggcgaaaccccaucucuacugaaaaaaaaauacaaaaauuagccaggcauggcugcaugcaccuguagucccagcuacucgggaggcugaagcaugagaauugcuugaauccaggaggcagagguuacagugagccaagauugcacaacugcaguccagccugggcaacacagcaagacucugucucuaaauaaauuaaguaagaaaauaaauaggugguuguuguuuuaagccacuaaguuuuggguagcuuguuacauggcaaaagcuaacugauaaaacagauuauuugagaagcaugacccacauuaccuuugggaagucacauuuucuggauuucaagguccucaucccauaaagucaggaggugguuggaggaccugugcauucccugcagcgcuacaauuuuuaagacaauaauuauaaucacuuacacuuguuugugaccaaacuucacaagguucuuuguggguugguccccuuggaaccaaucacacuguuuccugauaucuggggacaaguaaaaagcauuuucaccuaaagaaaaaaaacaaagaaaacaauugaaccgcaugcuaauaacaugaaaauuaaaauuaaucugucaacaaguuaaaugaaucacauaacauuuauuuagcccauaauuauuguugaauuaacuauaucagacaaacuauguccagugauuuuaaacauaaaguaugauggcauuggauccauaaaacaugguaagccaauauguucuauuuggcaauauuugggugauuaaguuaaagauauauuuauccaacaugagagagaagacagggauagaagaaaaaucaaguggagaguucaacaaguucuagacucuuggacaucagauuauaaugcaacugcuuuucagauuuucucaaugcuuuguugaacaaagcuuuuguuuuuaaucuuuggaagacaggaacagugaccugugggugaaccugggggauuaccuuugcuucacauuuuucuuugaaucuuuugggggccagaccuucacaaaugugaauacuguuuucauagaccucaacauugccuuaaauaauaaacauuuagcauauacauguuuauuuauacuuuauaaaucccccucaucuguuccaagccuugccuguacugacccugggcugcacacuguacacaggcucuggaaacuauaauaggcugcaccuccucaaagagcagucuaggggaccacagacccacaaauaaaugaucaacaggccagguaauagaugcccuaaauaggguguccggauuaaccaugagcaggccuugggagcagcagcuuccacggcgagcagaagccauuggaauugaacuuugaagaugaauauggguuugcugcugaagugcgguggagagcauuccagggagggggagccccaugagcaaagacccagugguauccaagcacggggcugguggcuaagccccgaucaaagcaacucuuucuagaagcuuuccccggugccccuaacagaaaucacuucucucgcgacaugccagccuauuaugucaugcguaauaaaugugcauuugauccauuugcccacccauuuguaaacuguuaaggacaccaagagugccuuaugacuagguggcgcuuggucaaaugugguggaauaaaggaaucaaugagaacaaggauacugucugcauguucccugcuuacucuggcuccuaaaagcauuuguggcauauggcaggugucaauauaugucuguucaaugaaugaaacaguuccugucaacacaucgguugucuuuuccaugacuguuccuacacuucuccuggcccgagcauaaagccaggccagggcacaugcugugccacgcaggacuuacugcugacgaaggauggcaacagccucccgaagcgcaucaaaggcuccucguugagcucgguggacuuguccacuaauuugaagaagacgucguuuggcucacuggcgaagguguauaccuccuugauguucaccuuccugccaaugcccaggaccacgaagaaguagcccuugcauuuggccugcaggaugacucucugggccuccuccagcugcugcuccggcaccucgcccgucagcaucaggaccacaauuuucaggucccguggguuuggggcacuuucaaagacauucucuaugguguauucaauggcacugccuaaggcccugguucccugcaacugugucauuccccugcugaggaaguccaccagcuucuccuuggagccauagucagucagggagaauuccaccuucacagguggcaugcuggcauuguccacggacucagagggcgcgugcugcacaacugccacucuggcgaagugcugggaggccuugggaucugggcucauguccaguugucugaccagguacgcuauguacuucuucaucucauugaacuggaacagggugguggucucagcgcugucuaagaugaaagccaugucgauguccacaucgcucccugccgcucuccugucccugaaggaaggccuccaacugccaaauccacaggaugggucgauguugcagaugucuagaaagaagcauggcagccuauuuguucugugacacccacagcaggauacacagcucaucaaucugcugggagacuugggcgauuaaaaugaucacauaagaucaaaagcgggccggaagcgguggcucacgccuguaaucccagcacuuugggaggccgaggcagguggaucacgaggucaagagaucgagaucauccuggccaacauggugaaacccugucucuacuaaaaauacaaaaauuagcugggccugauggcgcaugccuguaaucuaggcuacucuggaggcugaggcaggagaaucgcuugaacccaggaagcagagguugcagugagccaagauugugccacugcacuccagccugggcaacaagagcaagacucugucuaaaaaaaaaaaaaaaaaaaaaaaaaaaacaucacaaccaaaaccaauuuauaucuugccuugauuugauuauggccagauuucaguuucuaucaccuaauacuuaguagaugaaacaaaucacuaaccuaaaaucuuuguagcauaccaugugcuggcauuuuuaaaagaaaugaaaaauuauauuacuucucugccacucuuugaagaaauauguucuagaaagucacuagugccaauguuuucauucuagauucuaaugucaaaacuuaagcagaaacugccuccuccuuuguuaccuauaaaaugaauuauccgccaucaaagagaagcucuguuuugggagguccauuuuuaauauagaaacugcugcaguaguauuuacucugguaaauacgaggcuuugugaaucaauugaacucaagcucuuuuuacagaucaucauuauucucucacucucccauggauauuauguuuugcaauugcagcugagcagaucuuccuguuagagaaacagcuuacccaagcaaacaugacacgugaggacauucuccaggaagucugugaggucucucccugcaggcaggacaagcgcaugccccacugcuguguuauugaucugguuuaaacaaaagaacaauuuugguaggggcguacaugaucaguaauaucugaaaauauggcagaggaguaaaucaaagcuacaucaauaaaauagauuaacuucccaauagggcaguauugggaauaucuucucauuugggggugggguuaggcucugaguauaauagaaagacauagguuuuauucuacuagggugagcuggaguucauaucccguucaaauggguuucaguuuuuuucagcuguaaaaugggggguaauaccuuccuaauggugucauuuggaggguuaaauuagauaauaaauguuaguaacugguguauccucuggcaaauaguaggaacuuaaucuuaucguuauuuuuagcaacaauaugggagcuccaucccuuccccacccucucaggugugguuaaagcaaguaacaaaaucacucccagugggugcaaagaguccugucuaucgccguaccuggcacacgauuaguaauuauucauuuaacaaauagcuaguuugaaugaaugaaugagcaaauaauuaaugaaugaacaauuuuuugaucucguugaaaccaugcuaagaaacucacgugguucugggucccucagcccacacaaggacagacuuaugugaaugaauccccccaucaagagcacauggccgguagcccaacuucaacacugaauucccaagcccagcgcucuaugcacaaaucauccuguguucggcagaacaagcccugaggaauggcagugaugacccaaugucuuucgccgacacaggcugugguaaaagcauagaauauccaauguggaaggaaagacauuagcaaucauccugccccagucucaauuuacaggugaaaaaucugagacgcagggacgcuaaguggcgugcacauuacuuuaaauggguggggggaguguggaaccaggccaaggccuccugacucccggguggacuccuuccuacccaucacccaucugucuugaacaguaucgccagaacugcacugaauaaauauuaauugauguaagaauuaaacuaguugucugggugcgguggcuuacgccuguaaccccagcacuuugggaggccgaggcaggcagaucacguggucaggaguucgagaccagucugaccaauauggugaaacccccgucucuacuaaaaaaaaaaaaaagaaagaaaaauacaaaaauuagccaggcaugguggcgagugccuguaaucccagcuacucaggaggcugaagcaggagaaucacuuaaaacuggaagguggagguugcagugagccgagaucacgccauugcacuccagccugggugacagagcaagacucugucucaaaaaaaaaaaaaaaaaaaaaaaaaaaaaaaaaaaaaaaaaaaaaaaaaaaaaaaaaaaaaacacacaauuaaaccaguuauuuaauagaauuacaagcgacacuuggccucuccgugggcugacccuuggggccucacugaagaaagcuuugcacaguggugugguguagauugggggugcugagucggcauaguuuuggggaccucacugagagacuacaggccuccagggccacccuggauauucaccuucagggccgauugggacagaguggagacuggaauggguaucaucagcacauggguuucagagucuaauggacuaggguccuagccucucacgagcaccucacuaacagcaggaucuuccuauccaugaggugagacugaugauacaaaccucaccagccaguuaugggaagcaaaugcccaguacacaguaagacacagcucagagugugcacagggggccaucuugggaggagacaggaaggaugcaaacguccagguccucaugaauaaagcaaacaagucacaccaccuuguuaguagauagagagugucaccaacacuagcaucacuaaccggcaagagcugucaacaugugaggagggaccugggggcagugcuacaagcauguaggcgucccuguagugcuggagccacgagguuguccuggagaccucacaagagaaguucucaggcagauggccucauuggggacguuuuaggagcuaugggacaugaagccacaaaggagcauggacgugucugagaaccuucucagagccccagaagaaagggagaugccaacagcacgcacagagcacagaccugcaaagcguugaugagcugccggucuuccugccuuguaaggaacaagggggugauccccgcaucugagagcuugagcacagccucucugagcuguggggaugcucuuguggguguguugcugaagaaaacagccacuuuccucauuaggaauccguuccucacacgcuuaaauguguuccuggccacaaacgacauggcagucuccagacucugcuguuuggaugucagagccaccugaagguucuuaaucuuguccaggaggaccgacuuccucuuggagucagcaaaccggaucuccguggucaccucguuguuguaggugaccacagccacccgggccccccgugggcaguugcucucagcaauggucaggucauucacaauacucaagaccacaucucgcauccggccgaaagugucuugguugacucccucagaggugucuaaagcaaaggcuaguucuguugggaagacggggcacuccaggggcccuguggaaaguagaggguggaggguuaaagacaaacuguacuuacuacaaaagggaggcuuccuuuccuuaggagaaagucaccaaaaucaacuuaccguaacagcaagcuagaaaagaagcaaagagaagaaagggugagagacuacucuaccaugugagaauuucgaauguaaaaauaugcauugugagacaacagaaaaucauguacuuacggcauuuaucuuugaugcuuuggaugagggcacauugcuuuaaaagaaaauaaaagaauauguaaagagagcaaaucaaaggcucaugagguuaaugagucauucuggacacaugcaacuuacaucgauggagucgccccuguugcccuugggacccuguaaaaccaaggaacgaaaggugagaggcacagcagauggggaauucgaauaaacaggcuuuggcccccagaaauacacagagcaagacaaaggggccccuggauaaccuugauuguuuacagccucucccucuaaaccugaucuuaucccuugcaaagcaaaaaagagaagauucuggagcaaauguguuucccugggaggucauuuggccuuugaaauagucucauguucugaaaccaggaagcucaccaccaauccauguaaagcccacgagugaaccugggucuagauucugcuucucuugagaaaagagcucccuuucacacgcuugauacgcuguccccugccgaaggggcagugagagaucauugagcugcccuggcucccuccgugucuaaagcaucccagcugaauuccaccccgaggagcucuagggacugacucguggcuucccucagugucccaugccuaaaccucaccacccugacagcccagcaggcaucucaugggccauuaguugucuuuccaggaggcuauuucugccugcuuggucuucugcaggaacuggcuuaaugugcuccccccaacacuucaccuacuuaaagacagcaaucagacccaccugaccagcuuucuuuucccuaauucaaccaaacuaagcccugaaccuuuccuucuaggaaugauuuuccaacuccugaauuaucuuuuccauuauuuuuugaaacucaccaauuucaauauugagggacaauauauggagaaauucaaauaagaaaacaaagguauuagcaauaaagagguuuggaagggcugugggaggaugcccuccuggcuccugguggcagcaugacuagugggauuuaaccacaaaucaggagcucccuuggggauuucauagaccacaggaagcauugucaaaccaaggccuggcauaauuacacugcuucuacaagaugcaagcaaaagguauuuagauuuccccucuuugguuucuccucuacacaaaccucaaaugcaccuaugccaggaaacuauaaaggcaaauuacaauacucccuagaugacaggauaucccaugaaaccuauuuuuuuaaaguuucuuguuacucuaaaauucaaaaucucuuugcugcaucaugaugucagagaggcgguuugacaaccaagcaaauacaaagagagcacauuuucuugugagcaaagcagauggugggaaguuuucagggaccacguguaaagcacccagccccagguggccgggucagaacuggauaaauacuuacagcugguccuggguagccagggucucccuucuguccaacuaucccuggaggucccgaauuucccuagagggagcagaacaaacauuguucaacugugucagaaaguggagaauuuaaggcuccuauaguuggaagguacgguaaaagugaucuaacccaagggacuccaucaccacgaaaaaucucucacuuuaagggagcuaaaaugucucuuaaauucaaguuuagggacaagcaaccucaacaaagccaaugggagucccccaccaacuauagagguguuguauauuguguucucugccaggcuaagguaagacaggugcuuucccaagaaccacuaauaugauuacuaaggacucccaggagaauagguaacagacagugaauuagcuaaugcguucaguguagauaaucauccaauguuuuaaagcucuuugggauauuaaaugaucuaguuugacugucuucacugaucaaauuaauaagauaauuauguuucuuuuuaaacuacauuucaggcugaaaauaacuguuagcaaccuuuacacagaucuaggccacaauuugcuaauugaagacucugccauuuuaagagggugaguaaacauccauugaagaauaaucuggccagguguggugucucaugcauguaaucccagcacuuugggaggcugaggugggaggaucgcuugaucccaggagauggagguugcagugagccaagauggcaccacugcacuccgcccagaugacagacugagaccuuggcaacagagugagaccuugucacacacacacacacacaaagaauaaaaagaaaagagcuaucagggcuaaaaguagcuuaaggaagaggaaucucagcaccaguagucugaggagcccauggccuuggccuggcucgcuugcaagccuagaggcuucagaagcaguugccaugccucauucacucccauugccuggccgucugggugggcauggcccaaagugacugcacagacuucccagucacccauaaugagauucgagacugcaggugggugcugugccuggagugagcugggcuggcgacccuggaggugaguuggaggaagaggaauacaccuacaggaggagagccauggaccacagccaugguggcacccugaggacauuggucuggggcucaggauucccuuccuuccacccugugcuaucccuggccagggugcaagugaaggauaauugucaaagccucagcaguuaaucacauugagacauacguucucauuccucaccugcagccaaggcccacgcaaacuuacccuucggccucugaugccuuuggguccuguuguuccauuuagcccagguucaccuggguuacccugggaagaaagccgagaaguggcacaguaagcuuuggaacagaagaucucacugaggguccgugggguaagacauccaggagacgugugggucacacuuuucccgggcagccaagugguuaguuuugauucacuuuuccaguggguuacuacuauauuugugguauuugcagauggucuuaauuuaauuaaucaguaaugauacuaucauguagguuauagcauuucacagcuuacagaguacuuugauugcagcauauuuuauuuaaaucucauaaacaccaggacaaguacguauuaugaccuccacuugacagaugagagaguauuuuagggaaggaagggucuuucucaggguagcccaguuaacugaguggcugacccaagacuaaugccaagauauucugauucucaguccauggacauaccagagccaucccaaaaucaugaugaugcuucaccgaccagggauuauuuaccuuugguccuggguauccagggaauccucuuucucccuauaaaggaaaaauagauuauuuaauacuugguucuaauuuaaauucaucuaaaauaaauugaccuugaaagaaagaaaugucugcugagucaucaaacgaaaacacucacucaaauacaaagacaauuuuuaaagaaauaauucuuuuaaaacacaacacaucagaaguuguccuuggagccuccuggcagcaaggacgcuuggauaauccucagcagauacguacuuuuuugccucugcguccuucacugccaacuccgucucucccgucaucucccuaagagugggaaagagaugugacuguaggucgccaugccuggcacaccauaaccaccgucucugcccugccgcugccccugagaaguggauccuugagcuccugaaauguuugcagacuaagguacaggaguaggcacacuuccugcuccuguccuaucuuccaagugugaacaagaccauuucuguaggcggugggcucaaaggacucccguagcaaaauggcacuggcggacuaacauagaaagaacugcugguugcuuuugguaaagauucuguuuggauguagaaucaaagacucgucaaccccaagaaucuuagaauugacaggaaucuugaugguuacuuugauucuaugcauccguaagucuuugauucuacuucaaaaccaaaacacugaacuccaucucucaggcccaggucauauucccccuccccauaucccuucccuuccuuccaagucaucaccccuagacccccuccuuuccaacaccuccccccagcaugcucagaucuguuccuguugcucucucaugaggagcauucagaacuggacgucauuaauuaugaaucagaagaaucagaagaacgugugugaauuguacauuacuaucucuaacauauguaggaauugccacuuaguuaauuuacaguuuucaacagauaucaacaacuagagaucuguugacccaaauuacuagaaacagaaucaggaagagauuuccuucaaugguuugaagucugauuuuuucccugugcuucugagauuaaaaguaauacaaacagauucguuuuuaaacuucaguuaguugaaaagacaaaaaugaaagacagaaaaauauuuugaugcuuggaauuaaaacagucagaucaaccugguccuuuuauacaguguuaggugccaugacuccuuuuggaaaaagucacaauggaccguagauuucuuuauucuuuuguaacguagaaauguacaucacaaaauuauuguuggugaguuuuuggggcauuuuuaaauagcauuuaaaaaacgaguuacugagguaauaauuucuauuccuaagaugucucauucaaaagaaauuguuuccaucuggacugagaccuaaucaaauccaauuccauuuuaacccaaaugacauuuacuucuuugcagaaaagcuucaucuaguuaugcuugcaaagcauuugcgggaccuaagaugaagguaguuuaagcuucauuagccucuacauucucuuguaucaggaaaaacacaggggaaaaaaugucucuccccacggcccgccccaccucucuaccccugccaauaaaauaaaacuuguuaaauuaauuugccgcagaugagcaaguuucaguauuuccagccguauccccaauaauacaagaagcaaggcucaucuuuauuuggaacccucuccuggcuuccugcaccuuccagcaaagagucagcgacagccugaccccaagcgcgcugugaccuuaccgucuccccacgagggccccgguucccgauuccuccuuuugguccuggcucuccgggcucacccuagacaugagaaacauggcugagacccuguggccuggggcuggcuuacagugugaugccaagccaugcuuuugcucuagguaagggugcugcaacaugcugacuucaccuuugagauuucgguggaaugauuuucuaaauugcaacauucaugugcaaacuccuggaaaagaauccaggaggguuuuguuuguccuuuucaccagcguggcaugggggacgggcugaugagaagagagaguaacaacugggagaagaaggcacggaaggcggugggcauugagcccagcauaaaaccccaaaacacucuccaggcagagaccaucguggauucacaggaacucauuucuuuuacagagaacaugcagucuuuucggacugguuaugacaaauuguaauuuaucucaaagcugauagaaaggagguucucaggcagccuucauacagcagacuugcuguuauccaggacagucagggucggggcucuuggaugaucuaaaugugauuagcugagccacugugcgugcacugcccauguuuaaagacugcucguuccauauuauacugaaacuguaccaagcacugcccggcugcucugauggcucagagggugcugcacuauuggcacaagccaagcaagagaggagcagaaaaccuggcagcugauggagggcuguggccaggagaaagccagcccucugagcagagaugguugguggcagggaugguggugggaauuaugguggggauuguugggggacaaugauuccacuggccaagccgcgaucaacaggggaggcuggagugggaaccaguaguacugaagaggagggacagacagacugaccaaagagggagaggggcaugugugccuggcuggucccuguccucaggaaagcucuaccuuucuaaagacaaaccuuucuucccaguggaccgguucugccucguucuccaggagcaccagcggcaccuccgcuucccuggagcaggaggggaggaaugugucagugaaguggccaaccguccaggcaaauuggucucugaaaccugacucuccccugcauggaagucagagcccgccaggggcauggaaccugucccaccugcaaaucccaagcacucagcucugagcacggggcuacggacucaaauauaaacaugcacagaaauggcaugcacaaauuuaaaacaugaguauuaccucucagugccaguuuucacaaauuaaugcauguugcaguuauuaauguacauauccuagguuccugacaggacggcaagcucccagauuuuaugugacuuuauucugccucccuuuucacacccucacagugagcaccugguacauaugggcauguuaaagccuguuaggugaaugaauaaacugauggaugaaauuaacucuuaaaaugugguacagucuacgcaacccacaaauaacauaaaagagauggugaaaaagugcaaauuaauaaauguuucuggagcuacuggauaacuauuugaauagcuuugcaucuauaccaucuuaaauuguugauuaauuacaaguuaaguaaauguuuuuuaaaaacgucuaaagauauguauuuaucagcuuucaagcuagagaaggacuuucuaagcaaguucuugccugcuuccaccauaaaauauuuuuguacauuuauguagcaacauauugagcucguuaccaguuuauuagucauuuuuugguaauaaaugauaggaugccucccucaauaucaucucagccaugagggaaacccgaauacguaauuccgugacaccugauccuagcccagcaaugacagugugucucugcucaucauugcugauagcugcuuugcaagauaacaucugcagucacagcaaguuuaagggccaucuucugugcugaacucaugggugaacuugaggcacucacuauacaaaauacauaagcacaaggggcuaucuccagggaccaaaggggaaacaccuugcagaaucuaagcauuuugguagauuuagauuuuccaggauuccauccugaggcauauccccugauuuccacccagggacacuuggaaggagcagaauugagacuuagaggcccauggagcaccaaaaaaggaaacucuuacuuucuuggggugaaguagccagucacugcaaggccugagguuaaaucugggguuuuuguugccaaagaggagagcuaaagggaggucugucuacaauagcaucauccgagaaacucucucagccugcuuggcaaugugcccucuguucagcuagagagggggcugguauuaggacaggcuuacccgagguccagaaaugccuuguucuccuaucagcccuggaggaccagcaggaccagcugggcccugaggaaggaaaagaccaucgugagugcuaaugaggugacuuuccaugagaagccucugcauggcaucugcccaucccacagggccuggaaccucacuucugcuggccaaaaacggccaccaaaacccacaauuauccugucuuagcugcaguagcagcugccucaauccagaucgugaauaggcaagugagcuuaaaauguauacaagcaacaagcauucagacaaaaacguguaggagaaucuucacagaagcaucauucacaauugccagaagauggcaacaaccuaaaucuccaucaaccaaugaguggauaaacaaagugugcuguagccacacaacagaguauccuuccaucauguaaaggaaugaagugcuucuacaugcugcaauguggaugaagcucaagaacaugaugcuccgucaagccacacacacaaagcugccuaguaaaugauuccauuuauacaaaauauccauagugggcaaauccauaaagagagagagauuagugguuuccagggacucgggguggagggugauggggagugacugcuaauggguacaggucuccuucgagacuguguuuugaaccuagauagaggugaugauugcacagcauuguggaaguaccaaaugccacuggauuguucacuuuaaaaugguuaacuuuccggauauaaaugccacccaaucauuuuuuaaaugauuugugaaauaucagagggcacacagucacacacggaagcacucaccugugcaccucugguccccugcucucccucaaagcccggcuggccaggaccgcccuuguugcccuuugaaauaagagaagaugcagggaggagucaggaugguuccugucaaugucagcucuuugcucuacagucauuucugggccagggacuuggaaagcaaccagggaaaacucagcucuuccagagguaacagaugaucaaagcgguaaccccaggugagacacugagcacaggagccagcugucucccugcacuucuacaauuguuccucacucuugccucaccucuccucggacagcuuugugaaacagggaucauuuagaccuaaagcagaggaccgagacaccgggaaguugcggguugcugauggccagauaggugagcacguucuggaagaggcgcccgcccgggacacuacugccucagucauguuuccugcacuuggaccccaaguccccacugggcaccauuuucucuagacucugcagaagaggcuguuuaaggagacggcugacagagccucgggagccagaacagcccaaggaggaugaaagaaaaauaaaucucagaaccccaaaaucgcuaagccaaagggaaaagucaagcugggaacugcaucagacagagcugccucccauucuauucuuaaauaagauagcuacaaagaauuuuuuuuuuuuuuuuugagauggaguuucacucuaguugcccaggcuggagugcaauggcaugaucuuggcucacugcaaccucugccucccggguucaagugauucucuugccucaggcuccugaguagcuggaauuacaagcuuacaagcaugcaccaccacgccuggcuauuuuguauuuuuaguagagacgggguuucuccauauuggucaggcuagucucgaacucccaaccucaggugauccgccugucucagccucccagagugcugggauuacaggcaucagccaccguccuggccagauuuuuuuuuuuuuaagcugaauaccucccucacauucugcccacagggaaauuccuuguggacaaaggacagacagaacugaaagucaucccucugcucaugggagacaaaggcauauccaauugcuuccuucgcccuguuuuucacuaagccuaacuaaggcauaggugacuguucugguaaacuguguauucagugaaaggcuaaucagagacucaaaagaaugcaaccuuuugucucuuaucuaccuaugaccuggaagccuccuccccugccucgaguugucccaccuuucuggaccgaaccaauguacaucucacacauauugauugaugucucaugucucccuaaaauguguaaaaccaagcugugccccgaacaccuugggcaggugucaucagggccuucugaggcugugucacgggcaugucuuuaaccuuggcgaaaucaacuuucuaaauugauugguaucugucuccgaagcuuuggguucacaggagagaguguuuuucacuccugggcugggcggcaucugggcuguuugaagagagucuccagggggcacugcaugaggcucaccuuagcuccgggggguccccuucggccaaagccacccuguggaagaaaaagucccacaaacugugagggggagcaugggacgcugggcauggggccuagagcucuuucagacuucacccucuuauucugcgguuacucaggggaaucuucccaagcacccacaucgugccaagaaccagaaaccacaccucaucagcccuggggaaacucgcacacacagacacccuuccuccacccucauccgggugaaguuuugcuuccuugcugcuccuguuaaucacccaauggaaguuuugagaauuacugcagaccugccaagcaaaauaaugacuccuuuuggcugcacgaucccagccaguuucaaaugaggaaugugaaaagggaaugucaaccugucuauuuuucuuccaccuucccaacuguacugagaagucaugaaauacauuaauuauaauggaagggagucccagguucuccaagugaucccggccaaacacaacacacacucgguuaaguaaaauaucugaagcacacacaugugcaccuaaacgucucguguacuuagguagggcucacgacuuggcaacaucuuccuggaugcuccagaggugaccuuuaguucaaacaugugggcuuacuucacaaguaauccauuaauuuccaccucaaaauuguuuccucagcaguagaaagguuuggggugggacuuuaugaaugucccaggcggucuuugcaaaguuaggguugguguugcagaggcugugaccgacuagcucuguuguggggcucagucaucugcuacaucaaccuaggaaccucacucuccacuuccaauggaccagcccagugaucugcggugaccaguuugccauuauucgcuguaaugccaccugcuucagcggaagaucuuggccaccuuccauggaaaauuugagacaaggggacacuguucuccucuacaaaccaacaaucuggccuggccccucccaaaagagacaugcuagaguuccaugagaguccagcagcacucagugauacauugcucaggccagaggccgccugcggagacucuagaaaggggauguaggcaugcugaagcccagugggagggacacauuucagcuuggccugagccuggcacugugguccuaagggaagggauagcaggccauuagaccacaaaaggaagaacugaguccucaagagcccgugacugaaaccgaauucaaauccaguuucuaccuuguguguagaauugaaauuaauuguaugaacuacucaauuuuaagucauuucaugaaaccaaguuuuggcucugcucacacgcugaguuguaauagcccauuguaacauuugaugaguauuucuucuuuuucauuauauagcuucuuuuucauuauauagcauuauucaaaaauaaugcucacuuccaagcaguugauccaggucuuuacaauuuauuaaaaauaaauaaauaaauagugcucaaacauuuuaaaaugauauuuucaaaauuucuauuuucuucugaauuuucaaagcaaaaugaugcccauaguccaucaauuugauuuuggugagucgcuccuuuugaaagccccucaccccagcgaacucuacuggcccaagugccgggccgaacgagccacugccccucagggcguggcugagggcccaguucccagcacccagccccagcuugcagccuuugugcucuguucauuucugagcagagaccuccccuaggcacccaccagcauccugaauuuccucugagagguuacaaacuucuacaccacuggucuucucccagcuacaaggcagaugcugucugugcccgaggaccuuggaagcuuuugguuggcuucagaaagaucauucacaucacuuugacuuuagcauuuauucaacaagacugaggauuaggcauacaaggagcuauucugcuacagacauuucugaaaugucuugaaauugcaagaugcaauacgccagaaaaagaagaaaucuaguuuuuuuauuucacuuacagcauccccccaaaaacccacagauaauuacaaaaacaacaaauccacaacucccucagcccucuugccccuuauucccucccucccccaguauuaggauuuccauuugggucucuuaaauauuuaguuggaucaaaccuggcccgauauuugaaaguagcaaagauauuauuuuuaaaaguaucuguucaguauguuuuuggggagagcaagaauuggggagagagaagagaugaagcaccagggaaauuauaagaaugaaaauagauuggaguaacaaccguuucagaaauccuuuuacauucacucacugcagagcuguggacuaaccaugcaccaggucauguugggcagaucuuauggcacuaagaauugucacagagccccccaaagcccuaauggcacucacauucuucccaguuucuccagguccuccagguacuccaucucucccugggacacccugguguggggaaaauuagcaugagauucucaucugcagagaagaaugucuagcucugaaaugcugcacaagacauugcagggaaaggggucgauucacagaggaagagcccgucugcaggacaguugcacacuuugcaggaugcaccggacuucaguacacucccaccucuacaagccuuuggcuuaacaagcaccuuccguaaauaucuaagaggcacagauucugcugagaagccccacuuggcaagggucacucugguuccccacggagacuuccuucacggggacucugcugcuaaucuuaggcuacguugcaguguuaaaggccacgucuuuggccucuguggcugcugaugagccgagaaguguguccuuucucuugcccucaguacagggagagucuaggaaugugcagcaccuuaccauggggccgaggucaccgguuucuccuuuggguccucucuccuggcugucuuguccuggguuacccugaaagcaacaugggaaagggaaaugagccacauauggaaggaaagcagcugccacuggacuggauggucagggaaauauuagcaaggaccugcaugcaaggcuucgagggacaagcccuucggccacaacccauccagguaacauccaugcaggucuuacgaaacccaaucacgggaucagcaaagcacucuuagccccaaacaggugcaaucguucuuccccagggaggaggaugccccaggcucacuccugcuuauccuuggccacagaggcaggauggacuggaagaagaggcuagcuuguacugcucauuugcuuaaacguuuuacagagacacaaaaugagaaaagcugcaaacucuucucuuuuccaaaagcaaauuugaagugcccugauaccacauuuuuggaaacuucucagauauuuguauaacaggacuugcaaaugauuaucugguuagcaagagaaccaacacaucuccccaaacccccaaacugcaagaaaaagacaaagcacauauuuuaucaacguguuuuaaagcaauuucaaaaguagaauucuuccuuucaucccccuuucccaacaacccucuuccccaggcucaggucugaaaucgucaauaaagaaaucuuuaccggguccccucgaaucccaacaucuccucuuucuccuuucucuccucgagguccuuuaucacccuaaagaaaaagcacaaguggaugcuaaaaacuagauguuuccauuuuuaucucacccuaaaaaucacauucuucaacucauaaaucuuaacuagaacaauguuuacaauuuacucauucaccaugaaggcaaauucacuuccacauauuuuucauucguuuaguaaauccaugaauauuuauuggggacccacuuugugccaggcacuggagauuuauuuauaacaaaacaaacucagucccugcccuaugggaugugaucucgaaacaagaaaauguacuguaaugugucagagcugagaggggauguaaugggugcacucacaggggaggucagggaaggcugccuggaggaagcgggcuugauguauaugaggaaagaaaauaacuauucccuaaaugaaauguugauauucuuuccauaauagcaccaccguggaaauacaccuacccuucuuccaggauucccuuucucuccagaagaaccaggcaauccuuugucucccugccaaagacaaggauuaaaggucacaccugcugcaauuucuaucacagacugaguuguuaguuucuggaaucuucagaaccaaaagcaguuuggacuuagaguaaaaucacuuacaucuucaccauccagaccauccaguccaauuucuccuacuucgcccuaagagggaauaaggcggacagguaaguauagaaagcuauucuggcaaaggaagaaaugagaaauacugggagaguuuuccauuuguaaaacaaaaccaagcuugcauaccuucucuccugggaauccccgagagcccuagaaggcaaggcgauaggggaagcauuagcuuuuccugcagggcuggucccucgggcagaagaggccaagggcuguucccccacuccaccccauuugaauguugcagugucugaaaauguaauauuagaguccuaccccuuuggauuccucucucaccaccacgugcgauguuuuaaaacuaaaacuagaacugaaugcuuggguggucuuggcucccugggccggcggggguggaccccaaaacccagggcaaggagcugacuuuguaacuuugcagcccuucccuucagcaccugccuucaaacuucagcaaacagagaagcaaguucaccagccuucaacccaccugcuguccucucacuccacucccuucccugacugcucccacgguccagggccggggccgugggcaccagccuacccuccgcccuggcccauguucucuccuugugaggguuuccuggcuucuucauguuuccacaggaaacuauuucuccauucucaggcuccccaccagcugcagccccugcuccugaacccacccugcucagaacugccuuccaaugagaggucacgggcugcugaaugcugaggucaagaagccuggaccagcgccucccucccuggcagcaucuggagaaacugcgagucaccugaccccuccccacgcuagcaaccccaucacccacgccucaccuuuacuccucucuggcccgggcagcccuggaaaccuugagugccguucacaccaggcggaccacgcucacccuguugugagagacaaaggcauuuugcaagcuggagcccuucaucacccuuucucugccgggcuugcagcagcguaaaggguacugugaacagcaugcagcagaaagcagauuucaccauggggaacgccgaucgaggcuacgugagccagggagccucuugggccccugcaugaggccuggccuggaaccugcaguuucccugaagggaaugagaucugggaggguagcagcgcagacagcacugcccuguggggcaaggguggguggcccccagcacugugucucugugggugcugaaucccgggaagacccaccgggcugacagcuccuccaagugaugcuugauucccaguucucuagccgagcccugccggcugggcccuggugaccacacuguuccucgugagccccucuguccccuaucccagggcuggaccuugaucuagggucccaaagcuccccagacaggugucugucuugggcauugcucccauggacccugcuacuggggucuguccauccccaagacccucggauacugaugaucugauccagcaacauccccuccagggacuacccuuaacgggguaaccccuaaagcccuggugaggucuccugcugugucccugccccucagcucacucccaucucuacuugcaugucuuaaucuaguagauacugggugugcaaauucggugucccucuggcucagaaaccaauuaaucccuccuucugaaacagaguaagaacaaaucccacccuucaugcccacauuugucauacuucaauuaucguacuuagacauccaggcaaaguuguuaagaaaaguauaaauuaauuuuucucccaaagggaaagccaucagcaacugaacaaaugaugaaauccacaaugcaaucccaauggguaaggaucaaggagggggugaaauuuuagggacuaaaacaauuuuuacuuacggguccacccucaucaccaggauagccucgguagccgucuucuccaggaauacccugaaacaaaguaaucggguccucuguuuaaucccguggucuucuuugcucuacaguaagaaucccuguggucccccuucauuuggcagagcagcacuaaaacucagcauggcuuucccuguuacugcuuuuccccucaguacaccaugucacgauucucucuaucaggaucucuaaggcuccugcucugccaagaaagccuguuaguuccuacugacucagagcaaaugcuaugaguuccagcugccauucgcagccaggcugcugucagggacgccagcugccuuuaacauuauuuuaugaaaugaaggaccaagcuguuaaagcacagauccccuuauccugugcaaaaggagggucccgccugaaccaucuucacuggaacaggccccagcagaacagcacgcaggucugccccucagagcuccuccuucuaacauaagaaauggucucucgucuccuccuucaucuccacacucuucuguuagagaaauuaccccaccaaaguaaugucgggcuucugacaccucaucucaggcgugggcaaggguaaagccaccguaccuuuggcccgaugcugccgaugggcccgcggucuccccucugcccagagcacuugcagggaaccccacagcaagcuuucucggcaauguuguccuaccgaaaggaagagaaaccaaauguucagaucucaagaaaugcccagcagaaaaucauaaaugcgcuuuaagggucaaaaucggauguguggggguuucacggugugagaugaagucccuccaggugacauuugcuggacgacugacgauaugauagaaauugccagcgaagucaggagggcccagcuccuggcggucggggugcagaugggaggucaccaauaggaaaguaaagaacaaccaaaguaaaauagaucuuauccacaauaucacugcaggcuggaccuuauuucuagaaguuuccaucaucagaucuuaacuauaacuuacauauguuccaguuccaaagugcaaagccaagcaaauggcagauggccaagacugaaggugguuccagaacagauauccaugaccacccuuccuuggaaccagggugagagucaugggauaugguaccagcccagaaagaggcuuccagagcagccauggugggagcaggcacaagugguccuggccucggagccaaaagcuucucaacuccaggucacacagacacccucuacauucucaucccaucuggccccugaccuuaugugggaaagggcaugcccaaauacauuuccaucugcuaaacuaauggugggcacaugcacuuucuuccaacgagcuuccaagagcuuucccuuucucccauaucccagauuugugagcuaacucaaccuacuuccacuaggaaaaaaauccugauucuaacccugcaaagaaguauggaagaaaggaagguccauuccucccauucucauagccacaguccacuguugcuaccaucaaagaaucucugaguucgcagcucagccccacaucuuccaaaagcuccauccccagucuaaacccaggaggucacaccuccagcugagagaggcuggcccuggggagaaugaggaagccucagagggagcuucauugacacagagggaaacuagggagggcaauuaaagcacuucuccacccagaaacagccuuucuuuuccugcauguuguuuuuaucaugcaagauuucagaugcucuugacacaguuuccaauuggaggauggacaaucucgaugguuugcaucccugcaaugguguuaaaagaggccguugcuaagggagcagagaaaaugcuaaggccacaaccucagcgcgcccaggauccccuuccagcucgcuggauuuccagcgauuugcuaucuccauuuccagauucacauguguuauggcaacaaggcaguucccaagugaauuaaauaaauuuaacuaucuaccaaggccccccccccaccuccauucaccugcugauaauuaacuucauucucuugaaaugccaaaaggugugguaucuacacuggucuguguauaaagacauaaaaaaaacucacaagcugcuccgcuaguucauaauccaaguccagcaaguuaagccucaggggccugucauacauaaacccucgcccaaacuccagaugcauuagccgcuccaaguugaccacucguucaaggcccaccaggaucaaggcacggacuccugcaaagaaagacacauuuaauacagcucaccuaggcauguggaaaaugcaauguccuuuuuuccugacuacauuuuuaaagaaaacuucaguguaaaauuuagcuuuuaacuuaaauauauuuaaucaaguuuacuggcuacucugaauuguugaaauacucaaacuuuggacucugcugaauaauuguuuccgguaugucaauaacuaaaccuauuacuaaaaauauaggaaguggcauccaugaaguguauucaugcaugaguucucaaacucaggcccucuguaacacgaguaugcugugggaaguauugaaauacuaacaccuccaaaaucagauaauagcagccucaucuccauugcuugggaaaaguaagcuaauaaauagaaaguucuuaggauaaauuacacuucuguaauggcauccacuuucugauagucagugcuaccaaacgccaaagcaagugaauagucaaagaucacaucugauaauaggcauggcugucaccuuauguuugguacgucauugcuuacauuauuuucuuuguauuauuuggguguaguguuauuaaauguugaacugugauaacugcaaaccaaaaauagagcaauguauuuuuauuaguaacuaauuccuaguuuaugugaugaaguuaaaugaaucaauacgucaugaucuuuugcaaaagcaucaugcuuucugaacauucuaccaccugaacagccacaacacaacaguaaagcugucuaaguacagaaggaauuuuuguuagcuccaucccacagcuccaagcaggugaugaagggccacaacgcugggaggaagagucucccaagacaacgcugcucccuuggggcgcugcauuagcagagagguuucucuccagcagagcaguacaccccgccucaccaggguuuacuucucauauuuagaaagccuuggcaccuaccuucuuggcggagguucucagaugcucuguguaaaucagccagaucuccgucugcuccaucaguaaaaugaaugaccaccugcagauaagagagcugucaaaucccaggaaaacuaaaaaggaguguugcagacugcugauagaaaacugagagacucgcugucucaagcccuucauuuuacacuuaaggaaacugagggcccaaguugaggaaugauuacccauguucacaagacuuugauauugcacuuaaaauggaggaguauauuugagugcuuaauuuauuuuaaaaaagacaagcagcaaugacaauaaaaacaauuuuuaucucauucucauauuucuaagauguaguuucugcgaaucauaugcauaugugugcaugcaugugugcgugcaugugugugcauguguguggguacauauguguguguaugggugcauugugugugcaugugugugcacgugugugugcauguguggguguguggguguacaugugugugggugcguaugugugugcauguguaugggugcaugugcgugcaugugugugggugcaugucugugggugugugugcgugugugcaugugugcauguguuaugggcuaaauuguguccccucaaaauuuguauguuaaguccuaaaccccaguaccguaagaaugggacuguauuuggagauagggucuuuaaagagguaauuaagguuaaugagaucuuuagagugaaccuuaaucuaguaugacugauguccuuuuagaagaggagauuuggacacagacaugcacagagagaaagccauguggagacacagggagaagaccccugccuacaagccaagcagagaagacucaggagaaacagcccugccgacaccucgaggaugucaagccuccaagacugugagaaaauaaaugucuguuccaaaagcccgccaggcuguaguacuucaugaugaucccuagcaaacucacauggugugugugucuacacaauauauaugcauguauauacacacaugcaugcaugcacacauacacacagagaaaugaaaguggagaacguaccugacuggacuauaauuaaacauaaaucaaucacaaauucaacucauucaaguuaaacuacugauuuccaggauucuuuuagagcuuacguaagacuaccaaaaugaggaagacaguacaugacauuagaucaguuaauaacuaagggauuuuccauauagacacuaacaauccagugaaacaugaagaggauuuaacuugggggaagggcuuccuccuuuccaguaaaaauuuggaaauuucccagggagcaccugaaccaacuggccccacagaccuucacgcuguccggcgaggacugucugaacuuguucagguagaccuucaggguguccuccgugaggacguaggggugcuggcugcgcauguuccggaacuucucgagcaucucuggcugguacucgucaaagucaaaggccuccaccgggcccgagggcguguuggccaccacugacacacgcacggugggcgagcggccaccgcugcagcugacccugugcaucuggcugauucuguucaagauggcguccaccuuggacucgaagcccuucugggccacaaaaacauucuggucucuagaaccaucaaaccccagaaucacauccagauuacaagcuggaaaggagaaaugcaggugaugaguucucagcuggggcugaggagacgaacucuacuuauaccagcaguagggacaacccaggcagaggaccagggcaucgcacucaagugcaaaaugagauccugugugugugagcuuugagaagcaauucuauccaccccucucacagagagaaaugaggguagcuguuaggugccaaauaguaagcuauuuuaaaaagucagcuuuguuggugguguuaauuaacuuuggugugaugauacaccacugguguuuagaugcaccccaaguuugugcuuuaaauuaaaagcacuugaaaaucaaauauucugaucucaaauacuugaucuaauaaaucuauaauuagacacaggaaucaauaaaucugaauuguuugagggauuaaggaauaggggagaaaaguaaaucuuauaaaagcaaaauaugauagacuucuacucuugucuuggaagaacgcccuagguaguggugaggugggugucaggaccagucccaguggguauaaguaaauguaugaagcaaccaaaugccuaaggacuccagaggucagcaccagggaccagacagcuaaagaggcacaaaugucaacaggaaaggauggaaaauaugcacauaaugggaguuaccuuuggcagcaucaguuacaccagggcaaaggguuucaugcaucgcaucaugcaaaguuuccaaaacuugcucgcucaguucggacagcuccuggacguugcccacgcggaacgcuguggcgcuguuggacgcuaucuuuccaaccuccuccgagucgauauuccucacuccaacagcaaacacuuugaccccccucugggugagggccaggcucacauccugugcaucuuccaccgacuuuccucccgugaucacaaaggcaaucugagggacccgcugguccaggcggcugccugccucaggcacaaagugguuuacccgcaggugcucaaggcccaccuuaguguuggcgugucuucccccuuuguagaccacuuuguugauggcgucaauaaucugccucuugguagagaaguccuucaggaagaauucgucaguggggucagaguuguacuggacaagccccacuuggauggagucgccaucuucauaaacuguguccacuauuucagacacaaaacgaagcacuuccuggaaacugucccuccugaaguugauggaaccauccaacaggaacacaaugucugcuuucuucuucucuagaagugauuaaagugaaaauaaggagagauuagguuuccagacccagaacauaaauacacaaaagguaaaauuaaauaacugaaauaagacauuccuaauaauuuauucacagugaaaccuucacucaaauccaugccucuuuagccuguaguuccugaauuugcagcucccaaacaugcuaaauacaagaagaugaaugauaaauccucuaaacaaaaaggaaaggagaaaaauuauuugaugucacacucugugaaaacucagugacagagaacuucaguuaucccgugcaaaauggcauugugacaagaauucaauagggaccuggcuuugacauuugugaucucaaguguuuuaggaaaugccacuagaaguuuccuuuguggucaagaauuuuaaauaguuccuggaagugaagagaugugugugaggugcaaagcaaggaaggacuaggagaaacagauuggaaaauaggaagaggccccuuaaccuuuggaugauggucugagagcuuuguaggagcuggcugaauaucagugguguggaggguaauuucuugauuauaauuaagcaacugagacuggaauagagaggagaaaggaugagagacagugugagggaugugagaugugccacaggcagccugguagggagcagugagcuagggaaacaggcauacugcuccccuuugaagaaccaacccuaaugguuugcuucagaugucuacauggcgauuacuuggaggagggacaaagaaaaauaugggcugguggagagauccacuuugcuuuugcagccccaaagacgagaaccaggagcacgggguagaagcugagguggacgacugcaagucuuccaggaaggugcucccugauggucccaccaggccaaggaaugaggggaccuggacuauauugggcaucuggccaguaggcaugggccaacuucaaagucacauucaguggggcauggacuggcugauuucaaagaugccauccuauucugagagccaaugaguuuguaauuaucucagugcaacacugcagaaccuuucaauggggcuaugauuagucucaggagugauggaagaucaauaauaugcuuccuucugcaauuucaauggaacuacuuuuccaguauuuaauuucuaauauuaucugaagaaacaacccagagagaagaaaauuauuaaaaaugacuacugauuacuuuuuuaacuaaaaaaaaaauguugaugucacacucuguagucaugggucacacggugcauaccuggccgugaaggaggagggguguccaccccuggaggugcaggaguggcugcggaggguccaaacgaguucaugauucuuucuucuauguugggaagcucucugaacucucgcacugugaagaccagucuggggucauuggugauggucugcagcucuguucugucgauguuccggucuccuaccccuaaacucacaaugcccgaggaacggaucaccugggcgaaccuggacacaucguccugggauuuuccacccaggaccaggaccagguguuggggcaccccgucuucuaugcgacuccccgcagacuuaacaaagagguuucuugccacaaauucgagagccuugccaguguucaguggggaccccccucugagccucaggcgccguauggcguccagcaccggggccugggaucuguagguuuucagauagaauucugggaagacaucauugcugaacugcacgaccccaacucucacuuuacuggggccgauguugagucuucgaacaauccugcuaacaaaaucucgaauaugugcaaagccaucuggccuaacucccucagagcugucgaucagaaagacaaugucugcagcaucacucucaacugcugcagaucaaagaagaaaaagggaaacauucaguguguaaguagcccucacccagguuuggugugcaccuugcaccauaauccuaaucaaccuuaagauuauaucccaagaugccuguguuguuuguaucucgggcuuuuugaaauuagccguuaaaaauuggaccuuuuacaccaaaacaauuucugcuccuugaaauauuugaaguuauccaaaacgugucuuucugaauuuacucuauuuaaauuuuggcauuguggucuggguuacuacugauuucuaaaauguaaggagcauuuagaaaucaaucuugggcuaccguaaucuacagaaucaugaacuguugcuaccagaagagaccaaggccacugggaucuauaucuuuguuguacaagaagagaaacagcugaggccaaagguucucgccuuguccaaggccaucacuuagcaagugagaccccugaggagcccaacaccaucccagcaugcugcgcaaucucagcccaugggggcaggguacguauaacacagugccauauccaaggggucacauuaaugcuccccaggcauuugugcccucguauuuccuuuuugcucacacaucucuagcauuuauaugaaguuuuuauuuuucacuauuauuccucuauuuccuuuucuuucuuuuuuuuuuuucugagacauggucucuuucuaucucccaggcuggagugcaguugcacagucacagcucacugcagccuugaccucccaggcucaagcaauccucccuccuuauccuccaaguagcuggaacuacagacaugaaccaccaugccugugccuuuauuuuuuaaauuucauuaaaauuuuuuuuuuuaauuuuuuggaugagggucucacuguguugcccaggcuggucuugaacuccugggcccaagugauccuccugccucagccucccaaagugcuagaauuauaggcaugagccgccaugcccagcuucccccacccacccugacucauuuucuuuacauuagcgcauuuuuaaaaauauuuaauucuauuaaauaacugguuuaauuuuuuuuuuuuuuuuuagauggagucuugcucugucgcccaggcuggagugcaguggcgcaaucucggcucacugcaaccucugccucccagguucaagugauucaucugccucagccucccgaguagcugggacuacaggugugugccaccacacccagcuaauuuuuguauuuugaguagagaugggguuucaccauauugaccaggcuggucucgaacuccuggccucaugaucagcccaccucggccucccaaagugcugggauuacaggcgugagccaccacgcccagccuagugcauuuuuaacaauaaaauuaaucaaaagauccugagaaagaugagccacauuuuccuauuaguuagaauuuuagguacuccucagaugcuauuuuauuaaacuuguauguugcuacuccacacauuucaaccugcccuuugccucauacacaauugggcaauuuacgguguaaaugcagcauaguggaagcugagcagcucuugugauggagcuguuuaagaaagagagaaucagcccccgcauuggggagcugguccagcacacauggccuugggguucuccuguugagcacacaugaucucacaggacccccacaacagacaaggcuacucugugaucacaauggggcaagaugaaaaugagaccacauuguaacccuaucugaacacagacaaaaagaaaaacauggugcaaaccacaaaaaggacaaaaacacucccuguccugguuaauaagagugacugcucuucucuaccaaucuauaccaaggccauccugcuucuagguaagacuuaagauacagcuacagaaucaccuccacgucuugacaacauccaauccaggccacaguuccauuucuuuaagccuuccacaaaaugaccugccacuagcucaaguccccccaguccuuccggccacccuccuauggagaugcccucaugcuuugccacgguaugcauucucccuggaugccaugagcaauagacccaacuuguucagucgcagguguguccugguggggucuggcuggugggcaugaagaacauaaaggugcugggcgcggugucucaggccuguaaucccagcacuuugggaggccgcagcagguggaucacuugagcucaggggcuugagaccagccuggccaacauggugaaaccccgucuccacaaaaaauacaaaaaauuagccgggcguggugguaugaaccuguaguccuagcuacugaggaggcugaagugggagguuggcuggaucccagaaggcagagguuaaaaugaguuaugaucaugccacugcacuccagccuggacgacagagccagacccugucucaaaauaaaaaccauaaagguaagggcauacaaccuuuauuuuaauuuaauuuauuaugaguaccauggccuuugagccuguuauuuuucauauggaaaaugcuccaaggagaaccuccgacgcccccaucucaccuggagguggauagcgagugcuggcuaagagcuucuggaucugcucugaggucagggucgugaugggcgucagcaguuucugcuccaggcugggcagcucccggaaggugcucaccgagaacacauauucggggcucagcgagaucuucaccagcuccuccuggucugcguuccuggcgaucgugaaaggggccacgccaaacugcuugagcuccaccgccgggucguccaccucaucgucagacuuuccagacgagaugaggaccaggaacugcgggacgcccucuucaaugcggcuccccaggggccucuugaagauguuccuggacacguacuccagggcauugcccacguugaucugccgcccucccuugggccucagccgcugcaccgcguucugcacuucauccuugcuggaaugggcguucagcaggaacuccaccuuggggucaucgcugaacuggaugacagccacccggguggugucaaagcccacguccagguagucaaccagccucucuaugagggugcgaacguacuggaacucaggcccggcacuuugggacccaucgaugagaaagaccacgucccucuugccaccaacaccugcgaaacaaaugugagcauggcuucaccuucaucgucaccaaauucuuagcguucaugagccaccgcccaguuugucauggauucacaggcaggggauccuaacaccaaucaccacuguuaaaaguccaagaagugggaguccugggcauuucaguguuuacacaucaaagagaaggggagcaaaggaugaaaaacccgacggaggcagaaucagaagagccucaucagcaccagcgaggaugguacuugggaaggacgugaccugcacugcaucaggugcugcucagggacccgagggucagccacugggcuucgccagagacagggaccuugucagauggagugaccucaacuggagcacuugggggaggagcaagggugaaugacaaaguagggugggcucagagaggaugggaggaaaggaacuuuagaguauagauaagucuuuaggagacaggugcugcuggcaggggaaguggcgcaucagagaggguguuuaagagagaagaagcaaugcauuuuaucauggauggaaccauccagcacaguggagaaagggugacacaagagcaagaaagggaacugcagauggugccacugagcaggugagaggaaagggagcugaggaagcggagacaggccacccaaggaaccacgggaugacguggccggggacagcucucuuuggguuuacuugcauuuucuuggagaaauaggacucaagauuaccagcugagagucaggugggucaggagaggugugagagaagccuccgaauggggagaagggggaaagagggaggcuguucuggagcgcaggagagugagugggcaaagagccacagcguuguggaaauguacguuccugacaacagaagcugcacccgcacugugacaauauucccaaaguccauccucggcaaucuggggccaagacacagcaucacagaggccuccugcaggcagauacauuuuggaaauguugcauuuccuuucuuguguuggagacacacaaagcgccuuaguuaggaagaaagaaagccucuuucacuuuguuuaucccacuguugcccaaauuuaccugaucauaaaugcucaggaacaucccacagaaaccuggugggccacacugcucucuuccccaggcaccagcgaggagaaaccaagccccucucaguugcacccaaauaaucauccucaccucccucaucacccacuguauccugcagugauuuccuuucacuugcuuuuacuccuuccuccgcuccuccccaacuuuccuucuuuucucuccucuuggaagagcaggcaagugagugcauaugagggagcaaggccgcaucugccuccuucgccacugugaaccccccccacccgagugacccgggagaguggcccuuggaggacauuuauugagagguagauauaucuuuccuccuuccuucucagcaccagggcucccaccauuuuuuaguuuauuguaccaggccuagaaagagggaacaggaaaaagaaaauagaauaaacuauggucauaagagccagguggccuuccugccaguuaagacacuucucagcaccaagcaaagucaaaauuaucuucacaccuuggcucuggagauaccaauauuucagagucuaugucccagcuugcagagugucccuggucagacuccuuccugccucacagaaggcugcugaccaaaccuaccaggggucgcaggacugauacgcaacaggcguuaucaguuagacggccccucccuuuggauaucuagacagaagcuuucaugcaaaguuaaggaguccugaauuccaagcugcacauaugucccuuuuggagaauuuaauuugccccaaaacaugaaucuuagcaucuccccccuugaaccucugccauuucugcccaucgaggccaaaaagggcauguggguuccuaaauuuuccuguaauuuuaguuuucacuucacauggcaggaaaagcaaaauugagaacaccuuguggcccacaguccagacaaguagccccagacaaugacacugagugaggaugcaaagaguucccugcguaccugggcucgguagaggcugcaacaccggcugcagccugcucagcuccucgcgggugagcugggucacccucucagagaugaccuguuggacgguccccagcuggcgaaaggugggaauggccacggcaaaguccgggaugaaggagauggucugcaucucugugaugucagcguucccgaugccaaugccaaugggcacagccccaccccucuucacgaccacggagggguuccgcacaucauccccagaccugucggccgugaggacgaucagcagcuggggcacaccuucuguuauccugcuucccgcagagcugaccaggauguuccucaggacaaacuccagggcggccccgguguugggggucggcccucccagcagggucagcuggcggacagcguugacgacguccugcuuguucauguaugaauucagguagaacucgggccugguccggucgcuguacugcaccacggccacgcggacccgguccuggcccacauccaggcuuuccaccacucucuggacaaacucuuucaacagagggaagccgcuccugacgcccucagagccaucaagcagaaacaccacguccuuuucaccugaaacugggaggaggacagccugguaacucacacaggacaucagagcagcaauuucauaucaacgaggugggcugcauaagagcaucacagggauguccaaguccaaauccccgaacuugagaaaaggacuuugcagaugugauucagguaaggauuuggggauggggggauuacccuggaauuagccaggugggcccaauguaaucaaucacaaguguccuuauaagaggggguaagagggucagaguuagagagaagauguaaggauggaaacagaagucagagaggagagaaagugccaagcugcuggcaaugaggauggaggauggggccaggaggcaaggaaugcaggcagccccuggaggcuggaaaaggugagcagaugaagaaucccuuagaaccugcagaaagaacacagccuguugacaccuugauuuuagcuuagcaacacugguuuccaauuuccagccuucaaaacugucagauaauaaggauuuuuguuuuuguuuuuguuuuuguuuugcaguggaggggucgggggguggacagaauuucgcucuugucgcccaggcuagagugcaguggcgcaaucucagcucacugcaaccuccgccucccggguucaagugauucuucugccucagccuccagaguagcugggauuacaggcacccgccaccacacccagcuaauuuuuguauuuuugguagagacaggguuucaccauguuggucaggcuggucuccaacuccugaccucaggcaaugggcccgccuuggccucccagagugcugggauuacaggugugagccaccgcacccggccuguuuuguuuuuggccacuaaauuuguguuacuuuguuauaacagcaaugggaaacuaauacaccaauauagggaccccuuuuauuuuggaacuuuucaaugcuugaagaguauuguuagcuuucaaagauguauucaagaaaaaacuugggaugggaggagagacaugagauggcagcaccugcacaaccacuagcauuuuaucgaugggagguuucaauugaguugcugcaagucacaaguggguuaaugggaggaaacggaacccagaugucggaguuaccaucccaagccaacggccaaugggcccaguaaucaaaggagaggcucuggagucuucauuuuucaucaaaaggcauacaggggaaauuacucucuucacugcauuuuuaucacuaaauuaaagggguuaaaugaaaagucauggcagugucaauuagcaguugggggauuuuaaugcagaguuuaugguggaaaguuaucuaccucuucuacuccuuuaauuuuuaaugaauguaaugaaggaauuauaacaauauaaaggcauugggugaauaugaagaugaaggcuguuuuagguacaauguaaccauaugauauggcuuuuauuaugcauaccauaaaaacuguuuuuaaaaaaggauuuuaaccacugauaucuaaaucuuuauaacaugucuuacuaugaaauaaucuaaugcccuuaaaaauacucacccucauucuccugagagagcagcuagagaaucaaaguaaggagggacaucucauauucuauuguuccugcugaaaccagcaggugauuaauuuuccaccuuuccuguaaacucaaggagggcuucuaucuaaggaccaguggccagcagccuacccucaacucaugcauuagagaacugaguggcagagcaacuagcauuucucuaccauaccuggugcuggugcuccguugugcacugauuuuaagagauucacuaucuguggaugaagaucuccaaucuugggaagcgacucugcagccaggauaaacgcuggagacagcacgaucugcucuaacucagcagggucugcguucuuggcuuggaagaugaaaggcacaaccccacucugcuucagguuacuugcuggcccauccacacggucagaugaccuuccugcgaccagcagcaccaggaacugaagcacuccauccucgauccggcugccagcagacuucacaaaaauguaccucugugcauaguccagcgcguagcccagguugagggcuuugcccgucuugaucuucauucucuucacaagauucaggaucucaggcuuacucuggugcucaucaaaacgggacuccaccuugacaucaucgcuguacugagccaccgcaauucggguccccucuggcuucacauugagcucaucgauaaucuuguagagaaagucacggacaacagggaacuggcccacaagauuggcugagccgucaaagaggaacagaaugucucgcuugcucucugcaaugaagguagauuaggauacaaugagggacgagagcauaacaggaaccaaagcgacuucagcccagcaccauuugacaacaggaguuggugaaacucaucugaugaccacugugccagcaagagaagagaaaacccaaauucauaccacuugucuugaaaauguccuauuucaaaucagugcauauuugcaaagcuaguaacuagaacagccuaucccaucuagcaucaugcuucuucaauaaagcaagccagggaaaagccccacuggguuguguucuuacaucagguggcaaucgcuccaggaaaacagacagcaguuucaaacuguuacaaauaaaaguauugaaaacauggcccuuaauauaccuuugcuuaaaaaaauugaucucaaucucuagaaaaaaaaagggggggcugauaugggucaaccacucaaagauaacuggguugccaugaaucugcuguaauugaaugaucaaaucauuaaauuugagguuacgggccaagacccacaauagugcccauuacugcugugugggucaggcuccuugucaaugcuucccaaucuguuguaaugagacaauaggaaacacagaugacaggcccuauggcaccgcaauguguaauguaaauaacauucucaguuaaaacaguucuuagaacuauuuugauuagguuucaauugguuuagucuugccauucaucugugugauguuagcagacugguagaucugauacaaccauaucuuaccaccauaauaauuugcaauaauaauaauaaguuagccuuccccuagaaaccauuuuaccauugcaugaagaugcacccuuuguuuguuuuauaacaaauaauuuucuagauacagcagauguugaacauuuaaaaaucauguaaaaauacaauuucaacguuuaaauaaucccaaggcauauucauguaagaaaaaucucucucugucucccuccaccccaugauccccaaaucuggauucgaacuccagaauccucacagucauuagaggaaaaaaaauccuucugaauaaagggugaggcaaaauggacagaacauaagcuggauguucuagacuuuccuucgugaacacccuuuagacagaguccagccuugcugguacagugucucaaguccccauucaaacuauuucaauggaagggagccaauugucuuuguacaguccacagugcucuugaguucagacuggcaaacuacccuccaggguggugucugaggaaggagagggaguucccggcaacaggggagguuuaccuggcugagcgagugguacuuccuccacaccuccacuaacauaugugguuaggggcugaaucagcugcugaggcaaagcuggcagggagcugaaaucauccaugagauacaccaggcuuggguuaaaagcaaucugcucaagcucugccuuauucgccuggcuagcucccacacaaaaagucaggaugcccgcgcgugucaaggcguuggcagcuugcaaauaggaguccucagacugcccagcugugagcagaagcaggagcugcggcacguguucacggauccugcugccgccagcuuccgugaagugguuggcauagacauagcuuagggcugagccuguguucaggcccgaaccucccuggagcugcagcugccucagaugaccaaggauaucugacuuggucugguauguguuuaaagagaacuccguuacaggagugucacuaaauugcacuaaaccaacacgaauauugucauuuccaauaucaaggcuguuaacuagguucauuacaaagucgcgcacauaagggaaauugguuuuuccaacguuggcugauccauccaaaagaaagaugauaucccuuuuguuugagugaacugcagugaagcacagaaaaaaaagugagacauacacaaccacggagaguuuuaucaugugugccuacaacacgugcacacaugccaacauuuagaacacagagaaagucagcauggcaaagcauguccaucuuguaaaauauggcagauggcugcauauuuuccucuggugguggcugguguuugugagacauauugguagccgaguuuacaaaaccaaguuggcucaaagagagcuacaacaucaaaguuagaauguuuacagacaacaaaagugaucagaauccuugaaaccaaacacuccuucccuaaaaaugaauacuaugaaggugcugcaucaguccauaucacucaucccagccagguuuaaguuugccuggcuggauccucuggggcucaccucuacccacaaacagagggucuuccauccauagcucagaagcaguuagcccucacuaaccugagaaaacgaguuccuuaaggcuaaaaaaaauagcaaaaguaggcuggucucauauugaagucuucuucagacuuccccguuugucauucuccacugggacucuucuccuauuaggaagucacagucuugcuaggcaaucauccaacaggggaauucccccaaagugagaugaugggaccguaaauacacagcaaaauagaaggagacuaguugcuaggcuuggccaaacuuauacacaucaagaauaaaaaguauaauucucaaaauaguguauuugacccaacacauuuaccaugugccuuuaaaauuuuauuuuuuauuucuucccugaugcccuacuguaauuuagaccucacaacuaauuguauccuaaguugaacuuuggcuaugaaaguguggauuaaaaguuuuaagaaaaauuuuaaaagagagagaaagagauggauauagaagaccagggagugugaagagaaagcaugcauccaggcagcaugggucaugccugcaucaggcaauccucuagugaucgagucugcaaggugggaaagcaucauucugugaugcucaucuucucuucauuaagggcagugaauuguauuucuucaacucauuagcucauagaucuguauaaugucuuuaaaaauaacucuccacuggcaaucauauuaaaugagggauuugaagaaccacuagguuugaacuccacacuuagccauucaauaugcuuucccauugaggguaaucccuuaacgagagagaagagagggauuaaaagcugaggacacugugcccuaaacagcucagacuggggcuguuuagaaguagauggacaacucaggaaaggaaagcuacauccuggugaugaggaggagacuggacagaaaucaccaguagaaacagaagaacacagggaucugacaagcgauaagaacugagaugugaccuccucggccagaagcuucaaagacaggugguggcccaugguccugugguuuaaaucauaugguucuuauaugaaauuucauugcaugacauuguaaaccauacaauccugaacccagugcaaaaggaaaccuggaauaaaucauguucguugcugcuguuuucaucauuuguugucucuuagcuaaacacaaacacacuucauuuuguuuuguucuuaaaggcccugccuggagaccaccccauugugugucugaagccaucaccaccauaccuucagggguuccagagaggguccugagaggugccagcaagccaggcagcaugccuugcaauggggcggcucggaacucagcugggaugaacaccagggaggagucgaaagcgaucucuuccagcucagccugaucggcacccuuguucccaauggcaaaggccauuaugcugcuucucuucagcuccugggcaggcuggcugauuucaucuagggacuuaccaccugugaucagcaccaaaagcuuaggaauccccucggcagcccgguagccggcugaacucgugaauagguuguuacgaacaaagucuagagcagagcccguguacagggccgagccguccaggggcuucauuuuccgcacagcgguuaugacuucccuuuuuguuggauggguauugaaauaaaauucaggccucacagugucugcauacugggccacugccaccuggauaagauccuguccgauuuccagccucuggaugacuuuagcaaugaagucucggauggcauugaaguuggccagucccagugcagaugagccauccaccaggaagacuaugucucucuuguugacuucaaugacuguagguggcaacauuauaaggcaauuagaauggccuuaccaagcacaaucaacaaugacuuucaacaaagcuaacuccauuuaaaggacacccucauuuacuguggccaacgugaccacagggccaccccaaagggaauuuguccuaaugaacacauaaguuaugguugccuccccaccugcuggaggaaagcuggcucaccuuccacccugcccagucaguacuuuuuacaaaauaguugcacaaaaacaaauuuaguuuuaguagccaccuguuuuguaugcugucacugaaaauucaauaaguucucuucugccguaaauacacaacuuggccagagugaagucauugcuugaauaauuaaagaaaccacugaugucugcucagagaacccuuugccucacagucuucauuucaaaaugcucauugucaagugcaaaagcugaaagagccugcacaucccuguucucuucaguucuauauucccugucuucauuugacagacgaaagaauuacuuaacauaaaacguauaaaaaggaaaucagcaucaaagccagcaagugccgcaaacauuuuucacuuaagagaccugcguuuuggccaggcacaguggcucacgccuguaaucccagcacuuugggaggcugaggcagguggaucaucugaguucaggagcucaagaccagccuggccaacaaggggaaaccccaucacuacuaaaaauacaaaaauuagccgagcgugggggcagacaccuguaaucccagcuacucaggaggaugaggcaugagaaucacuugaaccuggaaggaggagguuccaguaagccgggauugcaccacugcacuccagccugggugauagagugagauuucaucuccaaaaaaaaaacaaaaaaccuguuuuuaaagauccuaaguaauaugacagugauaacuuaaaggcaaaccauaaagcaaaaacaucucaauaagauaacugucucacagugacugugaacugcuguauccaugugcaggcacccugcccauauugcaagaaccaugaacucuguuaagaccacaacaccuaacccaaaaaccugacagagauuccaagaaguagaggaacauaaaugauuaaaccugagauggacuguuuugcaaaagaguccucuguuacuguauuccaucagauagauugcauggcaaguugauuuuguaaaagcagacaaaggaaacaaaguuugggaugaagguaaggaagaacuuucuaagaaucagagcuaccuucuagaacauauuuuuauuuuuauuuuuauuuuaggacagaaucucacucuaucacccaggcuggagugcaguggcaugaucucagcucacugcaaccuccgcuuccuggguucaagcgauucucccaccucagccuccugaguaguugggauuacagguaugcacgaccacgcccggcuaauuuuuguuuuguuuuguuuuguuugguagagaugggguuucaccaugcuggucaggcuggucucaaacuccugaccuugagugauccaccugccucagccucccacagugcugggauuacaagggugagccaccacauccagccuagaacacauuuuugaaaugcaguucauuucuaguuguuuggaccagaagcugggagcgugaugccuggggugagaaucgcugauacaugccaaaugaagacagcagugccucaucugggugcucaccuguagcaucaagacaaggucuauguucuaagagaaggguaacauguuaugcaccaacguccuuaauacaauaacacaguugccuacugguguaacaaugugugcagaacaucauugaaccuuuucucaauauuucauggucauuguuaugaacauccauucugggcuuuccuuccuucauuuaauuuagaacaugcugucucucugggcuaccccuucauuuugauuuaaaauaucuuugcagauaaaacuaauguguagaucucuagaagacuuauaccuuuguaccauuagagagaauauauauguauauagauacacacauacacguauauagacacauauaaauuccauauaugcuauaccaugaaucuaccacucauguauuuacuauguauaucacacaugacagaaaaauagacaaauacucauauaacaaugaccugagaagcuacuugcuccuauaccaaguggcccagauuguuauauucuucuuuauaaguaccagcaauggcacaacucuuggggugggagaagauaaauaucauccccuacccucccacguuuucccucccccuaccacugcaucacuaaaaguucucccgaugagccagcgggaaggaauaccuucuagaucuaaugaaacaaguggccuagucuccuugcacccaacaaggauucagcucugggaacccugaaaugcaccucugguucccagaggcucugucccagaguccccuuugauuagguaagaggucauuuacguuugauuuuuauucaagucaugggagcucaugacagaugauaugccuagaaccaugcuuagccaaauauaguaaacacugaaaaauauugaguaacuggaagaauaacugaauuccuauguuugcuucaugacucugacgcaauucaccuaggcuuugcagaaucauuucauuucucugggggcugcaccaugaaucuccucugacccagugauaaaaaccuugggauucucacagcugacucuucugugagccacgucagggaugcauacgcauuuccuuccacuugacauaaauaucaacccaaacacagcugucuuaucucuuuaauguggcucugcagggccugacuucacugccuuguugggagaugaacuugaagguccugcuacuccucaccaacauggcacaacccucuucagcccuccucccacgccucucucuguuuuccuccaugccucaucccugcaccuccaucagacucuccugaaagccuccaucaggcccacagucuuccucaugcaucacccaagcaguggacauuccuggagaagaccacacaacaagguaccugcaugccacgcucggaacuccagacccccaucaggagaccugugccugcccaccauccucccaugccuccuugggaaguuggcuguccuguccuccagaaugacugucucauggcugugcucucugcucagcccucugccacugccuccaaggccuccucaucugucucugagaaaauagaagcccucagaggagagccccugcccccaccacuaacccacagccuaccuuccucugccauuggcucccaacccacaggcuccacucccuguggcuucucaucccccuacagcagcugcuucuccagcuuccaugcauccagggagucugaaccucaggcucccuguccagugugcuccagcuacacugccuucugacaguucugggaagggacuaagugccuucuuguugcagggccaccccuccugcucuuccuucugccuggaccacucuucccccugcucuccgcaugcucaucugccuucgguuccacaccuucucagggccuuccauccaccugaucuaaaauucccuuccccagucuuccuaucacagcccuguugaaugccccaaugcaacuuaucaugcucagaauauuuugccuggucacuaguuuauauuauuauugucucuuuccccauuauccuguaacagacgagcagccacaucugucucauuaaacagcaccauaucucuagugcuuggcauagugucuggcacaugccagauagucaaggauauuuguugaauauuuacaaguuaaucauugauauuaaacaugauguuuguaaucaagggguugaaacucuacuuggcuagggaaaaucugaaacaagggucaugugcugcccauuuucauuaaaaaguugaaacuucuccugguacagacauaucuucaucuggugcaacuccuuugucauaaauucaagaaaucgaaacccagagagguugcaugaccugcccaggaucacauggcagguccacagaagacccaagaccagagaccagcuuucccaucuacagccauguugcaucgucggugucugcaaaacauagggaaaucucugggcuucuauacuuugggaugcacaccaauaguaugcaagcucagagaaaccucagcaggucauaaauuuucacuugauuguuuucuuaauugccagagucacaaaacggcaccaugauggaaugagcaugagcagcuccaggcaccgggcauguaguccuguacacuguuuccauugcuucucaauguccauuugcauucagaacauuauuuucaaaauucuagucucucuauuagcucaucuggaggauuugggccaauuuuauggucccaucaagugagaggaaaagcuggaaaacuguaugcagcaaaagcuaagccacacagaauugaccuuucaaacuuaaauaaaugccagacacagccuucuccagaaggcaacacucacauauacuuuucuugcuacaucaccuggucacaguuccaaugcacagauuaaguagagaugccauagccugagcuuucuaccuguaauuuuuauuacaacaaaagcugugguuuaaaaucauuugaggcaaguucaaucuaacucagugugaauuuuguaacccuuguaaggaaaugugguguguugccuuuacaugaaugcagcaacuagaacuaaugauuagcaaggcacuauuaaguagaggucagcuccuuaaauaaauagauagugauguuuuuaauuaagacuuuaaaaucuucuacucuuaauuucauacaauggcauauucuccaaaaugguuauuuuuaaauuauuuucacuccuuuaucaaaggaaaaccucccuugaucaauuguaauugauacaauggguaaagcaguaucuuauuacaauauuuaucuuguagacccagacuuuauuuauaaaguuagcaaauaagaguuguaacaauguguuauuucacccaagaaaauuuagaugauugguugcagaugauaaucagagucuuauaggagccucgguauccauucaccaauuuucauugagcccauacucuggaaggaaaaugaagaauaaggucuuauagucaaggacuaaucucauuagagcaucccaguguguaagcaacacuggaagugaguuggguguuucuggaaacuguugggggccacugugucccugauuuaccaaauggcauccuauuggccugaccuagguaaugaaauugauaggucugaaaagugacugaugucucagaaaacaguucaaaagguagaggaggcuaugcauccugaugcccccaccauaccuccuauguuuguuaagugcauauuuguuaugugacuugguugguuuuuuuguuuuuuaaaccacuccaauuggcuguuuugccaaaggcccuccauuugagcuuguauccuaauauugccacucaggagaauuacuccuacacuucacaagcacaagaaaaaaaaaacuucauaaauauuucaucaagugauuacacuguuauuucuuaccuucagaaguauaacucucagcacccuagcacaaaaugacuuugaggagacacccucacuccaucuuugcuuuuggaaagauacucugucuaugagcacacuucuaacacugacuuuuagagcucaaugccauaguccuggaguaacuuucucagaacuguaaugagccccucaagcccauuuuuaggaagacuggauuauaaguaguuaauacggugauguuuaauaaucucaaagcaacagguuuguugaauuagccuuaaaagcacgcuuucucagcaacucauacucucguaagagcuuucacucacucauuggucuuuaguuuuuccgcacacaugacaucacaaacaugacauccaggacccagcucaucagggaaggacuggacuguggguacuuacagcuucucccguggcgaaucaugcugguacccaccuuacgucuauguaaaccaacacacacaacaccccacucccacacagauggugagaagaggauacauaccuugugugacaaugguuggcgguuucaagacaaugugccuuugggccacgccaacaauguacggcaguaauuucuccuggagguccccaaagcuacggaauuccgggacaguaaacaccaaguugucaucgguagcuaugugcugaagcucugcccuggaggcggccugggcuccaaggccgaaugagaacacgcuagccugcuucagugcuaccaccccguagcgaaucucgucacuagaaggcccggcacuuaugaggaccagcaccuggggaaccccuuccuccacgcggcugcccccugcccgggugaagugguucuccaccacgaaaucaagggcgaggccgauauuggccaacuccccaccagcaaacccgagggcuuucacugcacccagaaccugggccuugguggaguagguguccaaggagaacaugguucugggcucaucgcuaaacuggaccacccccacucggaucugcugaguuccaauugggaguuucucaaggagauuuacaaggaagucgagaaugacugcgaaauugacacuuccgguguuguuugauccaucaauaaggaaaauaaugucagcagagucuugugcuuuaaaagaaagaaaugcaaaaaaugugaaagcauuagaacaagugaccacaugcauuauucaguguucugacauguuucuuuggaaaccaauaagaaacacgaaauaugggcaaacaaaacacauguugaugaaggaaugugaaauucucuuucaguucugcauucugaauggauaagaggcaaccucuuagaaaucaugguguaaaaaagggacauuuauagcaauuuuucauuugugccauccucauaguuaaauuuccaaacaucauauucacuuuucugaggggacaaucuuggguacauauucuagaaauuuccacuaaauuuggagggaaaaguaguagcaugaauuguccacuaccaaaccuaccagggaaaaucaaugaguagguuaccaaaacuuuagagaugauuucuaauuuuuggucauuucuccugccuccucaaaugauuagaauaauuuuuuauacaaauccacagcuacaaaacagagucacgauuuggugauuccucaacccaguauguugcuggaugccuucagaaacuauuguuucuucucuuuucuuuaaaaaccaaaaugaccuuguacaugcaacuucgugaaucagaacucaaacuacauuuaaaguuuucauguaaaaaauacuuugaugaaauuuuuguuguucuuuuuucucaaaugauguuuaguugcauaaaacucaaaugcaggucugggauugggcaggauguuuuguucauuuauuuugucauugccucuauauucagucacuuaaugcagaacaauguuaagcagagugauaugaaaccggucaugacauaauuauccaaccuuguuuuuaugacauccuaaacuaguuaccuagaaggaccaugagcaucgaauaaacccugauuagaauuagccugggguuauacaaagggcagaaaaacagcugaccaagaccucuucucucccccauaauggcaaacagagaauucccaaccugaugcugagaacgggguuauauagcagcccugagggaggaauagggaucgagaaaucuaaaagucagggccagagauuucacagcaucaguucgaauguuuaaauuuggcugauuuaaacucaaggaggagcacaauuauucuagucgauguuuuugauaacuugaguauguguuagggacaagaagagauuauaugugagcuugagcuuaucuauuuauauucugggauuccagaaaacuacacucaggguaucauuuuuaaaugaugguaauauuauagguaagaccauucacucugaucucugaucuuuucaaugacagugaacauuuuauauuuaaaauuaauguuuccuugugccaacaaaauuguuuuuguucucacuguagaaaaggauccaaagcuugucucacaaaauugaagaguucugcucuagugaaauuacauucuuacccaagcucuucucauugugugaacugaaacagagauugccagguucggaacugcccucuucccuuccuaauauacaagaaaguuccuaacaauauauuugcagauuaauucuuugcauagggaaauauauuaaccuggcaacauugcuaucacaauccuucuuauaagauacaaugaguaggauaauuguugugcuacaguaauuaagaucuuguguuuuuaguaauugccacacaaaaguuuuauauaagacuaggcccuugauuagggcccaaagcauuugccacuguucagccaaaauauaagauuccugaaggaucuucaagagaguguggugccagggggugugaauuacacagaaggccauagaaauggccuacaucauugcauaauacagaggcuccacaaauuccacaaaauuccucaacauuucccaggccuaaaccaaugaccucaaaggacacggaaggauuugccacuuccucagcauaucaagacguuuaaaagaaggauuaaauaugaucaauacagucaagcuuuuaaaaaugaucccuaagucgcaggauaacacuauuucuucuccauuuguaacuuacuuuuggguugaaauuuauagucaugcaaauaagauaaauggacccugagggaaaauccuugaacauucucuuguaaaagacugaacaucuacaguggccagucauagaaacacguuggauaauuugucaucacugaauaacaacauuauccucuuacacacacaauaaugggacauacaagggcaugcuuuguuauucaagagagcugaagccucaagggcacacaggggccaugugugcuuguguacagcaaggcggaccaaugaccaauguuaauguuacaaggaaucagaucuaugcacaauuuaaaagcuuuaaaauugucugguuuucugcuucuaugcuuuauguaucacauccucugugguguuuucuacagaaaaguuuuacaguguccaaggaaaauucacaguuuccuuugacaucccuggaagcucuuuucccgagcucacuggugugggcacaaugccuuucuuagcucaugugaugccuccuuucauuaagaaaaacaaguucccauucuuguuuccuauguaaaacacaaaauuguauauauauuuuacaaauuuuaaaaaucuucauccuuuacagagaaaagaaagcugaugccaaaauccucccugucaccuuuagcuuuuguuuuaaaauaaagguuuuauaucucagguauauucauuuuuuuaaagaaugacagagggauuuuuaaaaacacaaccauuagagauugauuauuugaguagaguucauugacaacaguggugaucguucauauuuuacacauauguguguuuuauaaucaagaacacucuauggggaaguuacccagcagacagguaguaagaagaggcagcccuaacuaauuagcaaucucuauaaugcucuucuaacuggcuuuccaaaaaacuauaagcagagauguacuguucuuccuaagauuauuauccuauguuuuugccguggaacaugcagcgggacgugguacuaggaggaacugcagagugauguuaauuagaaaagacacaugaauggauuaauuuucugcccuggugcugcuaguggcuuggacacuagaagacagagaugcuuucuuggcauaaaaacaaagguuuuaucaucuguguggaaacacacgauguugguaguuucauuuagcauucacuaugguaaucucauuguuuguccauuacauaaugguuaaacauaaaggcaaacucagcuauuuuugugaguauaacaaaacgucaauaaaagauguuccauuucucuacuggucccuuucacuguuuguuuguuuguuuguuuguuuguuuguuuguuuguuuguuuuagacagaguuucacucuugucacccagacuggagugcagugucacaaauuuggcucacugcaaccuccaccuccuggauucaagcgauucuccugccucagccucccgggauuacagacgcccaccaccacaccuggcuaauuuuuguauuuuugguagagacgggguuucaccauguugaccaggcuggucucaaacuccugaccucagaugauccucccgucucagccucccaaagugcugggauuauaggcgugagccccuuucacuauuuuuugguaggucuuuguuauuaucccgauauuccgaaaugugauggaucagggaauuaaugauacugagacuaucguagcgaggagugcaguucauuguagauacccucuugucauuuccugguaaccugaguguuugguuuggggugcucuuggagacacccagcuuuuccugucauuuggcaggacugaugccugugugguaaugccaggggugaggccugucauuuggaagcagggaacacuuugcaguguuugaacugccucucacucuuuccuauggagaagcagacccacagguaagggcaucagcacugccagccccguuaaagcugaaaucaggaguaaccacugggaaaaccauuuuaugaacaaacuucugaaacacccuggagcuggcuaguucugaaacccucuucuucaucaaguucugccugcucaagacagcuaguuccuuucugcugauguugggucaucucucuucagcuccugcuuucugaauccuuguuaugaaaaacugacaucugguacugcuucucugcaacugcuccagcauucugauugcaaucuugcaauucuucugcugucccuccgaugugguccuguagagugaugugugccuccaagccucaacucucuuuuuccugccccaccauccauguguauucacaagagacugacucuccaucagucaccucaccuccuaccuccugucccaguggccaucuuggugguaaccauuuuuaaaaguguaggagaaaaaucuguucauaaaucuugcuuccuaugaucaguuccccuaugccaugugguugcccacucauucuuuuuugauucaaagaauuauccacuuccucaugccuacuaaauacacagaagagagucuccaacauuccuacaugauuuaguuacauuauguucagccugcguucacacugcagacucuguggucaucuccagacuuuaaggucuguauggacaaccuuugugagcaccacccucucugguuucugcaguggcuggcucucuauaguuccuacacaucugaggaccacacugagcaccauuggaaacuccuccagccccgcgauuggcccucagaggucucccugucuacacaccagcagcgucuccaacuugcacacucagcugucuccaggacucuccuuccgagaccuggccucucauccucuggcucuucagaggucuccuggcccauuccagcucucauuagcuccccaugcagcuaggacaccauggcaggcuguuucaggaauuuacuagcuaccacucuggauuuccuuacugagaaaauuuucuucuguccucucuauuguucccucuuugcaaguuccaguucugggaacuccuuugauccugggagugccugagauaucugcagaaaggcagggauccacacuaauggagacacccacugacuuguaaucucugauagcaacuggaugccacuucaaaucagcaguugcuuccugaauguuuugugaccccucuucacaucccuauagcagcugaucaaaaauaacuucaaucccuccaagcccccaagccccacugcuucccuccuuuauugagaugauggaugucaacucaacuugaacucucucaaugugccucuuauccaccugaauaucuuggaaacacagccccuuuucucaugccuucccuccaucucagagaacaugugugucuccuuucuggagcucaacucucccccuggauuccucucucauuuccugcucauuccacccagaauucucugcuaccaacuaucaaauggcugcauggacucauuuucuaacaaggggaggucccucugcucugcccaucgcugaugaguaagcucugggcacucauuacaguugcugugguaugguagaguuugaaauuguacuugucaaauuccuuccccauuggccauuuaggcacuuagcccuggaaggagagcuaacaggcuuaacugguuaaauaaccugucggccaauuagcucuguacaugcaacugcacaugacacaucgaugcaauguccgugugcucucaauacuuccagagugguucucaucaacuccauuagaauuagaagagucucugugggcacagccaugauuaccgcauggagaagaaauaagaagaccagacccacagcccaaaugcacagccuccagcuccggcugucacuaaccauucaggacuaaauuuuuuccaaaaucaaucuagacuggaucauagcugagguuucuuguaauuccgauucuaccaacacucuuaaauuaacuccguaaaguagaagagagaagcucucugcuaguccacuggacacaaaaacagaugcccucgcucccgucucaguucacgcacucuccaacagggagcuuuccuuaaaggaaacagaucccaacaccaaauagaggaguuugaucagaugcacaccucaccacucugaggcuuucuuuucuaaggaaggcagagguauuuugugggaucauaauauuagaauguggguuuuuuuagacugaaaauauuaguuguuuaaaaaaagacucuucuuguauguaggugaaugcccuacuuggggagaagacuauggaagaauauuccaaaucaaaccuuuguuuuuaaaccugugaacacucaucucuucccuggcccacccgccauccuagcuguugcuuuaaggccagcaguugccaagcucaucucccaagaacagcagggcagggcguagcuugguggcguugccauuaccugugaugucuuuaaggguuuccguguccccagcccuuucuggacucacggaugaaugcacacaggacacuaaguuuccuacuaugucaugaagugagguaaaauucucuagguugaacauaugcauauugagcgguucacuugcuauuucuuuuaacgcuccuucaucugcauccucaacuccaauugcaaacacguuaacaucagcagacuuaaguuccgcugagggcagagcaaggccauccuucgaguguccaucaguuaacacuacgauaaccugagggacuccgucaccggcccggcuuccagcagccuuggugagguggcuuugcauuauguauucuaauccuuuuccagucugauugguucccccaauauaagacauguuggaaauaugagaaaggacuucuuguuuaguacgauacguauuuaacaggaacucgguauguggguuuccguugaacuggaccagagcaaaauggaaaucauuuucucccacagcuaaggauuuuacaacaucauauagaaacucucgaacaaguuggaaauguuccucuccaaugguccaagaggaauccacuagaaauauuauaucagcagccgcaccauuuuugacaucuuuaaaaaaagacauugguuuagauuuuucuacuauguaagcaauuacuuccuaucaaugcaaagccuuccuaaacaaauuugguuuacacuauacugcuacuaaacacuucacaccucacugauaauacaggaagguagacucacuuaccugggaaccagggaccugagcccaugcacucaauagcugcuggugcccagucacuagcccaaguuccauacucagagaccaucaugaaugggccaguagcaugcuccagauuggggaaacaauuuccugggcugucuuuaacucaaguaugauucccuguggcaguuugagccccaagacccaccugauuaaaccagaaggaagucuuaucacagacaaccaaccaucauuuuauaaauucauucuuuaguuuggaauacaaaaccgggccuugacaaaaaaggaaaaguaaaaauugcuauuuuccauucacuaacccccaaugcuuuggguaauuugcgugaaaaauaaauauaauaaauacauguucuuuaagcgaggaggacuuguguaaauguagagaagggaaaagacuuauuuuuuccagauuuuuugagcaugaacaaacuguacucuauuaguuacugcauauuuuucagagccagaaaagucuccauagaugucaaacauuaucuaucucauuuccagaugaacccaguucucccucaagggugggagcucaggguaucaggcugucaguggccccaggaggugcccuucugcagcugugagccaggcuugcugcuggacucuacuuaccucaggcugaccugaugccccaacccacguucuucuuccauugaagugacacuagacuucccuccaucuaagagcaaccuggccuggaggaagaaucccucagaggccaagcucucugggucaaggagagggagacccaccugaguccuuuccagcuugcaaugcaugaagcauuucccacuuuucuaaaacucugaaaucaaauucuuaauagaguuaauuagaacccaugcuuuuaauucguuuugggaaacagaaaucuuaaagauucaaggauccuagaugaaaaaugccuuccugcaucuggaguuagagagagagggugaucuuuguauuuuucagggaaaauaguuuuuacucucaaucauugacuucucccuacuuuaugugcucagagaccagccaaugccagaaauguggaaagucccuucaggugguaaaacauuugagauacaaacuuuccguucacauccaauguaaaaacaaaucauuuucaagccaauuccaagauaccaaacccaaguuuuaauaaaaauaggucaucucucacuggauaaagaguaucugaaaaggccuauaaauccuagaacuauccuaucugacuauccuauaauaaauggcuuagcuaccuuaagaacauaucuaagcucuaugucagugccugaugucuaagaucuaaaaucaaagaaugauauuccuuuuuacaaaaucaaggacguuucuggcucuuaccugcuugcugcugcugggcaugaguuguaggaaagccugagagaaagaggcaaaagacggccacuaagggcaagugccgauguuuccucauuuugaauuugucuaagcaccaaauaugaaccuaaaagagaaaacagggcaaagggaaugaucaguuuuugacucucauuaugcaaaaucucucaaaaucccaugcuuucuacguccuuuuuagacuuccaagaagacuuuguaucugauucauucuuugaaccagcagcaaaaggauggaugauagacaguuagauagaugauagauagauagauagauagauagauagauagauagauaaaaaucuauacagauacauacaugcgcacauauaugcauauauaaaaggaaggaaggagggagggagggaaggaaggaaggagaagggaagggaagagaagggaagggaagggagaagagaaggaagguaagggaagggaaggaaggaagaagugaaagaagggaaggaaggaagaagugaaggaagggaagggaaggaaggaagaagugaaagaagggaaggaaggaagaagugaaggaaggaaaggaagggaaagaaaggaaggcgagagggagggaaggagggaaggaaggaaggauggaaggaaggaaggagaagaagagaaagaagcagaagaaaaacaaagaggagagaaggaaagaaagaaagagagaaggaaagaaagaaagagagaaagaaagagagagagggagggagggagggagagagggaaggagggagggaggaagggaggaggcaaggugggaaggugggaggaagguaaagaauagguaagugagaagugaauaggcagagcucucugucuaaagggaccucagaccucuucuuguuagcagaacauaggucaccuguaauggcacugcucacucuccucucuggacauucuuaaacauaguucaaagaacacaauuacauuuuuagaaaauaggcauucauaguaguuucuccacaaucugaaaauauucucuuucuuuuucaaauuacuaaugaaugaaaaauuuauccauuaugaaagauaguuuugauuaaacauauaaaugagaauuuuugaaucuagugacuauuacuuuggccacagcuaaaaagcuaugcaauuaaaccuucuuuuccucccuaagugauguacgcagcaauuuggaaauagcauauuccuaagcaaagagcagaauggaaaugggucaggaguaaaagcacucauaggcacaaggcaucagguuuugacacccagcuuaaguuuguaagucauguuuaaaagaaccucagaggaaaguuucaguuuauggagagaacgggcuuugcccaaauuacaccaaaugcaacccaaccacagcagcugggaccaugucaagccuuguccauauucucuauuaauauuuagcacuuuuccuccaaggaaaaucugccauaugccaaccuccaaucucacaguggaaugagccuggggugauuuaauuaguaagacugugaagccagaccuggaggcuaacugcccugaugcagagucucccauacccacgcgccucugggggccgcacacaugaugccccaccagccaaguucacauucacuucagcucaguagcgugcgccaucagaccuuuccccugccaacaccuuuucuuccuaccacaagaucuugugacagccucuucacucuccaaucuccaaucuaagagaucagcuugggggcuggggucucccuuaagaccccuccagagagcuagggucuuucugucuaggcugaaguccccuugccaggacagcaucuuuuuucuccucuccuuaaugcaggauucugguuuccuuuaacuuuuucuuagaccacagacggggcugcccacaggacccugugcucugaagggccccaugcucaguuugaugcuuugauguugcuaucuuggaauucuuaaaacauuugaacgagaagcucauuuucauuuugcaaugaugugcaugucagugacucuucuuacccagacuggccagggguuccccaguuaggagcucucuggucagggguucccuuuucagagguuuggguaacaguacuggggaacaaggccauuggcgacacagguaggcuaggauguuauuaaaccgcuguuuugggugccauguuaucaaaaguuauucagcaucuacuaugugaucauugcaguuuuucauaauuuuucauaauguguguuauuuaucuuuacauuauccuuagagguagaugcugauccucaugcuuacaggaaaaaaugggggugcagagaauaaguggccaaggugcacaacuauucagacaccuuggugcucaauagcaccugccacacugaggguucauaagaugagaggauaagaagaacauuuuuauuucuccaugaaaaccccacgauuccauagcaacuuuucaaucaaguucaccagccugaauuugggcuuuuuaggaaucagaaaaggagccagagauguuggggaaagacaaggugcuuggaaucagauaaaucuggauccuggauccaccauacccuaccucaggcaggugguauacuugcucaaagccuccauuuccuccucuauaacacagaacaaugauagccaugccucucuuccagcccucugugaggagcaugugguagccuguuugguaaaugccugacgcggaauggaugguaagugaacucuaacuaccauucuccagcaacguuucauucaucagcauuucccaaagcacauuucauggaacacccauuccauucgauguucuaaggggaaaaacaggcauuccaugagcaacgcaguuuggaaagugcugaauaccaagccuccuucuggaacaguuacaauauaccuuaauauauagcaguucugaaaaauaaaguaaagaaaccugcuguacuugauuuaacccagaauuccccaaacacauuucaugggcuauuccucuccaugucuaauuuugcuaagcucuuacuccucugaagcagcaaccaaaggcaucuccaccugcccaggccuccacugagcccagaucacuggguuugcaaauaucugcucucucggacuccauuaacuguaagugggacccaugucccuugaugguggagcucacugccucccugugaccaagugagagaauuagaauggguagacgacugacauuuccccggagaagcccaggggaaggaccagacucaaucucauuaucagcaugaacuuucaugacacuaguuaauauugucauuuuuucuuauauugaguuucaggaagaauuauuugauauuggaaaugauauaguguagacuacaguuaaauuagaaauuccauuugacuuaagaaacugaaauacauauaaucuagggagauugaguuuucaucaucauuucacuguuaggguuugaagguuaaaaagaagucuguuucacagauuacagcauguaaaggcauucagcaucagugugaaugaaaaucaaaaacaucuuucuggguaucaaguauaugucagauuuugaaaugugacuuuuuucaucuuauaauucuaaaacuccaaaugcuuacagauugguuuuauauccccugcaucaggaauaauuuggcaauucccugaagaaagcaaggggaaaugagagcaaaucaggcacgugaaauuguuuauacaagacuuuggaaagacugacaagacuacaugagaucuguaagaagugaggaaaauagcacaccaagaaacuggauaaccuagaaaaaaaauagauauuugcuugaaauauacaauccaccaagacugaaucaugaagcaauaaaaaaaauucugaacagacuuaaaauuaguaugggguugaaucgguaaucaaaaaccuuccauaaaaaaaaaacaaaaaacccaggaccagaugucucuccuggaaaauucuuccaaacacuuaaggaagaauuaacacuaauccuucucaaacuuuucucaaaaaaauuaaagacaaaggaacacccccaaacucauuuuuauaaggccaauauugaaaagaaaaauacagaccaauaucccugaugaacacugaugcaaaaauucucaacacaauacuagcugaccaaaucaacagcacauuaaaaggauuauacacucuaaccaaguggaacuuauuucuagaaugcaaggauguuucaacguaugaaaaccaaucaaugugauacaccacauuaacagaaugaagggguggaaaauagcaaagcuugagaccucacacuuauaauuucaaaacauauuacaaaaugguguaaugaaaucaauaugaugcugacuuaaagacagacauaugaaccaauggaacagaauagagagcccagaaauaaaaccucauguauaugaucuuugagcuucaacaaagcuacacaguggggaaaggcuagccuccaucguaugaauguuccucaaaaaacugaaaacagaauuaucauauaauucaucuaucccacuuuuggguauauccaaaagaagugaaaacaggaucucaaagauauaugugcacacccauguucauuucagcauuauuuguaauauccaaaagauggaaacaacuuaaaaguccaucaauagaugagaugaauaaagaaauuaauucauuucaacaguguuuuauaguuuuuagugcacagguuuuuuucuuccuugguuaaguauauauauguauauauacacacacaauggaauuuuuugcaauuaugaaauugauuauagauuuccaaggcugcuuuaucauaaacaaagagucuuccaggacugugaagcucagccacacucugagcacagaguauggcaaaaugccugucuguaucauuguagguguauaauaaauauuuguuaaauucauuaacugcuauuccuacaguucuccuaggacuuugcacuguuauuacaccacuuauacuguaauuuuuuuuuuuugagacagggucucccucugucacccagacuggagugcagugucacgaucacagcucacugcagccucaaccucccaggcccaagcaauccuuccuucucagccuccugaguaaaugggacugcaggcacacaccaccccacccagcuaagcuuuguauuuuuaguagagacaggguuuugccauguugcccaggcuggucuugaacuccugggcucaagagauccuuccaccuuagccuuccuaagugcugggauuacaggcgugagccacugugcacggccuacuguauuauacuaagucuuauacaugccacauacaaggaauauuauucagcuuuauaaaagaaugaaauccuuuuaucuacuacaacauggaugaaucuugaggauauuaugcuaagugaaauaagccagucacuaaaagacaaaugcauuacuuuauaauuccauuuaugugaagguauuuaaaguagucaaagucuuagaaaaagaaccuagaaugguguuggccaugggcugucaggagggaggcaguuguaguuacugucccauagguauagagcuucuguuuugcaagaucaaaaaguuauagauauuuguuguagcacaaggugcguauaguuaacacugcuguacuguacacuuaaauauagucaagauaguauguuuuauguuauaugguuuuuaccacaauuaaaauagaaaugaggacaggaaauaucauuugccagguuuuaaaagcauggguaacuaccccuaaaauguagccaucaauuuaacaggaaugauguaagugcagcaucucuuuuuugaggugugauagaguuuaagagcuacuaggaaaaaacaguacaacuaaacauccuaaagugugucuacaugccgcuguauucaaauaacacaauguuugcccuuacuucuaaauaagauuuggaaagaaauaagaaaagaguauaugucaugcaaaauguuaggguuuggcaaagaagaucagagucucaugaaagugggaaagaaucuaauaugaacauucagaccuggugcaaacauggcuucugccuugacuaguauccucugagcuuuggaaucggcuccacccaaggccugagcuuuuguaucucuaucuuaaucuuccucucuccacaggugcccccaugggcucugcaagucuucaugguugucuguuguguagcacaggaauuccauuuuccccauacagcuaaugaaaucagggaugaggaugaucuaauguucucagccuugccaccugaagauugauagcagaggagagucuguccggcugaugagugauguaacuuugccaugaauggagcagcagacuaguguccagauggaccacuuagcaaagguacagggagagccacagagagugauugaggcugccagucaaggacaggagcuaagugggugcaaaggaaaccugaagcucagucccguggauuugccgugaaauuccuccugccugaggucaggcccagagggagaagcuggaguccaaaucuugcggcccagcuaugaggaagacggaacacagugugggcccuaggccugacccgccaaaaauuggugagauggagacagaugaagccacaaacaagggaaugaacaccaggacccauguggcuuuggauuuccaaagaaagucaacaaaaaguaccaccugugaugaaacaaauguacccugugauucagauucugagaacuugaagccaugaucucagcagcuaaaauagaaccaccugucaauacagcagucucuuggaaaugcaucaacagugagaaaggaaugcuguucuaaugaugcucaggaggccaguuaucaacagaacagauauuuuucugcaacaaagugacagcaaugaguggugauagcggcaguauugcaaaagcucagcccgauuuuuuuucccuugcaauggucacugccuuuuggacauggauauauguuaacacaauguagaagagcagucuccagugcuugugcugugguuugauaaugcucccaagcuuuagcccggucgcagcacagcagggcucagggacccccgacaggcuggacugccuguucuccucccuccacuuagguugacccuacccccaccgugccacagccccaacuuugccccuucacucucuaggaaucccucaagcccaugcaacccugggaaccuuccagacuuuuccaccaagcucuaccuuucuucccuacagucuguuagacccauuccugaguguuucuucaaauaaaaaaaaaaagcaauugcaauaucuaauuuuuuguaugaccucaauuaaauaaugauauacacuucagaauaauauaaaaguacauuuuauaugugcuauucuugauucguucuaucaagcuugagcgucaauuuuuuuuuagcaaagguaagcuuccugcuagauucuuucuaagaaaauggccuguucuuuccaaaacaaccuguauuauuguaacugguccagaucaauguuuuaauacgggaucaacagauucaaagagucuaugauccucccacaguugagugcaaaauugcaucuauggaugaggguuuuucuggagauaaggguccauguuuguaugugauucuaaaaggcaguugugccacuccucaccccccaaaaguuuaagcaucacugcuucaauuaaaaauuuuaaugcaaaucuucuggaagauccaguucgauuacuuuaaauguuuaauccauguucaagaggcaugauuuuaagugguauuuuuguuugugaaugagaacacaagaguauuauagaggcucuuuguaaagcauucggcuuuguaauccagguggaaaaaauaggacaugauaagaugagagcugucuccucacuguugagucugggaugggaagagcugcagacaccugugcagggagcauugacaaagagcacaagugaauuaugccuugagcagguuuugcuaaugguuuucuuaaucauucccauaccucacacagugaaagccuuugaauccacugauucugucacauauaaagcauugagugggcucacucuggagcaauuccaaaauuacauuucucaucuuccagagugcucaauacaaucuaaauaguuacaaaauaaaauccgggaagucuaagacaucacucacuuacuucaaccauucugaguaaaaugaacuuuuaguucauugaaaaucauauguaaagauuuuuauuuucaagaugugaaucuuuggaggaguagcccccucaguggagauacuucccauuggaacacaaaguaaugggauaaauacacugugcacaggaauuauuuuauccagaauauauccagauauugagggaagaggaggggagggaagagaaggaaaggagcccuuccagcucugaaaaggacgggagauaaugccuguaggacaaugcguuauccaggcuccacugaugauucagaacccauaugguuugacugagcugaauucccaggugggaaaaacgccuuuggccccacacacuuuccugccaucaugcgggaagcaggucuuguggcucgugggcuccuagcccagcuguugaauauuugcugauauuuucguuugcaauuaacucucuucuauuguuugucauguccuggagucuccauuuauaaaaaaacgaaauucccuggcagcaaauuuuggagaacuuuuucauuuagauuauuaaaagaugucaaacaccaucucaccagaugaccacccgcccucuucaacaagagggaaugaggcagccauccgcgcucauuccccgacaccacccucccggaggaaggagagaggagagugcugguaacguuuccugggcuucugucuugugggugggauuucacgcccuccucccaaccauccgauggcugauuucccuccauuuuauagcugagaaauugaaaccccagcaaggcaaagugauuguucaaagcuacauagauaaaaacaacauagaaccagaacccuaacccaaguuagcauuuccaaagcucaugggaagaaccccgggaaacccuagaggcugugccagauuuggcccagaucucaaggaaacuccccaugccuuuuggggaaaaaauagacuuccuugguggugacacaccacagauucuaugucaauggaagucggcugucuacuaucauucuuucaaauaugaaaaaaagacucagaauuggcugcuugagauccuugggcuggaaggggucuguuccuucauccuagauucuguguccuaaaggaaacagauucaauaagagacauucaucacauuuucauucucaucuuucuguuuaggauuauucaucuuuuuguuuacucugccucauucuaaaaaggauuugaggugccuuuuuccguuuaguuucuaucccuuugaaauuuaaaaggauaccuuucaucagaaagauugcccuacauggcccuucaaccugaaaucauauucaaucauauuccaaugaauaugauuucccaagcuauuuugcaauucuguaaauuaguuuucauuuagccuacucaaaaccuuuuucauuuuccaugucuggaaaucuuuuuuaagaaagagacacacacgcaugcacacaaggaaauaguuugaaaacaaagacucaaauaaauccagagcuuccauuuugaagucauuuauuugguuuucuccaagcacugcuuuuuaaaaucagccugucccuccuaucaaguucugggacuucuguuaguuccuaauuguccuguuuaaaaugggagcaguggaaauagucaaagaccacagugggagagccgugcacacugacugugaaauagaaagucaaauuucaguaaauuugaggcacucauccacccuugccuuugccacgcccauuccuagacugcaagaaggagcgccccauuucuuucucuuuuucucacucuuucucucucuuuuugcacgaauccugggaaaggaguccccguucuuuuccucagggaggaagcuaagaaaggauuuauuaaguccugcaauuaggguaggaggagaguggaauuuaauaugcucuugguguuugaaagacccaaaggagaauccucaaaagaaaauguuuuggaagagcuccaagaaaccuccaaagaaauauagcaaauuuuguuuuuuuacuguuuauuuaacaacuuggauuucacauuucuuucuuuuuucccuuuuuuuuuuuuuuuuuuuugagacagaguauagcucuguuguccagguuggaaugcaguggcaugaucagagcuuacugcagcuucaacuuccugagaucaagcaauccucccaccucagccucccaaguagcuaggacuacaggugugcgccaccacgccuggcuaauuuuuuuugaauuuugguagagacaauaucucacuauauugcccaggcuggucucaaacucuugggcucaagggauccuccugcccuggccucccaaugugcugggauuauaggcaugagccacuacaccuggccuuugaauuucuauucuaugaaaauacucuagaacaauaaucuguuugacucaaacugaauguguauccugugauagcaacauuuuaaaacucuucucaucaggcaggguaacuagaccuccuuugucaccuacugggguccuuugucacuuacggggguccuuguuagauauggaguagcggauucgagaucuucaacucuuccugguaaaaucuaacaaagcaacaccuguucugcaacuuguggauuauaacaaagcaaugcagaaagagaaggccuggacauccccuaccaaugcccucccucugugaaugagagcaccuguaagaauaugccgaccugcagccaggcuuaggccaagcuccucagaggugggucuccuucccauuacaaaggcaauuaagaaacuccagauuaauuacccagauauuugaaaaaauuacuuuaaaacauauuccuagcauugcagauaauaaccaugaggcagaaaguuccauaucuggugugauuugaaaagcuagacgccaccaugcaaauguaaaacacauuccacauucugaaauauacggcagccagacaagauuuugucugcacuuauacugcuaauuauaaacaucaggcagagacuaguuccauuucaacauuaaagaagaaaggugcauuagaaaaugcuucaagaaauauugcacaaaugcccacuccauuccaacuccuugccacgugacgcugcuggauccaaauuggagcuuggcacuuauuccugucuuuuccuucuuggcaaugaacuaaggugcuacugaccuuuccaaaacugugguguuccacuguaaaugauuaaaguggcugaaaggugcucucuuuguaaagagaaaaguuagauauuuugucuguuuucuagucuaauuuauaaucaaguagagaagauaaaaucauucuugaaaacagaaaccuuuucaaaaaucaaguuggaacaucugauaaaauaucauccaugcuggauuuauugcaguaaccugggaaauucuacuuccuuacugccucugucagcaauggucggccaaucucucccagccucccuuuuguguaaaagaaggcuccuugccuguugcucgaacaggccauaguccugcgacugcucucuuccaucuguugcccugggcucugaugaaugauggguuuucugcagccccaguuagaaacagagcacccuggugcaccgccgggccggcuguggguuuagcugaguuggcgcuaacucuggguaccggcccugggcugcugaaucaacuaaugaagauuccagaagugaaaaaccaguuuccuggaaugguuucccuugagaucugagucaacuccagcugcuguucaauuuuuaauuuugaaauuaaaccgagccaugagcucuuccuuccagugaccaauuccugaugcucuggguuccugaaaaccuaauguauagcacacacaggggguuuuacagaaacauuucccauuguacuuuucccuggccacuugcaauucucaaauguuucucuguaauucaugaguuuaaacuucaggagaacaguaggaucauacuaugcugaaugcagccagaccccuacaagacuaacaauuugccuuugggagaagguuuggcagaacuuuucguauuuguuuuuuucuucucuccuuuuucuuuccagauuuuuuuaagcaacaguuacuccucugcugaaucaacuuaaaagaggcuacuccaaggaagacugggaaugggaagaguaccuuucuccacauggcacccuaaaauacacucuuaaaggcuugucccccuugaaauguccagauuccaagaugucugcauauuggaaacaucagacaauucugcuacuagcucuguggcccugucacugggcauaccucucugagcucucuuucuucaucugaagcauaaagggcguggagaaaccauccaccaagguaguaguuuuuuugauauuucaauuagccaaacagaaauuauauguuugccaaccagaagagagggggcuaugucuuagucauuuuuuuaauauuccccaagaauguauucucuuuuuuuauuauuuuauuauuauuauacuuuaaguuuuaggguacaugugcacaacaugcagguuuguuacauauguauacaugugccauguuggugugcuggacccaucaacucgucauuuagcauuagggauauauccccucccugaaccucagggcucaaggccaugaugcacaauaggucuuguuaaacuuaaguaaacaugagaacacaaagaccaaccaaaggguuagguuuuuguuuuuuuuguuuguuuguuuguuuguuuguuuugcucugagcuagaauugucucccucagagucuuaaugcugguuaucucaagcgaacagacauaaaucugagagucaguaauauauauuuguauuaauaaauauucaagacgagacauucauaaucauagcuugugugaauuuuuaaaaguauguuaaaacccauuguccauuauuaggggaaaguaucaaaggacaugucacgagcacccuuacaguucuaaaauccgguaauucuacagggauacgcaauggcaugaauaugcaaaccuacuuugguucucaagcacccgacuguucauuuaaaccucuguaauuagauauggguaaaaugcuuccuauaaaaugucuuauuugcugaauacccuuguaaugcaauuguuugggaacaaagaugccuccuuugauggcacaauuucaucucaauacacuuacaccugagcagagaagaaaaacaaagcucuaacguauguacacuuccguuauuaugaacagccacaauaaauauaauaaugacaaucauguauugaaauaucaguccuaaaacugcccgcaagcucugcugagauggucaucacugaguuacuacaaacccugaaacuccacccugggagacuccaggcaccacuucagagauuuuucugaagcucgcagagauacaccucccucuagaggaaagaaaaccaaacugccuuuucaaaaacagaccaggaugaacgugcuaacucaaaauuucuuuucuuuuuuuuuuuuuuuuuuucugaaacagggucugguucugucgcccaggcgcugaagugcaguggcauagucacggcucacugcagccucaaccucccaggcucaagugauccucccaacucagccucguagcugagauuacaggcacaugccaccaugccugguuaauuuuuuaaaacgcuuuuguagagacaaggucucccuauguugcccaggcuugucucaaacuccugggcucaagcgauccgcccaccucagccucccaaagugcugggauuacagagaugagccacagugcccagcccucaaaauuucaucucuuucccaaaauggacuauaagaccagaauguauuaaaaauuauauuuuucaaaauuaacaaagugaauuguugaagggaauaucucugcaaaaucaggaccuguggaauacucccuggaaauaagacauucaugaccacacauuagagggggcaagcaacauguuuuauuuaaagaauaggauuguccuuucuuugcacugaauuuuuacacugaauuccacugaaguuuuacaguggaaacagagaagcuguaucuagaaacgggagaaugaagauaaccauucuugucuaguucauggcugucugaauuaguaggaaacuuuaaagcucccccacuuuaaaauuuggaggguuugcggcuuucauuuucuuagcuagagcuaauaggauuuucuuuaaaugucaggucccuccucaaaucgucagcuauuuauguagcagugauguguuuuuuacugccugcuugcugcagccaggacaccaugaaaaguuugcucccguaagucaggguggaaaagcugccugguacacaacaucccugucagauggaaaccgccugcaauccuucccccaagagauagcagauuuucagcuucuuccaaaaagagcagugacaaaacugaacuuucaaauaaaaauuuuugcuaaagcuguuacugcgccugcaaggaagugucacgcaauaguauucacgacuugccggugaauuuuaaguccuaaacauggaauuucacauauaagugggaggugauaucaaccgcuggugaagacuacgcuugauccaguugucugaacacucugagcaaggaaacaaaugaaaccucgcuggcaaaaagucacugccagcuuccaaagcuuccaaagaaggcggucuuguuucaagcuggcuuuaggcauccaggucuauggguuccguuccugaaacuaaggucaggaugagcagccucauuggaaccauaaaucaacaaucgacugaagagaggagcuucuuccuacuuucucaucggggacguauuaaguucuaggauaggaaaucacaaaaggcacugaugauaaagucagugcaauuugcugaguccugaaugcuuuagaaauaaaaugaagugugaaguaaagacaauuuuucagaaaggugccuaccucguaucaaaaauaucauucagaccccagguuuggacauuugccacauguccccucaccugugggccacaacuauagugggguggaacacgcucccugccaagcagggaaagagcggggccaagggcuaacauucuagaggcuuccccagccaccucccagaaaggugcuguagccacacccuccaaugccuggauaggaaaagccaggacagccucacuucaccccaacauggaauuccuucccaagcccucugcuccacucagugucugcuuccuggcuucucucgaccaugagugaggaaaggagagaacuaaaccucuggguagcaagaaacccccuaaacaaagaaguccagacaggcagcuguuccuacauccugaucuuuguaaaagccacgccuccccacccaggcuuucauccucagcuacaagcccacuucagaaagaagagcauacagguccccuccuucagcgcccuccacccccaggagguggccugagcagggcggccagccccgguauuccggucacggaaccgaugcccccgccccacgguccaccucccuucuuucucgguucauugguagagucuuagugagcccaaagcaguuuucccaacgagaugugaguuauuugggauccuccgucacuggcuugucugcucuccuucaauggggaaggauuucacugccaucucaggcacucgcucccuggccugggcaaggaauuccgcaucucagagccccugguugcucauuuugaaaaccaggaaacuacugcaucaguggcuucugaccaaaaaucucuuccauuaucuuuagcccaacaaaaaccucagaagucccaguaaugucaucaacggccacccacucaguuuucaauauaguuuugcuuaggagcaauguaacuuugauuuuaaagccauuucgguuguuuuuuacagcauuaagaaugggacccuggggagcugggggaucccagguugagcauccaccauccccgugagcucugagcacccugcagcucuagcacccugugguccucgccggggugagcuguauguggggagagaagccagucagccggggccacagcccugccuccccauccagcacagcagacuccccugugcucagagggguuugcuccuggggucugcaccggccucgaaacuggcuccuggggcuuccuguggaagcagauuuuucuuuaaccacucccuagucccucccagugaccccacccauacuucaauacccguucauuauccaacauaguaggccccuugaaacagguuccccaaacaggcuggccacugucagcgaacguguccauccucagcaagagagggcccgagccccacccugcauccuccgggccagagaacagcccucggggccucccagcucggcacuggccucaccucugugcagcaugggcuggcccugcagccccaggggcccugccuuagacacucagcaugcugcccaaaugcccaauuccuucuucuccucugaccccugcaacuccuuuaagcaaccccaagggacaaagucuccaauagagacuucagguuccuggaaagacgaaagcuugacggcaaugacugagcgacccuuuacuuggcccugauccugagcaccagaguuacuccaaucuugugaaagcagcaaaugugcuccaccaggaccuucccaugggcggcccugggcagaaaacccaugcagguuguugcacccugaccuagugucaccacccagagagcucagagaacaucucccagcggagccgcccggcagggagcuaugcuaguccucagcaaagacgcuucugcaaacaaagcggaucccgaauggguuuuagaaggcggcaguaacuuaaauaaaucaugggccgaaacacacugccgcccggaaugcacagggcgcguguagcagccacagacacgcgguggaaaagugcucacacucuuaggcaaucaugaccuuaaccaauuuaaggaaaucccauugccauaaagugagaaagaaaaaucagcggaaucuuccagagaccuaaaacauguacagaaaacuggcgaucagcaugaacguaagagccacuaacgcuaccuagaaaggaucacuucagguuaagagcauuuccuucuagccccaaaccuggaaaaacagaagagaaaucacacuuaccccugagcaaaccugaaggcgugugucccugggcuccucgauucaauuagguuugaauaggaugcauacuuuucccacucacugcgucucuuuuucuuuuugcagccuuucuccaccaaaaaaguggagacucagagcugcggaggaaaacucuugcaguccuugcaggaggcuggagcccaggagaacugaacggccuuugguggaagacugagcuccaaacug

SEQ ID NO: 12805 - RNA, 90166 nt, Homo sapiens
caguuuggagcucagucuuccaccaaaggccguucaguucuccugggcuccagccuccugcaaggacugcaagaguuuuccuccgcagcucugagucuccacuuuuuugguggagaaaggcugcaaaaagaaaaagagacgcagugagugggaaaaguaugcauccuauucaaaccuaauugaaucgaggagcccagggacacacgccuucagguuugcucagggguaagugugauuucucuucuguuuuuccagguuuggggcuagaaggaaaugcucuuaaccugaagugauccuuucuagguagcguuaguggcucuuacguucaugcugaucgccaguuuucuguacauguuuuaggucucuggaagauuccgcugauuuuucuuucucacuuuauggcaaugggauuuccuuaaauugguuaaggucaugauugccuaagagugugagcacuuuuccaccgcgugucuguggcugcuacacgcgcccugugcauuccgggcggcaguguguuucggcccaugauuuauuuaaguuacugccgccuucuaaaacccauucgggauccgcuuuguuugcagaagcgucuuugcugaggacuagcauagcucccugccgggcggcuccgcugggagauguucucugagcucucuggguggugacacuaggucagggugcaacaaccugcauggguuuucugcccagggccgcccaugggaagguccugguggagcacauuugcugcuuucacaagauuggaguaacucuggugcucaggaucagggccaaguaaagggucgcucagucauugccgucaagcuuucgucuuuccaggaaccugaagucucuauuggagacuuugucccuugggguugcuuaaaggaguugcaggggucagaggagaagaaggaauugggcauuugggcagcaugcugagugucuaaggcagggccccuggggcugcagggccagcccaugcugcacagaggugaggccagugccgagcugggaggccccgagggcuguucucuggcccggaggaugcaggguggggcucgggcccucucuugcugaggauggacacguucgcugacaguggccagccuguuuggggaaccuguuucaaggggccuacuauguuggauaaugaacggguauugaaguauggguggggucacugggagggacuagggagugguuaaagaaaaaucugcuuccacaggaagccccaggagccaguuucgaggccggugcagaccccaggagcaaaccccucugagcacaggggagucugcugugcuggauggggaggcagggcuguggccccggcugacuggcuucucuccccacauacagcucaccccggcgaggaccacagggugcuagagcugcagggugcucagagcucacggggaugguggaugcucaaccugggaucccccagcuccccagggucccauucuuaaugcuguaaaaaacaaccgaaauggcuuuaaaaucaaaguuacauugcuccuaagcaaaacuauauugaaaacugaguggguggccguugaugacauuacugggacuucugagguuuuuguugggcuaaagauaauggaagagauuuuuggucagaagccacugaugcaguaguuuccugguuuucaaaaugagcaaccaggggcucugagaugcggaauuccuugcccaggccagggagcgagugccugagauggcagugaaauccuuccccauugaaggagagcagacaagccagugacggaggaucccaaauaacucacaucucguugggaaaacugcuuugggcucacuaagacucuaccaaugaaccgagaaagaagggagguggaccguggggcgggggcaucgguuccgugaccggaauaccggggcuggccgcccugcucaggccaccuccuggggguggagggcgcugaaggaggggaccuguaugcucuucuuucugaagugggcuuguagcugaggaugaaagccuggguggggaggcguggcuuuuacaaagaucaggauguaggaacagcugccugucuggacuucuuuguuuaggggguuucuugcuacccagagguuuaguucucuccuuuccucacucauggucgagagaagccaggaagcagacacugaguggagcagagggcuugggaaggaauuccauguuggggugaagugaggcuguccuggcuuuuccuauccaggcauuggaggguguggcuacagcaccuuucugggagguggcuggggaagccucuagaauguuagcccuuggccccgcucuuucccugcuuggcagggagcguguuccaccccacuauaguuguggcccacaggugaggggacauguggcaaauguccaaaccuggggucugaaugauauuuuugauacgagguaggcaccuuucugaaaaauugucuuuacuucacacuucauuuuauuucuaaagcauucaggacucagcaaauugcacugacuuuaucaucagugccuuuugugauuuccuauccuagaacuuaauacguccccgaugagaaaguaggaagaagcuccucucuucagucgauuguugauuuaugguuccaaugaggcugcucauccugaccuuaguuucaggaacggaacccauagaccuggaugccuaaagccagcuugaaacaagaccgccuucuuuggaagcuuuggaagcuggcagugacuuuuugccagcgagguuucauuuguuuccuugcucagaguguucagacaacuggaucaagcguagucuucaccagcgguugauaucaccucccacuuauaugugaaauuccauguuuaggacuuaaaauucaccggcaagucgugaauacuauugcgugacacuuccuugcaggcgcaguaacagcuuuagcaaaaauuuuuauuugaaaguucaguuuugucacugcucuuuuuggaagaagcugaaaaucugcuaucucuugggggaaggauugcaggcgguuuccaucugacagggauguuguguaccaggcagcuuuuccacccugacuuacgggagcaaacuuuucaugguguccuggcugcagcaagcaggcaguaaaaaacacaucacugcuacauaaauagcugacgauuugaggagggaccugacauuuaaagaaaauccuauuagcucuagcuaagaaaaugaaagccgcaaacccuccaaauuuuaaagugggggagcuuuaaaguuuccuacuaauucagacagccaugaacuagacaagaaugguuaucuucauucucccguuucuagauacagcuucucuguuuccacuguaaaacuucaguggaauucaguguaaaaauucagugcaaagaaaggacaauccuauucuuuaaauaaaacauguugcuugcccccucuaauguguggucaugaaugucuuauuuccagggaguauuccacagguccugauuuugcagagauauucccuucaacaauucacuuuguuaauuuugaaaaauauaauuuuuaauacauucuggucuuauaguccauuuugggaaagagaugaaauuuugagggcugggcacuguggcucaucucuguaaucccagcacuuugggaggcugaggugggcggaucgcuugagcccaggaguuugagacaagccugggcaacauagggagaccuugucucuacaaaagcguuuuaaaaaauuaaccaggcaugguggcaugugccuguaaucucagcuacgaggcugaguugggaggaucacuugagccugggagguugaggcugcagugagccgugacuaugccacugcacuucagcgccugggcgacagaaccagacccuguuucagaaaaaaaaaaaaaaaaaaagaaaagaaauuuugaguuagcacguucauccuggucuguuuuugaaaaggcaguuugguuuucuuuccucuagagggagguguaucucugcgagcuucagaaaaaucucugaaguggugccuggagucucccaggguggaguuucaggguuuguaguaacucagugaugaccaucucagcagagcuugcgggcaguuuuaggacugauauuucaauacaugauugucauuauuauauuuauuguggcuguucauaauaacggaaguguacauacguuagagcuuuguuuuucuucucugcucagguguaaguguauugagaugaaauugugccaucaaaggaggcaucuuuguucccaaacaauugcauuacaaggguauucagcaaauaagacauuuuauaggaagcauuuuacccauaucuaauuacagagguuuaaaugaacagucgggugcuugagaaccaaaguagguuugcauauucaugccauugcguaucccuguagaauuaccggauuuuagaacuguaagggugcucgugacauguccuuugauacuuuccccuaauaauggacaauggguuuuaacauacuuuuaaaaauucacacaagcuaugauuaugaaugucucgucuugaauauuuauuaauacaaauauauauuacugacucucagauuuaugucuguucgcuugagauaaccagcauuaagacucugagggagacaauucuagcucagagcaaaacaaacaaacaaacaaacaaacaaaaaaaacaaaaaccuaacccuuugguuggucuuuguguucucauguuuacuuaaguuuaacaagaccuauugugcaucauggccuugagcccugagguucagggaggggauauaucccuaaugcuaaaugacgaguugauggguccagcacaccaacauggcacauguauacauauguaacaaaccugcauguugugcacauguacccuaaaacuuaaaguauaauaauaauaaaauaauaaaaaaagagaauacauucuuggggaauauuaaaaaaaugacuaagacauagcccccucucuucugguuggcaaacauauaauuucuguuuggcuaauugaaauaucaaaaaaacuacuaccuugguggaugguuucuccacgcccuuuaugcuucagaugaagaaagagagcucagagagguaugcccagugacagggccacagagcuaguagcagaauugucugauguuuccaauaugcagacaucuuggaaucuggacauuucaagggggacaagccuuuaagaguguauuuuagggugccauguggagaaagguacucuucccauucccagucuuccuuggaguagccucuuuuaaguugauucagcagaggaguaacuguugcuuaaaaaaaucuggaaagaaaaaggagagaagaaaaaaacaaauacgaaaaguucugccaaaccuucucccaaaggcaaauuguuagucuuguaggggucuggcugcauucagcauaguaugauccuacuguucuccugaaguuuaaacucaugaauuacagagaaacauuugagaauugcaaguggccagggaaaaguacaaugggaaauguuucuguaaaacccccugugugugcuauacauuagguuuucaggaacccagagcaucaggaauuggucacuggaaggaagagcucauggcucgguuuaauuucaaaauuaaaaauugaacagcagcuggaguugacucagaucucaagggaaaccauuccaggaaacugguuuuucacuucuggaaucuucauuaguugauucagcagcccagggccgguacccagaguuagcgccaacucagcuaaacccacagccggcccggcggugcaccagggugcucuguuucuaacuggggcugcagaaaacccaucauucaucagagcccagggcaacagauggaagagagcagucgcaggacuauggccuguucgagcaacaggcaaggagccuucuuuuacacaaaagggaggcugggagagauuggccgaccauugcugacagaggcaguaaggaaguagaauuucccagguuacugcaauaaauccagcauggaugauauuuuaucagauguuccaacuugauuuuugaaaagguuucuguuuucaagaaugauuuuaucuucucuacuugauuauaaauuagacuagaaaacagacaaaauaucuaacuuuucucuuuacaaagagagcaccuuucagccacuuuaaucauuuacaguggaacaccacaguuuuggaaaggucaguagcaccuuaguucauugccaagaaggaaaagacaggaauaagugccaagcuccaauuuggauccagcagcgucacguggcaaggaguuggaauggagugggcauuugugcaauauuucuugaagcauuuucuaaugcaccuuucuucuuuaauguugaaauggaacuagucucugccugauguuuauaauuagcaguauaagugcagacaaaaucuugucuggcugccguauauuucagaauguggaauguguuuuacauuugcaugguggcgucuagcuuuucaaaucacaccagauauggaacuuucugccucaugguuauuaucugcaaugcuaggaauauguuuuaaaguaauuuuuucaaauaucuggguaauuaaucuggaguuucuuaauugccuuuguaaugggaaggagacccaccucugaggagcuuggccuaagccuggcugcaggucggcauauucuuacaggugcucucauucacagagggagggcauugguaggggauguccaggccuucucuuucugcauugcuuuguuauaauccacaaguugcagaacagguguugcuuuguuagauuuuaccaggaagaguugaagaucucgaauccgcuacuccauaucuaacaaggacccccguaagugacaaaggaccccaguaggugacaaaggaggucuaguuacccugccugaugagaagaguuuuaaaauguugcuaucacaggauacacauucaguuugagucaaacagauuauuguucuagaguauuuucauagaauagaaauucaaaggccagguguaguggcucaugccuauaaucccagcacauugggaggccagggcaggaggaucccuugagcccaagaguuugagaccagccugggcaauauagugagauauugucucuaccaaaauucaaaaaaaauuagccaggcgugguggcgcacaccuguaguccuagcuacuugggaggcugaggugggaggauugcuugaucucaggaaguugaagcugcaguaagcucugaucaugccacugcauuccaaccuggacaacagagcuauacucugucucaaaaaaaaaaaaaaaaaaaagggaaaaaagaaagaaaugugaaauccaaguuguuaaauaaacaguaaaaaaacaaaauuugcuauauuucuuuggagguuucuuggagcucuuccaaaacauuuucuuuugaggauucuccuuugggucuuucaaacaccaagagcauauuaaauuccacucuccuccuacccuaauugcaggacuuaauaaauccuuucuuagcuuccucccugaggaaaagaacggggacuccuuucccaggauucgugcaaaaagagagagaaagagugagaaaaagagaaagaaauggggcgcuccuucuugcagucuaggaaugggcguggcaaaggcaaggguggaugagugccucaaauuuacugaaauuugacuuucuauuucacagucagugugcacggcucucccacuguggucuuugacuauuuccacugcucccauuuuaaacaggacaauuaggaacuaacagaagucccagaacuugauaggagggacaggcugauuuuaaaaagcagugcuuggagaaaaccaaauaaaugacuucaaaauggaagcucuggauuuauuugagucuuuguuuucaaacuauuuccuugugugcaugcgugugugucucuuucuuaaaaaagauuuccagacauggaaaaugaaaaagguuuugaguaggcuaaaugaaaacuaauuuacagaauugcaaaauagcuugggaaaucauauucauuggaauaugauugaauaugauuucagguugaagggccauguagggcaaucuuucugaugaaagguauccuuuuaaauuucaaagggauagaaacuaaacggaaaaaggcaccucaaauccuuuuuagaaugaggcagaguaaacaaaaagaugaauaauccuaaacagaaagaugagaaugaaaaugugaugaaugucucuuauugaaucuguuuccuuuaggacacagaaucuaggaugaaggaacagaccccuuccagcccaaggaucucaagcagccaauucugagucuuuuuuucauauuugaaagaaugauaguagacagccgacuuccauugacauagaaucuguggugugucaccaccaaggaagucuauuuuuuccccaaaaggcauggggaguuuccuugagaucugggccaaaucuggcacagccucuaggguuucccgggguucuucccaugagcuuuggaaaugcuaacuuggguuaggguucugguucuauguuguuuuuaucuauguagcuuugaacaaucacuuugccuugcugggguuucaauuucucagcuauaaaauggagggaaaucagccaucggaugguugggaggagggcgugaaaucccacccacaagacagaagcccaggaaacguuaccagcacucuccucucuccuuccuccgggaggguggugucggggaaugagcgcggauggcugccucauucccucuuguugaagagggcggguggucaucuggugagaugguguuugacaucuuuuaauaaucuaaaugaaaaaguucuccaaaauuugcugccagggaauuucguuuuuuuauaaauggagacuccaggacaugacaaacaauagaagagaguuaauugcaaacgaaaauaucagcaaauauucaacagcugggcuaggagcccacgagccacaagaccugcuucccgcaugauggcaggaaaguguguggggccaaaggcguuuuucccaccugggaauucagcucagucaaaccauauggguucugaaucaucaguggagccuggauaacgcauuguccuacaggcauuaucucccguccuuuucagagcuggaagggcuccuuuccuucucuucccuccccuccucuucccucaauaucuggauauauucuggauaaaauaauuccugugcacaguguauuuaucccauuacuuuguguuccaaugggaaguaucuccacugagggggcuacuccuccaaagauucacaucuugaaaauaaaaaucuuuacauaugauuuucaaugaacuaaaaguucauuuuacucagaaugguugaaguaagugagugaugucuuagacuucccggauuuuauuuuguaacuauuuagauuguauugagcacucuggaagaugagaaauguaauuuuggaauugcuccagagugagcccacucaaugcuuuauaugugacagaaucaguggauucaaaggcuuucacugugugagguaugggaaugauuaagaaaaccauuagcaaaaccugcucaaggcauaauucacuugugcucuuugucaaugcucccugcacaggugucugcagcucuucccaucccagacucaacagugaggagacagcucucaucuuaucauguccuauuuuuuccaccuggauuacaaagccgaaugcuuuacaaagagccucuauaauacucuuguguucucauucacaaacaaaaauaccacuuaaaaucaugccucuugaacauggauuaaacauuuaaaguaaucgaacuggaucuuccagaagauuugcauuaaaauuuuuaauugaagcagugaugcuuaaacuuuuggggggugaggaguggcacaacugccuuuuagaaucacauacaaacauggacccuuaucuccagaaaaacccucauccauagaugcaauuuugcacucaacugugggaggaucauagacucuuugaaucuguugaucccguauuaaaacauugaucuggaccaguuacaauaauacagguuguuuuggaaagaacaggccauuuucuuagaaagaaucuagcaggaagcuuaccuuugcuaaaaaaaaauugacgcucaagcuugauagaacgaaucaagaauagcacauauaaaauguacuuuuauauuauucugaaguguauaucauuauuuaauugaggucauacaaaaaauuagauauugcaauugcuuuuuuuuuuuauuugaagaaacacucaggaaugggucuaacagacuguagggaagaaagguagagcuugguggaaaagucuggaagguucccaggguugcaugggcuugagggauuccuagagagugaaggggcaaaguuggggcuguggcacgguggggguagggucaaccuaaguggagggaggagaacaggcaguccagccugucgggggucccugagcccugcugugcugcgaccgggcuaaagcuugggagcauuaucaaaccacagcacaagcacuggagacugcucuucuacauuguguuaacauauauccauguccaaaaggcagugaccauugcaagggaaaaaaaaucgggcugagcuuuugcaauacugccgcuaucaccacucauugcugucacuuuguugcagaaaaauaucuguucuguugauaacuggccuccugagcaucauuagaacagcauuccuuucucacuguugaugcauuuccaagagacugcuguauugacaggugguucuauuuuagcugcugagaucauggcuucaaguucucagaaucugaaucacaggguacauuuguuucaucacaggugguacuuuuuguugacuuucuuuggaaauccaaagccacauggguccugguguucauucccuuguuuguggcuucaucugucuccaucucaccaauuuuuggcgggucaggccuagggcccacacuguguuccgucuuccucauagcugggccgcaagauuuggacuccagcuucucccucugggccugaccucaggcaggaggaauuucacggcaaauccacgggacugagcuucagguuuccuuugcacccacuuagcuccuguccuugacuggcagccucaaucacucucuguggcucucccuguaccuuugcuaagugguccaucuggacacuagucugcugcuccauucauggcaaaguuacaucacucaucagccggacagacucuccucugcuaucaaucuucagguggcaaggcugagaacauuagaucauccucaucccugauuucauuagcuguauggggaaaauggaauuccugugcuacacaacagacaaccaugaagacuugcagagcccaugggggcaccuguggagagaggaagauuaagauagagauacaaaagcucaggccuuggguggagccgauuccaaagcucagaggauacuagucaaggcagaagccauguuugcaccaggucugaauguucauauuagauucuuucccacuuucaugagacucugaucuucuuugccaaacccuaacauuuugcaugacauauacucuuuucuuauuucuuuccaaaucuuauuuagaaguaagggcaaacauuguguuauuugaauacagcggcauguagacacacuuuaggauguuuaguuguacuguuuuuuccuaguagcucuuaaacucuaucacaccucaaaaaagagaugcugcacuuacaucauuccuguuaaauugauggcuacauuuuagggguaguuacccaugcuuuuaaaaccuggcaaaugauauuuccuguccucauuucuauuuuaauugugguaaaaaccauauaacauaaaacauacuaucuugacuauauuuaaguguacaguacagcaguguuaacuauacgcaccuugugcuacaacaaauaucuauaacuuuuugaucuugcaaaacagaagcucuauaccuaugggacaguaacuacaacugccucccuccugacagcccauggccaacaccauucuagguucuuuuucuaagacuuugacuacuuuaaauaccuucacauaaauggaauuauaaaguaaugcauuugucuuuuagugacuggcuuauuucacuuagcauaauauccucaagauucauccauguuguaguagauaaaaggauuucauucuuuuauaaagcugaauaauauuccuuguauguggcauguauaagacuuaguauaauacaguaggccgugcacaguggcucacgccuguaaucccagcacuuaggaaggcuaagguggaaggaucucuugagcccaggaguucaagaccagccugggcaacauggcaaaacccugucucuacuaaaaauacaaagcuuagcugggugggguggugugugccugcagucccauuuacucaggaggcugagaaggaaggauugcuugggccugggagguugaggcugcagugagcugugaucgugacacugcacuccagucugggugacagagggagacccugucucaaaaaaaaaaaauuacaguauaagugguguaauaacagugcaaaguccuaggagaacuguaggaauagcaguuaaugaauuuaacaaauauuuauuauacaccuacaaugauacagacaggcauuuugccauacucugugcucagaguguggcugagcuucacaguccuggaagacucuuuguuuaugauaaagcagccuuggaaaucuauaaucaauuucauaauugcaaaaaauuccauuguguguguauauauacauauauauacuuaaccaaggaagaaaaaaaccugugcacuaaaaacuauaaaacacuguugaaaugaauuaauuucuuuauucaucucaucuauugauggacuuuuaaguuguuuccaucuuuuggauauuacaaauaaugcugaaaugaacaugggugugcacauauaucuuugagauccuguuuucacuucuuuuggauauacccaaaagugggauagaugaauuauaugauaauucuguuuucaguuuuuugaggaacauucauacgauggaggcuagccuuuccccacuguguagcuuuguugaagcucaaagaucauauacaugagguuuuauuucugggcucucuauucuguuccauugguucauaugucugucuuuaagucagcaucauauugauuucauuacaccauuuuguaauauguuuugaaauuauaagugugaggucucaagcuuugcuauuuuccaccccuucauucuguuaaugugguguaucacauugauugguuuucauacguugaaacauccuugcauucuagaaauaaguuccacuugguuagaguguauaauccuuuuaaugugcuguugauuuggucagcuaguauuguguugagaauuuuugcaucaguguucaucagggauauuggucuguauuuuucuuuucaauauuggccuuauaaaaaugaguuuggggguguuccuuugucuuuaauuuuuuugagaaaaguuugagaaggauuaguguuaauucuuccuuaaguguuuggaagaauuuuccaggagagacaucugguccuggguuuuuuguuuuuuuuuuauggaagguuuuugauuaccgauucaaccccauacuaauuuuaagucuguucagaauuuuuuuuauugcuucaugauucagucuugguggauuguauauuucaagcaaauaucuauuuuuuuucuagguuauccaguuucuuggugugcuauuuuccucacuucuuacagaucucauguagucuugucagucuuuccaaagucuuguauaaacaauuucacgugccugauuugcucucauuuccccuugcuuucuucagggaauugccaaauuauuccugaugcaggggauauaaaaccaaucuguaagcauuuggaguuuuagaauuauaagaugaaaaaagucacauuucaaaaucugacauauacuugauacccagaaagauguuuuugauuuucauucacacugaugcugaaugccuuuacaugcuguaaucugugaaacagacuucuuuuuaaccuucaaacccuaacagugaaaugaugaugaaaacucaaucucccuagauuauauguauuucaguuucuuaagucaaauggaauuucuaauuuaacuguagucuacacuauaucauuuccaauaucaaauaauucuuccugaaacucaauauaagaaaaaaugacaauauuaacuagugucaugaaaguucaugcugauaaugagauugagucugguccuuccccugggcuucuccggggaaaugucagucgucuacccauucuaauucucucacuuggucacagggaggcagugagcuccaccaucaagggacaugggucccacuuacaguuaauggaguccgagagagcagauauuugcaaacccagugaucugggcucaguggaggccugggcagguggagaugccuuugguugcugcuucagaggaguaagagcuuagcaaaauuagacauggagaggaauagcccaugaaauguguuuggggaauucuggguuaaaucaaguacagcagguuucuuuacuuuauuuuucagaacugcuauauauuaagguauauuguaacuguuccagaaggaggcuugguauucagcacuuuccaaacugcguugcucauggaaugccuguuuuuccccuuagaacaucgaauggaauggguguuccaugaaaugugcuuugggaaaugcugaugaaugaaacguugcuggagaaugguaguuagaguucacuuaccauccauuccgcgucaggcauuuaccaaacaggcuaccacaugcuccucacagagggcuggaagagaggcauggcuaucauuguucuguguuauagaggaggaaauggaggcuuugagcaaguauaccaccugccugagguaggguaugguggauccaggauccagauuuaucugauuccaagcaccuugucuuuccccaacaucucuggcuccuuuucugauuccuaaaaagcccaaauucaggcuggugaacuugauugaaaaguugcuauggaaucgugggguuuucauggagaaauaaaaauguucuucuuauccucucaucuuaugaacccucaguguggcaggugcuauugagcaccaaggugucugaauaguugugcaccuuggccacuuauucucugcacccccauuuuuuccuguaagcaugaggaucagcaucuaccucuaaggauaauguaaagauaaauaacacacauuaugaaaaauuaugaaaaacugcaaugaucacauaguagaugcugaauaacuuuugauaacauggcacccaaaacagcgguuuaauaacauccuagccuaccugugucgccaauggccuuguuccccaguacuguuacccaaaccucugaaaagggaaccccugaccagagagcuccuaacuggggaaccccuggccagucuggguaagaagagucacugacaugcacaucauugcaaaaugaaaaugagcuucucguucaaauguuuuaagaauuccaagauagcaacaucaaagcaucaaacugagcauggggcccuucagagcacaggguccugugggcagccccgucuguggucuaagaaaaaguuaaaggaaaccagaauccugcauuaaggagaggagaaaaaagaugcuguccuggcaaggggacuucagccuagacagaaagacccuagcucucuggaggggucuuaagggagaccccagcccccaagcugaucucuuagauuggagauuggagagugaagaggcugucacaagaucuugugguaggaagaaaagguguuggcaggggaaaggucugauggcgcacgcuacugagcugaagugaaugugaacuuggcugguggggcaucaugugugcggcccccagaggcgcguggguaugggagacucugcaucagggcaguuagccuccaggucuggcuucacagucuuacuaauuaaaucaccccaggcucauuccacugugagauuggagguuggcauauggcagauuuuccuuggaggaaaagugcuaaauauuaauagagaauauggacaaggcuugacauggucccagcugcugugguuggguugcauuugguguaauuugggcaaagcccguucucuccauaaacugaaacuuuccucugagguucuuuuaaacaugacuuacaaacuuaagcugggugucaaaaccugaugccuugugccuaugagugcuuuuacuccugacccauuuccauucugcucuuugcuuaggaauaugcuauuuccaaauugcugcguacaucacuuagggaggaaaagaagguuuaauugcauagcuuuuuagcuguggccaaaguaauagucacuagauucaaaaauucucauuuauauguuuaaucaaaacuaucuuucauaauggauaaauuuuucauucauuaguaauuugaaaaagaaagagaauauuuucagauuguggagaaacuacuaugaaugccuauuuucuaaaaauguaauuguguucuuugaacuauguuuaagaauguccagagaggagagugagcagugccauuacaggugaccuauguucugcuaacaagaagaggucugaggucccuuuagacagagagcucugccuauucacuucucacuuaccuauucuuuaccuuccucccaccuucccaccuugccuccucccuuccucccucccuccuucccucucucccucccucccucccucucucucuuucuuucucucuuucuuucuuuccuucucucuuucuuucuuuccuucucuccucuuuguuuuucuucugcuucuuucucuucuucuccuuccuuccuuccauccuuccuuccuucccuccuucccucccucucgccuuccuuucuuucccuuccuuuccuuccuucacuucuuccuuccuucccuucuuucacuucuuccuuccuucccuucccuuccuucacuucuuccuuccuucccuucuuucacuucuuccuuccuucccuucccuuaccuuccuucucuucucccuucccuucccuucucuucccuucccuucuccuuccuuccuucccucccucccuccuuccuuccuuuuauauaugcauauaugugcgcauguauguaucuguauagauuuuuaucuaucuaucuaucuaucuaucuaucuaucuaucuaucaucuaucuaacugucuaucauccauccuuuugcugcugguucaaagaaugaaucagauacaaagucuucuuggaagucuaaaaaggacguagaaagcaugggauuuugagagauuuugcauaaugagagucaaaaacugaucauucccuuugcccuguuuucucuuuuagguucauauuuggugcuuagacaaauucaaaaugaggaaacaucggcacuugcccuuaguggccgucuuuugccucuuucucucaggcuuuccuacaacucaugcccagcagcagcaagcagguaagagccagaaacguccuugauuuuguaaaaaggaauaucauucuuugauuuuagaucuuagacaucaggcacugacauagagcuuagauauguucuuaagguagcuaagccauuuauuauaggauagucagauaggauaguucuaggauuuauaggccuuuucagauacucuuuauccagugagagaugaccuauuuuuauuaaaacuuggguuugguaucuuggaauuggcuugaaaaugauuuguuuuuacauuggaugugaacggaaaguuuguaucucaaauguuuuaccaccugaagggacuuuccacauuucuggcauuggcuggucucugagcacauaaaguagggagaagucaaugauugagaguaaaaacuauuuucccugaaaaauacaaagaucacccucucucucuaacuccagaugcaggaaggcauuuuucaucuaggauccuugaaucuuuaagauuucuguuucccaaaacgaauuaaaagcauggguucuaauuaacucuauuaagaauuugauuucagaguuuuagaaaagugggaaaugcuucaugcauugcaagcuggaaaggacucaggugggucucccucuccuugacccagagagcuuggccucugagggauucuuccuccaggccagguugcucuuagauggagggaagucuagugucacuucaauggaagaagaacguggguuggggcaucaggucagccugagguaaguagaguccagcagcaagccuggcucacagcugcagaagggcaccuccuggggccacugacagccugauacccugagcucccacccuugagggagaacuggguucaucuggaaaugagauagauaauguuugacaucuauggagacuuuucuggcucugaaaaauaugcaguaacuaauagaguacaguuuguucaugcucaaaaaaucuggaaaaaauaagucuuuucccuucucuacauuuacacaaguccuccucgcuuaaagaacauguauuuauuauauuuauuuuucacgcaaauuacccaaagcauuggggguuagugaauggaaaauagcaauuuuuacuuuuccuuuuuugucaaggcccgguuuuguauuccaaacuaaagaaugaauuuauaaaaugaugguugguugucugugauaagacuuccuucugguuuaaucaggugggucuuggggcucaaacugccacagggaaucauacuugaguuaaagacagcccaggaaauuguuuccccaaucuggagcaugcuacuggcccauucaugauggucucugaguauggaacuugggcuagugacugggcaccagcagcuauugagugcaugggcucaggucccugguucccagguaagugagucuaccuuccuguauuaucagugaggugugaaguguuuaguagcaguauaguguaaaccaaauuuguuuaggaaggcuuugcauugauaggaaguaauugcuuacauaguagaaaaaucuaaaccaaugucuuuuuuuaaagaugucaaaaauggugcggcugcugauauaauauuucuaguggauuccucuuggaccauuggagaggaacauuuccaacuuguucgagaguuucuauaugauguuguaaaauccuuagcugugggagaaaaugauuuccauuuugcucugguccaguucaacggaaacccacauaccgaguuccuguuaaauacguaucguacuaaacaagaaguccuuucucauauuuccaacaugucuuauauugggggaaccaaucagacuggaaaaggauuagaauacauaaugcaaagccaccucaccaaggcugcuggaagccgggccggugacggagucccucagguuaucguaguguuaacugauggacacucgaaggauggccuugcucugcccucagcggaacuuaagucugcugauguuaacguguuugcaauuggaguugaggaugcagaugaaggagcguuaaaagaaauagcaagugaaccgcucaauaugcauauguucaaccuagagaauuuuaccucacuucaugacauaguaggaaacuuaguguccugugugcauucauccgugaguccagaaagggcuggggacacggaaacccuuaaagacaucacagguaauggcaacgccaccaagcuacgcccugcccugcuguucuugggagaugagcuuggcaacugcuggccuuaaagcaacagcuaggauggcgggugggccagggaagagaugaguguucacagguuuaaaaacaaagguuugauuuggaauauucuuccauagucuucuccccaaguagggcauucaccuacauacaagaagagucuuuuuuuaaacaacuaauauuuucagucuaaaaaaacccacauucuaauauuaugaucccacaaaauaccucugccuuccuuagaaaagaaagccucagaguggugaggugugcaucugaucaaacuccucuauuugguguugggaucuguuuccuuuaaggaaagcucccuguuggagagugcgugaacugagacgggagcgagggcaucuguuuuuguguccaguggacuagcagagagcuucucucuucuacuuuacggaguuaauuuaagaguguugguagaaucggaauuacaagaaaccucagcuaugauccagucuagauugauuuuggaaaaaauuuaguccugaaugguuagugacagccggagcuggaggcugugcauuugggcugugggucuggucuucuuauuucuucuccaugcgguaaucauggcugugcccacagagacucuucuaauucuaauggaguugaugagaaccacucuggaaguauugagagcacacggacauugcaucgaugugucaugugcaguugcauguacagagcuaauuggccgacagguuauuuaaccaguuaagccuguuagcucuccuuccagggcuaagugccuaaauggccaauggggaaggaauuugacaaguacaauuucaaacucuaccauaccacagcaacuguaaugagugcccagagcuuacucaucagcgaugggcagagcagagggaccuccccuuguuagaaaaugaguccaugcagccauuugauaguugguagcagagaauucuggguggaaugagcaggaaaugagagaggaauccagggggagaguugagcuccagaaaggagacacacauguucucugagauggagggaaggcaugagaaaaggggcuguguuuccaagauauucagguggauaagaggcacauugagagaguucaaguugaguugacauccaucaucucaauaaaggagggaagcaguggggcuugggggcuuggagggauugaaguuauuuuugaucagcugcuauagggaugugaagaggggucacaaaacauucaggaagcaacugcugauuugaaguggcauccaguugcuaucagagauuacaagucagugggugucuccauuaguguggaucccugccuuucugcagauaucucaggcacucccaggaucaaaggaguucccagaacuggaacuugcaaagagggaacaauagagaggacagaagaaaauuuucucaguaaggaaauccagagugguagcuaguaaauuccugaaacagccugccaugguguccuagcugcauggggagcuaaugagagcuggaaugggccaggagaccucugaagagccagaggaugagaggccaggucucggaaggagaguccuggagacagcugagugugcaaguuggagacgcugcugguguguagacagggagaccucugagggccaaucgcggggcuggaggaguuuccaauggugcucagugugguccucagauguguaggaacuauagagagccagccacugcagaaaccagagaggguggugcucacaaagguuguccauacagaccuuaaagucuggagaugaccacagagucugcagugugaacgcaggcugaacauaauguaacuaaaucauguaggaauguuggagacucucuucuguguauuuaguaggcaugaggaaguggauaauucuuugaaucaaaaaagaaugagugggcaaccacauggcauaggggaacugaucauaggaagcaagauuuaugaacagauuuuucuccuacacuuuuaaaaaugguuaccaccaagauggccacugggacaggagguaggaggugaggugacugauggagagucagucucuugugaauacacauggaugguggggcaggaaaaagagaguugaggcuuggaggcacacaucacucuacaggaccacaucggagggacagcagaagaauugcaagauugcaaucagaaugcuggagcaguugcagagaagcaguaccagaugucaguuuuucauaacaaggauucagaaagcaggagcugaagagagaugacccaacaucagcagaaaggaacuagcugucuugagcaggcagaacuugaugaagaagaggguuucagaacuagccagcuccaggguguuucagaaguuuguucauaaaaugguuuucccagugguuacuccugauuucagcuuuaacggggcuggcagugcugaugcccuuaccugugggucugcuucuccauaggaaagagugagaggcaguucaaacacugcaaaguguucccugcuuccaaaugacaggccucaccccuggcauuaccacacaggcaucaguccugccaaaugacaggaaaagcugggugucuccaagagcaccccaaaccaaacacucagguuaccaggaaaugacaagaggguaucuacaaugaacugcacuccucgcuacgauagucucaguaucauuaauucccugauccaucacauuucggaauaucgggauaauaacaaagaccuaccaaaaaauagugaaaggggcucacgccuauaaucccagcacuuugggaggcugagacgggaggaucaucugaggucaggaguuugagaccagccuggucaacauggugaaaccccgucucuaccaaaaauacaaaaauuagccaggugugguggugggcgucuguaaucccgggaggcugaggcaggagaaucgcuugaauccaggagguggagguugcagugagccaaauuugugacacugcacuccagucugggugacaagagugaaacucugucuaaaacaaacaaacaaacaaacaaacaaacaaacaaacaaacaaacagugaaagggaccaguagagaaauggaacaucuuuuauugacguuuuguuauacucacaaaaauagcugaguuugccuuuauguuuaaccauuauguaauggacaaacaaugagauuaccauagugaaugcuaaaugaaacuaccaacaucguguguuuccacacagaugauaaaaccuuuguuuuuaugccaagaaagcaucucugucuucuaguguccaagccacuagcagcaccagggcagaaaauuaauccauucaugugucuuuucuaauuaacaucacucugcaguuccuccuaguaccacgucccgcugcauguuccacggcaaaaacauaggauaauaaucuuaggaagaacaguacaucucugcuuauaguuuuuuggaaagccaguuagaagagcauuauagagauugcuaauuaguuagggcugccucuucuuacuaccugucugcuggguaacuuccccauagaguguucuugauuauaaaacacacauauguguaaaauaugaacgaucaccacuguugucaaugaacucuacucaaauaaucaaucucuaaugguuguguuuuuaaaaaucccucugucauucuuuaaaaaaaugaauauaccugagauauaaaaccuuuauuuuaaaacaaaagcuaaaggugacagggaggauuuuggcaucagcuuucuuuucucuguaaaggaugaagauuuuuaaaauuuguaaaauauauauacaauuuuguguuuuacauaggaaacaagaaugggaacuuguuuuucuuaaugaaaggaggcaucacaugagcuaagaaaggcauugugcccacaccagugagcucgggaaaagagcuuccagggaugucaaaggaaacugugaauuuuccuuggacacuguaaaacuuuucuguagaaaacaccacagaggaugugauacauaaagcauagaagcagaaaaccagacaauuuuaaagcuuuuaaauugugcauagaucugauuccuuguaacauuaacauuggucauugguccgccuugcuguacacaagcacacauggccccugugugcccuugaggcuucagcucucuugaauaacaaagcaugcccuuguaugucccauuauuguguguguaagaggauaauguuguuauucagugaugacaaauuauccaacguguuucuaugacuggccacuguagauguucagucuuuuacaagagaauguucaaggauuuucccucaggguccauuuaucuuauuugcaugacuauaaauuucaacccaaaaguaaguuacaaauggagaagaaauaguguuauccugcgacuuagggaucauuuuuaaaagcuugacuguauugaucauauuuaauccuucuuuuaaacgucuugauaugcugaggaaguggcaaauccuuccguguccuuugaggucauugguuuaggccugggaaauguugaggaauuuuguggaauuuguggagccucuguauuaugcaaugauguaggccauuucuauggccuucuguguaauucacacccccuggcaccacacucucuugaagauccuucaggaaucuuauauuuuggcugaacaguggcaaaugcuuugggcccuaaucaagggccuagucuuauauaaaacuuuuguguggcaauuacuaaaaacacaagaucuuaauuacuguagcacaacaauuauccuacucauuguaucuuauaagaaggauugugauagcaauguugccagguuaauauauuucccuaugcaaagaauuaaucugcaaauauauuguuaggaacuuucuuguauauuaggaagggaagagggcaguuccgaaccuggcaaucucuguuucaguucacacaaugagaagagcuuggguaagaauguaauuucacuagagcagaacucuucaauuuugugagacaagcuuuggauccuuuucuacagugagaacaaaaacaauuuuguuggcacaaggaaacauuaauuuuaaauauaaaauguucacugucauugaaaagaucagagaucagagugaauggucuuaccuauaauauuaccaucauuuaaaaaugauacccugaguguaguuuucuggaaucccagaauauaaauagauaagcucaagcucacauauaaucucuucuugucccuaacacauacucaaguuaucaaaaacaucgacuagaauaauugugcuccuccuugaguuuaaaucagccaaauuuaaacauucgaacugaugcugugaaaucucuggcccugacuuuuagauuucucgaucccuauuccucccucagggcugcuauauaaccccguucucagcaucagguugggaauucucuguuugccauuaugggggagagaagaggucuuggucagcuguuuuucugcccuuuguauaaccccaggcuaauucuaaucaggguuuauucgaugcucaugguccuucuagguaacuaguuuaggaugucauaaaaacaagguuggauaauuaugucaugaccgguuucauaucacucugcuuaacauuguucugcauuaagugacugaauauagaggcaaugacaaaauaaaugaacaaaacauccugcccaaucccagaccugcauuugaguuuuaugcaacuaaacaucauuugagaaaaaagaacaacaaaaauuucaucaaaguauuuuuuacaugaaaacuuuaaauguaguuugaguucugauucacgaaguugcauguacaaggucauuuugguuuuuaaagaaaagagaagaaacaauaguuucugaaggcauccagcaacauacuggguugaggaaucaccaaaucgugacucuguuuuguagcuguggauuuguauaaaaaauuauucuaaucauuugaggaggcaggagaaaugaccaaaaauuagaaaucaucucuaaaguuuugguaaccuacucauugauuuucccugguagguuugguaguggacaauucaugcuacuacuuuucccuccaaauuuaguggaaauuucuagaauauguacccaagauuguccccucagaaaagugaauaugauguuuggaaauuuaacuaugaggauggcacaaaugaaaaauugcuauaaaugucccuuuuuuacaccaugauuucuaagagguugccucuuauccauucagaaugcagaacugaaagagaauuucacauuccuucaucaacauguguuuuguuugcccauauuucguguuucuuauugguuuccaaagaaacaugucagaacacugaauaaugcauguggucacuuguucuaaugcuuucacauuuuuugcauuucuuucuuuuaaagcacaagacucugcugacauuauuuuccuuauugauggaucaaacaacaccggaagugucaauuucgcagucauucucgacuuccuuguaaaucuccuugagaaacucccaauuggaacucagcagauccgagugggggugguccaguuuagcgaugagcccagaaccauguucuccuuggacaccuacuccaccaaggcccagguucugggugcagugaaagcccucggguuugcugguggggaguuggccaauaucggccucgcccuugauuucgugguggagaaccacuucacccgggcagggggcagccgcguggaggaagggguuccccaggugcugguccucauaagugccgggccuucuagugacgagauucgcuacggggugguagcacugaagcaggcuagcguguucucauucggccuuggagcccaggccgccuccagggcagagcuucagcacauagcuaccgaugacaacuugguguuuacugucccggaauuccguagcuuuggggaccuccaggagaaauuacugccguacauuguuggcguggcccaaaggcacauugucuugaaaccgccaaccauugucacacaagguauguauccucuucucaccaucugugugggagugggguguuguguguguugguuuacauagacguaagguggguaccagcaugauucgccacgggagaagcuguaaguacccacaguccaguccuucccugaugagcuggguccuggaugucauguuugugaugucaugugugcggaaaaacuaaagaccaaugagugagugaaagcucuuacgagaguaugaguugcugagaaagcgugcuuuuaaggcuaauucaacaaaccuguugcuuugagauuauuaaacaucaccguauuaacuacuuauaauccagucuuccuaaaaaugggcuugaggggcucauuacaguucugagaaaguuacuccaggacuauggcauugagcucuaaaagucaguguuagaagugugcucauagacagaguaucuuuccaaaagcaaagauggagugagggugucuccucaaagucauuuugugcuagggugcugagaguuauacuucugaagguaagaaauaacaguguaaucacuugaugaaauauuuaugaaguuuuuuuuuucuugugcuugugaaguguaggaguaauucuccugaguggcaauauuaggauacaagcucaaauggagggccuuuggcaaaacagccaauuggagugguuuaaaaaacaaaaaaaccaaccaagucacauaacaaauaugcacuuaacaaacauaggagguauggugggggcaucaggaugcauagccuccucuaccuuuugaacuguuuucugagacaucagucacuuuucagaccuaucaauuucauuaccuaggucaggccaauaggaugccauuugguaaaucagggacacaguggcccccaacaguuuccagaaacacccaacucacuuccaguguugcuuacacacugggaugcucuaaugagauuaguccuugacuauaagaccuuauucuucauuuuccuuccagaguaugggcucaaugaaaauuggugaauggauaccgaggcuccuauaagacucugauuaucaucugcaaccaaucaucuaaauuuucuugggugaaauaacacauuguuacaacucuuauuugcuaacuuuauaaauaaagucugggucuacaagauaaauauuguaauaagauacugcuuuacccauuguaucaauuacaauugaucaagggagguuuuccuuugauaaaggagugaaaauaauuuaaaaauaaccauuuuggagaauaugccauuguaugaaauuaagaguagaagauuuuaaagucuuaauuaaaaacaucacuaucuauuuauuuaaggagcugaccucuacuuaauagugccuugcuaaucauuaguucuaguugcugcauucauguaaaggcaacacaccacauuuccuuacaaggguuacaaaauucacacugaguuagauugaacuugccucaaaugauuuuaaaccacagcuuuuguuguaauaaaaauuacagguagaaagcucaggcuauggcaucucuacuuaaucugugcauuggaacugugaccaggugauguagcaagaaaaguauaugugaguguugccuucuggagaaggcugugucuggcauuuauuuaaguuugaaaggucaauucuguguggcuuagcuuuugcugcauacaguuuuccagcuuuuccucucacuugaugggaccauaaaauuggcccaaauccuccagaugagcuaauagagagacuagaauuuugaaaauaauguucugaaugcaaauggacauugagaagcaauggaaacaguguacaggacuacaugcccggugccuggagcugcucaugcucauuccaucauggugccguuuugugacucuggcaauuaagaaaacaaucaagugaaaauuuaugaccugcugagguuucucugagcuugcauacuauuggugugcaucccaaaguauagaagcccagagauuucccuauguuuugcagacaccgacgaugcaacauggcuguagaugggaaagcuggucucuggucuugggucuucuguggaccugccaugugauccugggcaggucaugcaaccucucuggguuucgauuucuugaauuuaugacaaaggaguugcaccagaugaagauaugucuguaccaggagaaguuucaacuuuuuaaugaaaaugggcagcacaugacccuuguuucagauuuucccuagccaaguagaguuucaaccccuugauuacaaacaucauguuuaauaucaaugauuaacuuguaaauauucaacaaauauccuugacuaucuggcaugugccagacacuaugccaagcacuagagauauggugcuguuuaaugagacagauguggcugcucgucuguuacaggauaauggggaaagagacaauaauaauauaaacuagugaccaggcaaaauauucugagcaugauaaguugcauuggggcauucaacagggcugugauaggaagacuggggaagggaauuuuagaucagguggauggaaggcccugagaagguguggaaccgaaggcagaugagcaugcggagagcagggggaagagugguccaggcagaaggaagagcaggagggguggcccugcaacaagaaggcacuuagucccuucccagaacugucagaaggcaguguagcuggagcacacuggacagggagccugagguucagacucccuggaugcauggaagcuggagaagcagcugcuguagggggaugagaagccacagggaguggagccuguggguugggagccaauggcagaggaagguaggcuguggguuaguggugggggcaggggcucuccucugagggcuucuauuuucucagagacagaugaggaggccuuggaggcaguggcagagggcugagcagagagcacagccaugagacagucauucuggaggacaggacagccaacuucccaaggaggcaugggaggauggugggcaggcacaggucuccugaugggggucuggaguuccgagcguggcaugcagguaccuuguuguguggucuucuccaggaauguccacugcuugggugaugcaugaggaagacugugggccugauggaggcuuucaggagagucugauggaggugcagggaugaggcauggaggaaaacagagagaggcgugggaggagggcugaagaggguugugccauguuggugaggaguagcaggaccuucaaguucaucucccaacaaggcagugaagucaggcccugcagagccacauuaaagagauaagacagcuguguuuggguugauauuuaugucaaguggaaggaaaugcguaugcaucccugacguggcucacagaagagucagcugugagaaucccaagguuuuuaucacugggucagaggagauucauggugcagcccccagagaaaugaaaugauucugcaaagccuaggugaauugcgucagagucaugaagcaaacauaggaauucaguuauucuuccaguuacucaauauuuuucaguguuuacuauauuuggcuaagcaugguucuaggcauaucaucugucaugagcucccaugacuugaauaaaaaucaaacguaaaugaccucuuaccuaaucaaaggggacucugggacagagccucugggaaccagaggugcauuucaggguucccagagcugaauccuuguugggugcaaggagacuaggccacuuguuucauuagaucuagaagguauuccuucccgcuggcucaucgggagaacuuuuagugaugcagugguagggggagggaaaacgugggaggguaggggaugauauuuaucuucucccaccccaagaguugugccauugcugguacuuauaaagaagaauauaacaaucugggccacuugguauaggagcaaguagcuucucaggucauuguuauaugaguauuugucuauuuuucugucaugugugauauacauaguaaauacaugagugguagauucaugguauagcauauauggaauuuauaugugucuauauacguguauguguguaucuauauacauauauauucucucuaaugguacaaagguauaagucuucuagagaucuacacauuaguuuuaucugcaaagauauuuuaaaucaaaaugaagggguagcccagagagacagcauguucuaaauuaaaugaaggaaggaaagcccagaauggauguucauaacaaugaccaugaaauauugagaaaagguucaaugauguucugcacacauuguuacaccaguaggcaacuguguuauuguauuaaggacguuggugcauaacauguuacccuucucuuagaacauagaccuugucuugaugcuacaggugagcacccagaugaggcacugcugucuucauuuggcauguaucagcgauucucaccccaggcaucacgcucccagcuucugguccaaacaacuagaaaugaacugcauuucaaaaauguguucuaggcuggaugugguggcucacccuuguaaucccagcacugugggaggcugaggcagguggaucacucaaggucaggaguuugagaccagccugaccagcauggugaaaccccaucucuaccaaacaaaacaaaacaaaacaaaaauuagccgggcguggucgugcauaccuguaaucccaacuacucaggaggcugaggugggagaaucgcuugaacccaggaagcggagguugcagugagcugagaucaugccacugcacuccagccugggugauagagugagauucuguccuaaaauaaaaauaaaaauaaaaauauguucuagaagguagcucugauucuuagaaaguucuuccuuaccuucaucccaaacuuuguuuccuuugucugcuuuuacaaaaucaacuugccaugcaaucuaucugauggaauacaguaacagaggacucuuuugcaaaacaguccaucucagguuuaaucauuuauguuccucuacuucuuggaaucucugucagguuuuuggguuagguguuguggucuuaacagaguucaugguucuugcaauaugggcagggugccugcacauggauacagcaguucacagucacugugagacaguuaucuuauugagauguuuuugcuuuaugguuugccuuuaaguuaucacugucauauuacuuaggaucuuuaaaaacagguuuuuuguuuuuuuuuuggagaugaaaucucacucuaucacccaggcuggagugcaguggugcaaucccggcuuacuggaaccuccuccuuccagguucaagugauucucaugccucauccuccugaguagcugggauuacaggugucugcccccacgcucggcuaauuuuuguauuuuuaguagugaugggguuuccccuuguuggccaggcuggucuugagcuccugaacucagaugauccaccugccucagccucccaaagugcugggauuacaggcgugagccacugugccuggccaaaacgcaggucucuuaagugaaaaauguuugcggcacuugcuggcuuugaugcugauuuccuuuuuauacguuuuauguuaaguaauucuuucgucugucaaaugaagacagggaauauagaacugaagagaacagggaugugcaggcucuuucagcuuuugcacuugacaaugagcauuuugaaaugaagacugugaggcaaaggguucucugagcagacaucagugguuucuuuaauuauucaagcaaugacuucacucuggccaaguuguguauuuacggcagaagagaacuuauugaauuuucagugacagcauacaaaacagguggcuacuaaaacuaaauuuguuuuugugcaacuauuuuguaaaaaguacugacugggcaggguggaaggugagccagcuuuccuccagcagguggggaggcaaccauaacuuauguguucauuaggacaaauucccuuugggguggcccuguggucacguuggccacaguaaaugaggguguccuuuaaauggaguuagcuuuguugaaagucauuguugauugugcuugguaaggccauucuaauugccuuauaauguugccaccuacagucauugaagucaacaagagagacauagucuuccugguggauggcucaucugcacugggacuggccaacuucaaugccauccgagacuucauugcuaaagucauccagaggcuggaaaucggacaggaucuuauccagguggcaguggcccaguaugcagacacugugaggccugaauuuuauuucaauacccauccaacaaaaagggaagucauaaccgcugugcggaaaaugaagccccuggacggcucggcccuguacacgggcucugcucuagacuuuguucguaacaaccuauucacgaguucagccggcuaccgggcugccgaggggauuccuaagcuuuuggugcugaucacaggugguaagucccuagaugaaaucagccagccugcccaggagcugaagagaagcagcauaauggccuuugccauugggaacaagggugccgaucaggcugagcuggaagagaucgcuuucgacuccucccugguguucaucccagcugaguuccgagccgccccauugcaaggcaugcugccuggcuugcuggcaccucucaggacccucucuggaaccccugaagguaugguggugauggcuucagacacacaaugggguggucuccaggcagggccuuuaagaacaaaacaaaaugaaguguguuuguguuuagcuaagagacaacaaaugaugaaaacagcagcaacgaacaugauuuauuccagguuuccuuuugcacuggguucaggauuguaugguuuacaaugucaugcaaugaaauuucauauaagaaccauaugauuuaaaccacaggaccaugggccaccaccugucuuugaagcuucuggccgaggaggucacaucucaguucuuaucgcuugucagaucccuguguucuucuguuucuacuggugauuucuguccagucuccuccucaucaccaggauguagcuuuccuuuccugaguuguccaucuacuucuaaacagccccagucugagcuguuuagggcacaguguccucagcuuuuaaucccucucuucucucucguuaagggauuacccucaaugggaaagcauauugaauggcuaaguguggaguucaaaccuagugguucuucaaaucccucauuuaauaugauugccaguggagaguuauuuuuaaagacauuauacagaucuaugagcuaaugaguugaagaaauacaauucacugcccuuaaugaagagaagaugagcaucacagaaugaugcuuucccaccuugcagacucgaucacuagaggauugccugaugcaggcaugacccaugcugccuggaugcaugcuuucucuucacacucccuggucuucuauauccaucucuuucucucucuuuuaaaauuuuucuuaaaacuuuuaauccacacuuucauagccaaaguucaacuuaggauacaauuaguugugaggucuaaauuacaguagggcaucagggaagaaauaaaaaauaaaauuuuaaaggcacaugguaaauguguugggucaaauacacuauuuugagaauuauacuuuuuauucuugauguguauaaguuuggccaagccuagcaacuagucuccuucuauuuugcuguguauuuacggucccaucaucucacuuugggggaauuccccuguuggaugauugccuagcaagacugugacuuccuaauaggagaagagucccaguggagaaugacaaacggggaagucugaagaagacuucaauaugagaccagccuacuuuugcuauuuuuuuuagccuuaaggaacucguuuucucagguuagugagggcuaacugcuucugagcuauggauggaagacccucuguuuguggguagaggugagccccagaggauccagccaggcaaacuuaaaccuggcugggaugagugauauggacugaugcagcaccuucauaguauucauuuuuagggaaggaguguuugguuucaaggauucugaucacuuuuguugucuguaaacauucuaacuuugauguuguagcucucuuugagccaacuugguuuuguaaacucggcuaccaauaugucucacaaacaccagccaccaccagaggaaaauaugcagccaucugccauauuuuacaagauggacaugcuuugccaugcugacuuucucuguguucuaaauguuggcaugugugcacguguuguaggcacacaugauaaaacucuccgugguuguguaugucucacuuuuuuuucugugcuucacugcaguucacucaaacaaaagggauaucaucuuucuuuuggauggaucagccaacguuggaaaaaccaauuucccuuaugugcgcgacuuuguaaugaaccuaguuaacagccuugauauuggaaaugacaauauucguguugguuuagugcaauuuagugacacuccuguaacggaguucucuuuaaacacauaccagaccaagucagauauccuuggucaucugaggcagcugcagcuccagggagguucgggccugaacacaggcucagcccuaagcuaugucuaugccaaccacuucacggaagcuggcggcagcaggauccgugaacacgugccgcagcuccugcuucugcucacagcugggcagucugaggacuccuauuugcaagcugccaacgccuugacacgcgcgggcauccugacuuuuugugugggagcuagccaggcgaauaaggcagagcuugagcagauugcuuuuaacccaagccugguguaucucauggaugauuucagcucccugccagcuuugccucagcagcugauucagccccuaaccacauauguuaguggagguguggaggaaguaccacucgcucagccagguaaaccuccccuguugccgggaacucccucuccuuccucagacaccacccuggaggguaguuugccagucugaacucaagagcacuguggacuguacaaagacaauuggcucccuuccauugaaauaguuugaauggggacuugagacacuguaccagcaaggcuggacucugucuaaaggguguucacgaaggaaagucuagaacauccagcuuauguucuguccauuuugccucacccuuuauucagaaggauuuuuuuuccucuaaugacugugaggauucuggaguucgaauccagauuuggggaucaugggguggagggagacagagagagauuuuucuuacaugaauaugccuugggauuauuuaaacguugaaauuguauuuuuacaugauuuuuaaauguucaacaucugcuguaucuagaaaauuauuuguuauaaaacaaacaaagggugcaucuucaugcaaugguaaaaugguuucuaggggaaggcuaacuuauuauuauuauugcaaauuauuauggugguaagauaugguuguaucagaucuaccagucugcuaacaucacacagaugaauggcaagacuaaaccaauugaaaccuaaucaaaauaguucuaagaacuguuuuaacugagaauguuauuuacauuacacauugcggugccauagggccugucaucuguguuuccuauugucucauuacaacagauugggaagcauugacaaggagccugacccacacagcaguaaugggcacuauugugggucuuggcccguaaccucaaauuuaaugauuugaucauucaauuacagcagauucauggcaacccaguuaucuuugagugguugacccauaucagcccccccuuuuuuuuucuagagauugagaucaauuuuuuuaagcaaagguauauuaagggccauguuuucaauacuuuuauuuguaacaguuugaaacugcugucuguuuuccuggagcgauugccaccugauguaagaacacaacccaguggggcuuuucccuggcuugcuuuauugaagaagcaugaugcuagaugggauaggcuguucuaguuacuagcuuugcaaauaugcacugauuugaaauaggacauuuucaagacaagugguaugaauuuggguuuucucuucucuugcuggcacaguggucaucagaugaguuucaccaacuccuguugucaaauggugcugggcugaagucgcuuugguuccuguuaugcucucgucccucauuguauccuaaucuaccuucauugcagagagcaagcgagacauucuguuccucuuugacggcucagccaaucuugugggccaguucccuguuguccgugacuuucucuacaagauuaucgaugagcucaaugugaagccagaggggacccgaauugcgguggcucaguacagcgaugaugucaagguggagucccguuuugaugagcaccagaguaagccugagauccugaaucuugugaagagaaugaagaucaagacgggcaaagcccucaaccugggcuacgcgcuggacuaugcacagagguacauuuuugugaagucugcuggcagccggaucgaggauggagugcuucaguuccuggugcugcuggucgcaggaaggucaucugaccguguggaugggccagcaaguaaccugaagcagagugggguugugccuuucaucuuccaagccaagaacgcagacccugcugaguuagagcagaucgugcugucuccagcguuuauccuggcugcagagucgcuucccaagauuggagaucuucauccacagauagugaaucucuuaaaaucagugcacaacggagcaccagcaccagguaugguagagaaaugcuaguugcucugccacucaguucucuaaugcaugaguugaggguaggcugcuggccacugguccuuagauagaagcccuccuugaguuuacaggaaagguggaaaauuaaucaccugcugguuucagcaggaacaauagaauaugagaugucccuccuuacuuugauucucuagcugcucucucaggagaaugagggugaguauuuuuaagggcauuagauuauuucauaguaagacauguuauaaagauuuagauaucagugguuaaaauccuuuuuuaaaaacaguuuuuaugguaugcauaauaaaagccauaucauaugguuacauuguaccuaaaacagccuucaucuucauauucacccaaugccuuuauauuguuauaauuccuucauuacauucauuaaaaauuaaaggaguagaagagguagauaacuuuccaccauaaacucugcauuaaaaucccccaacugcuaauugacacugccaugacuuuucauuuaaccccuuuaauuuagugauaaaaaugcagugaagagaguaauuuccccuguaugccuuuugaugaaaaaugaagacuccagagccucuccuuugauuacugggcccauuggccguuggcuugggaugguaacuccgacaucuggguuccguuuccucccauuaacccacuugugacuugcagcaacucaauugaaaccucccaucgauaaaaugcuagugguugugcaggugcugccaucucaugucucuccucccaucccaaguuuuuucuugaauacaucuuugaaagcuaacaauacucuucaagcauugaaaaguuccaaaauaaaaggggucccuauauugguguauuaguuucccauugcuguuauaacaaaguaacacaaauuuaguggccaaaaacaaaacaggccgggugcgguggcucacaccuguaaucccagcacucugggaggccaaggcgggcccauugccugaggucaggaguuggagaccagccugaccaacauggugaaacccugucucuaccaaaaauacaaaaauuagcugggugugguggcgggugccuguaaucccagcuacucuggaggcugaggcagaagaaucacuugaacccgggaggcggagguugcagugagcugagauugcgccacugcacucuagccugggcgacaagagcgaaauucuguccaccccccgaccccuccacugcaaaacaaaaacaaaaacaaaaacaaaaauccuuauuaucugacaguuuugaaggcuggaaauuggaaaccaguguugcuaagcuaaaaucaaggugucaacaggcuguguucuuucugcagguucuaagggauucuucaucugcucaccuuuuccagccuccaggggcugccugcauuccuugccuccuggccccauccuccauccucauugccagcagcuuggcacuuucucuccucucugacuucuguuuccauccuuacaucuucucucuaacucugacccucuuacccccucuuauaaggacacuugugauugauuacauugggcccaccuggcuaauuccaggguaauccccccauccccaaauccuuaccugaaucacaucugcaaaguccuuuucucaaguucggggauuuggacuuggacaucccugugaugcucuuaugcagcccaccucguugauaugaaauugcugcucugauguccugugugaguuaccaggcuguccuccucccaguuucaggugaaaaggacgugguguuucugcuugauggcucugagggcgucaggagcggcuucccucuguugaaagaguuuguccagagagugguggaaagccuggaugugggccaggaccggguccgcguggccguggugcaguacagcgaccggaccaggcccgaguucuaccugaauucauacaugaacaagcaggacgucgucaacgcuguccgccagcugacccugcugggagggccgacccccaacaccggggccgcccuggaguuuguccugaggaacauccuggucagcucugcgggaagcaggauaacagaaggugugccccagcugcugaucguccucacggccgacaggucuggggaugaugugcggaaccccuccguggucgugaagagggguggggcugugcccauuggcauuggcaucgggaacgcugacaucacagagaugcagaccaucuccuucaucccggacuuugccguggccauucccaccuuucgccagcuggggaccguccaacaggucaucucugagagggugacccagcucacccgcgaggagcugagcaggcugcagccgguguugcagccucuaccgagcccagguacgcagggaacucuuugcauccucacucagugucauugucuggggcuacuugucuggacugugggccacaagguguucucaauuuugcuuuuccugccaugugaagugaaaacuaaaauuacaggaaaauuuaggaacccacaugcccuuuuuggccucgaugggcagaaauggcagagguucaaggggggagaugcuaagauucauguuuuggggcaaauuaaauucuccaaaagggacauaugugcagcuuggaauucaggacuccuuaacuuugcaugaaagcuucugucuagauauccaaagggaggggccgucuaacugauaacgccuguugcguaucaguccugcgaccccugguagguuuggucagcagccuucugugaggcaggaaggagucugaccagggacacucugcaagcugggacauagacucugaaauauugguaucuccagagccaaggugugaagauaauuuugacuuugcuuggugcugagaagugucuuaacuggcaggaaggccaccuggcucuuaugaccauaguuuauucuauuuucuuuuuccuguucccucuuucuaggccugguacaauaaacuaaaaaauggugggagcccuggugcugagaaggaaggaggaaagauauaucuaccucucaauaaauguccuccaagggccacucucccgggucacucgggugggggggguucacaguggcgaaggaggcagaugcggccuugcucccucauaugcacucacuugccugcucuuccaagaggagagaaaagaaggaaaguuggggaggagcggaggaaggaguaaaagcaagugaaaggaaaucacugcaggauacagugggugaugagggaggugaggaugauuauuugggugcaacugagaggggcuugguuucuccucgcuggugccuggggaagagagcaguguggcccaccagguuucugugggauguuccugagcauuuaugaucagguaaauuugggcaacagugggauaaacaaagugaaagaggcuuucuuucuuccuaacuaaggcgcuuugugugucuccaacacaagaaaggaaaugcaacauuuccaaaauguaucugccugcaggaggccucugugaugcugugucuuggccccagauugccgaggauggacuuugggaauauugucacagugcgggugcagcuucuguugucaggaacguacauuuccacaacgcuguggcucuuugcccacucacucuccugcgcuccagaacagccucccucuuucccccuucuccccauucggaggcuucucucacaccucuccugacccaccugacucucagcugguaaucuugaguccuauuucuccaagaaaaugcaaguaaacccaaagagagcuguccccggccacgucaucccgugguuccuuggguggccugucuccgcuuccucagcucccuuuccucucaccugcucaguggcaccaucugcaguucccuuucuugcucuugugucacccuuucuccacugugcuggaugguuccauccaugauaaaaugcauugcuucuucucucuuaaacacccucucugaugcgccacuuccccugccagcagcaccugucuccuaaagacuuaucuauacucuaaaguuccuuuccucccauccucucugagcccacccuacuuugucauucacccuugcuccucccccaagugcuccaguugaggucacuccaucugacaaggucccugucucuggcgaagcccaguggcugacccucgggucccugagcagcaccugaugcagugcaggucacguccuucccaaguaccauccucgcuggugcugaugaggcucuucugauucugccuccgucggguuuuucauccuuugcuccccuucucuuugauguguaaacacugaaaugcccaggacucccacuucuuggacuuuuaacaguggugauugguguuaggauccccugccugugaauccaugacaaacugggcgguggcucaugaacgcuaagaauuuggugacgaugaaggugaagccaugcucacauuuguuucgcagguguugguggcaagagggacguggucuuucucaucgaugggucccaaagugccgggccugaguuccaguacguucgcacccucauagagaggcugguugacuaccuggacgugggcuuugacaccacccggguggcugucauccaguucagcgaugaccccaagguggaguuccugcugaacgcccauuccagcaaggaugaagugcagaacgcggugcagcggcugaggcccaagggagggcggcagaucaacgugggcaaugcccuggaguacguguccaggaacaucuucaagaggccccuggggagccgcauugaagagggcgucccgcaguuccugguccucaucucgucuggaaagucugacgaugagguggacgacccggcgguggagcucaagcaguuuggcguggccccuuucacgaucgccaggaacgcagaccaggaggagcuggugaagaucucgcugagccccgaauauguguucucggugagcaccuuccgggagcugcccagccuggagcagaaacugcugacgcccaucacgacccugaccucagagcagauccagaagcucuuagccagcacucgcuauccaccuccaggugagaugggggcgucggagguucuccuuggagcauuuuccauaugaaaaauaacaggcucaaaggccaugguacucauaauaaauuaaauuaaaauaaagguuguaugcccuuaccuuuaugguuuuuauuuugagacagggucuggcucugucguccaggcuggagugcaguggcaugaucauaacucauuuuaaccucugccuucugggauccagccaaccucccacuucagccuccucaguagcuaggacuacagguucauaccaccacgcccggcuaauuuuuuguauuuuuuguggagacgggguuucaccauguuggccaggcuggucucaagccccugagcucaagugauccaccugcugcggccucccaaagugcugggauuacaggccugagacaccgcgcccagcaccuuuauguucuucaugcccaccagccagaccccaccaggacacaccugcgacugaacaaguugggucuauugcucauggcauccagggagaaugcauaccguggcaaagcaugagggcaucuccauaggaggguggccggaaggacuggggggacuugagcuaguggcaggucauuuuguggaaggcuuaaagaaauggaacuguggccuggauuggauguugucaagacguggaggugauucuguagcuguaucuuaagucuuaccuagaagcaggauggccuugguauagauugguagagaagagcagucacucuuauuaaccaggacagggaguguuuuuguccuuuuugugguuugcaccauguuuuucuuuuugucuguguucagauaggguuacaauguggucucauuuucaucuugccccauugugaucacagaguagccuugucuguuguggggguccugugagaucaugugugcucaacaggagaaccccaaggccaugugugcuggaccagcuccccaaugcgggggcugauucucucuuucuuaaacagcuccaucacaagagcugcucagcuuccacuaugcugcauuuacaccguaaauugcccaauuguguaugaggcaaagggcagguugaaauguguggaguagcaacauacaaguuuaauaaaauagcaucugaggaguaccuaaaauucuaacuaauaggaaaauguggcucaucuuucucaggaucuuuugauuaauuuuauuguuaaaaaugcacuaggcugggcgugguggcucacgccuguaaucccagcacuuugggaggccgaggugggcugaucaugaggccaggaguucgagaccagccuggucaauauggugaaaccccaucucuacucaaaauacaaaaauuagcugggugugguggcacacaccuguagucccagcuacucgggaggcugaggcagaugaaucacuugaaccugggaggcagagguugcagugagccgagauugcgccacugcacuccagccugggcgacagagcaagacuccaucuaaaaaaaaaaaaaaaaauuaaaccaguuauuuaauagaauuaaauauuuuuaaaaaugcgcuaauguaaagaaaaugagucagggugggugggggaagcugggcauggcggcucaugccuauaauucuagcacuuugggaggcugaggcaggaggaucacuugggcccaggaguucaagaccagccugggcaacacagugagacccucauccaaaaaauuaaaaaaaaaaauuuuaaugaaauuuaaaaaauaaaggcacaggcauggugguucaugucuguaguuccagcuacuuggaggauaaggagggaggauugcuugagccugggaggucaaggcugcagugagcugugacugugcaacugcacuccagccugggagauagaaagagaccaugucucagaaaaaaaaaaaagaaagaaaaggaaauagaggaauaauagugaaaaauaaaaacuucauauaaaugcuagagaugugugagcaaaaaggaaauacgagggcacaaaugccuggggagcauuaaugugaccccuuggauauggcacuguguuauacguacccugcccccaugggcugagauugcgcagcaugcugggaugguguugggcuccucaggggucucacuugcuaagugauggccuuggacaaggcgagaaccuuuggccucagcuguuucucuucuuguacaacaaagauauagaucccaguggccuuggucucuucugguagcaacaguucaugauucuguagauuacgguagcccaagauugauuucuaaaugcuccuuacauuuuagaaaucaguaguaacccagaccacaaugccaaaauuuaaauagaguaaauucagaaagacacguuuuggauaacuucaaauauuucaaggagcagaaauuguuuugguguaaaagguccaauuuuuaacggcuaauuucaaaaagcccgagauacaaacaacacaggcaucuugggauauaaucuuaagguugauuaggauuauggugcaaggugcacaccaaaccugggugagggcuacuuacacacugaauguuucccuuuuucuucuuugaucugcagcaguugagagugaugcugcagacauugucuuucugaucgacagcucugagggaguuaggccagauggcuuugcacauauucgagauuuuguuagcaggauuguucgaagacucaacaucggccccaguaaagugagaguuggggucgugcaguucagcaaugaugucuucccagaauucuaucugaaaaccuacagaucccaggccccggugcuggacgccauacggcgccugaggcucagagggggguccccacugaacacuggcaaggcucucgaauuuguggcaagaaaccucuuuguuaagucugcggggagucgcauagaagacggggugccccaacaccugguccugguccuggguggaaaaucccaggacgauguguccagguucgcccaggugauccguuccucgggcauugugaguuuagggguaggagaccggaacaucgacagaacagagcugcagaccaucaccaaugaccccagacuggucuucacagugcgagaguucagagagcuucccaacauagaagaaagaaucaugaacucguuuggacccuccgcagccacuccugcaccuccagggguggacaccccuccuccuucacggccagguaugcaccgugugacccaugacuacagagugugacaucaacauuuuuuuuuuaguuaaaaaaguaaucaguagucauuuuuaauaauuuucuucucucuggguuguuucuucagauaauauuagaaauuaaauacuggaaaaguaguuccauugaaauugcagaaggaagcauauuauugaucuuccaucacuccugagacuaaucauagccccauugaaagguucugcaguguugcacugagauaauuacaaacucauuggcucucagaauaggauggcaucuuugaaaucagccaguccaugccccacugaaugugacuuugaaguuggcccaugccuacuggccagaugcccaauauaguccagguccccucauuccuuggccuggugggaccaucagggagcaccuuccuggaagacuugcagucguccaccucagcuucuaccccgugcuccugguucucgucuuuggggcugcaaaagcaaaguggaucucuccaccagcccauauuuuucuuugucccuccuccaaguaaucgccauguagacaucugaagcaaaccauuaggguugguucuucaaaggggagcaguaugccuguuucccuagcucacugcucccuaccaggcugccuguggcacaucucacaucccucacacugucucucauccuuucuccucucuauuccagucucaguugcuuaauuauaaucaagaaauuacccuccacaccacugauauucagccagcuccuacaaagcucucagaccaucauccaaagguuaaggggccucuuccuauuuuccaaucuguuucuccuaguccuuccuugcuuugcaccucacacacaucucuucacuuccaggaacuauuuaaaauucuugaccacaaaggaaacuucuaguggcauuuccuaaaacacuugagaucacaaaugucaaagccaggucccuauugaauucuugucacaaugccauuuugcacgggauaacugaaguucucugucacugaguuuucacagagugugacaucaaauaauuuuucuccuuuccuuuuuguuuagaggauuuaucauucaucuucuuguauuuagcauguuugggagcugcaaauucaggaacuacaggcuaaagaggcauggauuugagugaagguuucacugugaauaaauuauuaggaaugucuuauuucaguuauuuaauuuuaccuuuuguguauuuauguucugggucuggaaaccuaaucucuccuuauuuucacuuuaaucacuucuagagaagaagaaagcagacauuguguuccuguuggaugguuccaucaacuucaggagggacaguuuccaggaagugcuucguuuugugucugaaauaguggacacaguuuaugaagauggcgacuccauccaaguggggcuuguccaguacaacucugaccccacugacgaauucuuccugaaggacuucucuaccaagaggcagauuauugacgccaucaacaaaguggucuacaaagggggaagacacgccaacacuaaggugggccuugagcaccugcggguaaaccacuuugugccugaggcaggcagccgccuggaccagcgggucccucagauugccuuugugaucacgggaggaaagucgguggaagaugcacaggaugugagccuggcccucacccagaggggggucaaaguguuugcuguuggagugaggaauaucgacucggaggagguuggaaagauagcguccaacagcgccacagcguuccgcgugggcaacguccaggagcuguccgaacugagcgagcaaguuuuggaaacuuugcaugaugcgaugcaugaaacccuuugcccugguguaacugaugcugccaaagguaacucccauuaugugcauauuuuccauccuuuccuguugacauuugugccucuuuagcugucuggucccuggugcugaccucuggaguccuuaggcauuugguugcuucauacauuuacuuauacccacugggacugguccugacacccaccucaccacuaccuagggcguucuuccaagacaagaguagaagucuaucauauuuugcuuuuauaagauuuacuuuucuccccuauuccuuaaucccucaaacaauucagauuuauugauuccugugucuaauuauagauuuauuagaucaaguauuugagaucagaauauuugauuuucaagugcuuuuaauuuaaagcacaaacuuggggugcaucuaaacaccagugguguaucaucacaccaaaguuaauuaacaccaccaacaaagcugacuuuuuaaaauagcuuacuauuuggcaccuaacagcuacccucauuucucucugugagagggguggauagaauugcuucucaaagcucacacacacaggaucucauuuugcacuugagugcgaugcccugguccucugccuggguugucccuacugcugguauaaguagaguucgucuccucagccccagcugagaacucaucaccugcauuucuccuuuccagcuuguaaucuggaugugauucugggguuugaugguucuagagaccagaauguuuuuguggcccagaagggcuucgaguccaagguggacgccaucuugaacagaaucagccagaugcacagggucagcugcagcgguggccgcucgcccaccgugcgugugucagugguggccaacacgcccucgggcccgguggaggccuuugacuuugacgaguaccagccagagaugcucgagaaguuccggaacaugcgcagccagcaccccuacguccucacggaggacacccugaaggucuaccugaacaaguucagacaguccucgccggacagcgugaaggucuguggggccaguugguucaggugcucccugggaaauuuccaaauuuuuacuggaaaggaggaagcccuucccccaaguuaaauccucuucauguuucacuggauuguuagugucuauauggaaaaucccuuaguuauuaacugaucuaaugucauguacugucuuccucauuuugguagucuuacguaagcucuaaaagaauccuggaaaucaguaguuuaacuugaaugaguugaauuugugauugauuuauguuuaauuauaguccagucagguacguucuccacuuucauuucucuguguguaugugugcaugcaugcauguguguauauacaugcauauauauuguguagacacacacaccaugugaguuugcuagggaucaucaugaaguacuacagccuggcgggcuuuuggaacagacauuuauuuucucacagucuuggaggcuugacauccucgaggugucggcagggcuguuucuccugagucuucucugcuuggcuuguaggcaggggucuucucccugugucuccacauggcuuucucucugugcaugucuguguccaaaucuccucuucuaaaaggacaucagucauacuagauuaagguucacucuaaagaucucauuaaccuuaauuaccucuuuaaagacccuaucuccaaauacagucccauucuuacgguacugggguuuaggacuuaacauacaaauuuugaggggacacaauuuagcccauaacacaugcacacaugcacacacgcacacacacccacagacaugcacccacacacaugcacgcacaugcacccauacacaugcacacacauacgcacccacacacauguacacccacacacccacacaugcacacacacgugcacacacaugcacacacaaugcacccauacacacacauauguacccacacacaugcacacacaugcacgcacacaugcaugcacacauaugcauaugauucgcagaaacuacaucuuagaaauaugagaaugagauaaaaauuguuuuuauugucauugcugcuugucuuuuuuaaaauaaauuaagcacucaaauauacuccuccauuuuaagugcaauaucaaagucuugugaacauggguaaucauuccucaacuugggcccucaguuuccuuaaguguaaaaugaagggcuugagacagcgagucucucaguuuucuaucagcagucugcaacacuccuuuuuaguuuuccugggauuugacagcucucuuaucugcagguggucauucauuuuacugauggagcagacggagaucuggcugauuuacacagagcaucugagaaccuccgccaagaagguaggugccaaggcuuucuaaauaugagaaguaaacccuggugaggcgggguguacugcucugcuggagagaaaccucucugcuaaugcagcgccccaagggagcagcguugucuugggagacucuuccucccagcguuguggcccuucaucaccugcuuggagcugugggauggagcuaacaaaaauuccuucuguacuuagacagcuuuacuguuguguuguggcuguucaggugguagaauguucagaaagcaugaugcuuuugcaaaagaucaugacguauugauucauuuaacuucaucacauaaacuaggaauuaguuacuaauaaaaauacauugcucuauuuuugguuugcaguuaucacaguucaacauuuaauaacacuacacccaaauaauacaaagaaaauaauguaagcaaugacguaccaaacauaaggugacagccaugccuauuaucagaugugaucuuugacuauucacuugcuuuggcguuugguagcacugacuaucagaaaguggaugccauuacagaaguguaauuuauccuaagaacuuucuauuuauuagcuuacuuuucccaagcaauggagaugaggcugcuauuaucugauuuuggagguguuaguauuucaauacuucccacagcauacucguguuacagagggccugaguuugagaacucaugcaugaauacacuucauggaugccacuuccuauauuuuuaguaauagguuuaguuauugacauaccggaaacaauuauucagcagaguccaaaguuugaguauuucaacaauucagaguagccaguaaacuugauuaaauauauuuaaguuaaaagcuaaauuuuacacugaaguuuucuuuaaaaauguagucaggaaaaaaggacauugcauuuuccacaugccuaggugagcuguauuaaaugugucuuucuuugcaggaguccgugccuugauccuggugggccuugaacgaguggucaacuuggagcggcuaaugcaucuggaguuugggcgaggguuuauguaugacaggccccugaggcuuaacuugcuggacuuggauuaugaacuagcggagcagcuugugaguuuuuuuuaugucuuuauacacagaccaguguagauaccacaccuuuuggcauuucaagagaaugaaguuaauuaucagcaggugaauggagguggggggggggccuugguagauaguuaaauuuauuuaauucacuugggaacugccuuguugccauaacacaugugaaucuggaaauggagauagcaaaucgcuggaaauccagcgagcuggaaggggauccugggcgcgcugagguuguggccuuagcauuuucucugcucccuuagcaacggccucuuuuaacaccauugcagggaugcaaaccaucgagauuguccauccuccaauuggaaacugugucaagagcaucugaaaucuugcaugauaaaaacaacaugcaggaaaagaaaggcuguuucuggguggagaagugcuuuaauugcccucccuaguuucccucugugucaaugaagcucccucugaggcuuccucauucuccccagggccagccucucucagcuggaggugugaccuccuggguuuagacuggggauggagcuuuuggaagauguggggcugagcugcgaacucagagauucuuugaugguagcaacaguggacuguggcuaugagaaugggaggaauggaccuuccuuucuuccauacuucuuugcaggguuagaaucaggauuuuuuuccuaguggaaguagguugaguuagcucacaaaucugggauaugggagaaagggaaagcucuuggaagcucguuggaagaaagugcaugugcccaccauuaguuuagcagauggaaauguauuugggcaugcccuuucccacauaaggucaggggccagaugggaugagaauguagagggugucugugugaccuggaguugagaagcuuuuggcuccgaggccaggaccacuugugccugcucccaccauggcugcucuggaagccucuuucugggcugguaccauaucccaugacucucacccugguuccaaggaaggguggucauggauaucuguucuggaaccaccuucagucuuggccaucugccauuugcuuggcuuugcacuuuggaacuggaacauauguaaguuauaguuaagaucugaugauggaaacuucuagaaauaagguccagccugcagugauauuguggauaagaucuauuuuacuuugguuguucuuuacuuuccuauuggugaccucccaucugcaccccgaccgccaggagcugggcccuccugacuucgcuggcaauuucuaucauaucgucagucguccagcaaaugucaccuggagggacuucaucucacaccgugaaacccccacacauccgauuuugacccuuaaagcgcauuuaugauuuucugcugggcauuucuugagaucugaacauuugguuucucuuccuuucgguaggacaacauugccgagaaagcuugcugugggguucccugcaagugcucugggcagaggggagaccgcgggcccaucggcagcaucgggccaaagguacgguggcuuuacccuugcccacgccugagaugaggugucagaagcccgacauuacuuuggugggguaauuucucuaacagaagaguguggagaugaaggaggagacgagagaccauuucuuauguuagaaggaggagcucugaggggcagaccugcgugcuguucugcuggggccuguuccagugaagaugguucaggcgggacccuccuuuugcacaggauaaggggaucugugcuuuaacagcuugguccuucauuucauaaaauaauguuaaaggcagcuggcgucccugacagcagccuggcugcgaauggcagcuggaacucauagcauuugcucugagucaguaggaacuaacaggcuuucuuggcagagcaggagccuuagagauccugauagagagaaucgugacaugguguacugaggggaaaagcaguaacagggaaagccaugcugaguuuuagugcugcucugccaaaugaagggggaccacagggauucuuacuguagagcaaagaagaccacgggauuaaacagaggacccgauuacuuuguuucaggguauuccuggagaagacggcuaccgaggcuauccuggugaugaggguggacccguaaguaaaaauuguuuuagucccuaaaauuucacccccuccuugauccuuacccauugggauugcauuguggauuucaucauuuguucaguugcugauggcuuucccuuugggagaaaaauuaauuuauacuuuucuuaacaacuuugccuggaugucuaaguacgauaauugaaguaugacaaaugugggcaugaagggugggauuuguucuuacucuguuucagaaggagggauuaauugguuucugagccagagggacaccgaauuugcacacccaguaucuacuagauuaagacaugcaaguagagaugggagugagcugaggggcagggacacagcaggagaccucaccagggcuuuagggguuaccccguuaaggguagucccuggaggggauguugcuggaucagaucaucaguauccgagggucuuggggauggacagaccccaguagcaggguccaugggagcaaugcccaagacagacaccugucuggggagcuuugggacccuagaucaagguccagcccugggauaggggacagaggggcucacgaggaacaguguggucaccagggcccagccggcagggcucggcuagagaacugggaaucaagcaucacuuggaggagcugucagcccggugggucuucccgggauucagcacccacagagacacagugcugggggccacccacccuugccccacagggcagugcugucugcgcugcuacccucccagaucucauucccuucagggaaacugcagguuccaggccaggccucaugcaggggcccaagaggcucccuggcucacguagccucgaucggcguuccccauggugaaaucugcuuucugcugcaugcuguucacaguacccuuuacgcugcugcaagcccggcagagaaagggugaugaagggcuccagcuugcaaaaugccuuugucucucacaacagggugagcgugguccgccuggugugaacggcacucaagguuuccagggcugcccgggccagagaggaguaaaggugaggcgugggugaugggguugcuagcguggggaggggucaggugacucgcaguuucuccagaugcugccagggagggaggcgcugguccaggcuucuugaccucagcauucagcagcccgugaccucucauuggaaggcaguucugagcaggguggguucaggagcaggggcugcagcugguggggagccugagaauggagaaauaguuuccuguggaaacaugaagaagccaggaaacccucacaaggagagaacaugggccagggcggaggguaggcuggugcccacggccccggcccuggaccgugggagcagucagggaagggaguggagugagaggacagcagguggguugaaggcuggugaacuugcuucucuguuugcugaaguuugaaggcaggugcugaagggaagggcugcaaaguuacaaagucagcuccuugcccuggguuuugggguccacccccgccggcccagggagccaagaccacccaagcauucaguucuaguuuuaguuuuaaaacaucgcacgugguggugagagaggaauccaaagggguaggacucuaauauuacauuuucagacacugcaacauucaaaugggguggagugggggaacagcccuuggccucuucugcccgagggaccagcccugcaggaaaagcuaaugcuuccccuaucgccuugccuucuagggcucucggggauucccaggagagaagguaugcaagcuugguuuuguuuuacaaauggaaaacucucccaguauuucucauuucuuccuuugccagaauagcuuucuauacuuaccuguccgccuuauucccucuuagggcgaaguaggagaaauuggacuggauggucuggauggugaagauguaagugauuuuacucuaaguccaaacugcuuuugguucugaagauuccagaaacuaacaacucagucugugauagaaauugcagcaggugugaccuuuaauccuugucuuuggcagggagacaaaggauugccugguucuucuggagagaaagggaauccuggaagaaggguagguguauuuccacgguggugcuauuauggaaagaauaucaacauuucauuuagggaauaguuauuuucuuuccucauauacaucaagcccgcuuccuccaggcagccuucccugaccuccccugugagugcacccauuacauccccucucagcucugacacauuacaguacauuuucuuguuucgagaucacaucccauagggcagggacugaguuuguuuuguuauaaauaaaucuccagugccuggcacaaaguggguccccaauaaauauucauggauuuacuaaacgaaugaaaaauauguggaagugaauuugccuucauggugaaugaguaaauuguaaacauuguucuaguuaagauuuaugaguugaagaaugugauuuuuagggugagauaaaaauggaaacaucuaguuuuuagcauccacuugugcuuuuucuuuagggugauaaaggaccucgaggagagaaaggagaaagaggagauguugggauucgaggggacccgguaaagauuucuuuauugacgauuucagaccugagccuggggaagaggguuguugggaaagggggaugaaaggaagaauucuacuuuugaaauugcuuuaaaacacguugauaaaauaugugcuuugucuuuuucuugcaguuuggggguuuggggagauguguugguucucuugcuaaccagauaaucauuugcaaguccuguuauacaaauaucugagaaguuuccaaaaaugugguaucagggcacuucaaauuugcuuuuggaaaagagaagaguuugcagcuuuucucauuuugugucucuguaaaacguuuaagcaaaugagcaguacaagcuagccucuucuuccaguccauccugccucuguggccaaggauaagcaggagugagccuggggcauccuccucccuggggaagaacgauugcaccuguuuggggcuaagagugcuuugcugaucccgugauuggguuucguaagaccugcauggauguuaccuggauggguuguggccgaagggcuugucccucgaagccuugcaugcagguccuugcuaauauuucccugaccauccaguccaguggcagcugcuuuccuuccauauguggcucauuucccuuucccauguugcuuucaggguaacccaggacaagacagccaggagagaggacccaaaggagaaaccggugaccucggccccaugguaaggugcugcacauuccuagacucucccuguacugagggcaagagaaaggacacacuucucggcucaucagcagccacagaggccaaagacguggccuuuaacacugcaacguagccuaagauuagcagcagaguccccgugaaggaagucuccguggggaaccagagugacccuugccaaguggggcuucucagcagaaucugugccucuuagauauuuacggaaggugcuuguuaagccaaaggcuuguagaggugggaguguacugaaguccggugcauccugcaaagugugcaacuguccugcagacgggcucuuccucugugaaucgaccccuuucccugcaaugucuugugcagcauuucagagcuagacauucuucucugcagaugagaaucucaugcuaauuuuccccacaccagggugucccagggagagauggaguaccuggaggaccuggagaaacugggaagaaugugagugccauuagggcuuuggggggcucugugacaauucuuagugccauaagaucugcccaacaugaccuggugcaugguuaguccacagcucugcagugagugaauguaaaaggauuucugaaacgguuguuacuccaaucuauuuucauucuuauaauuucccuggugcuucaucucuucucucuccccaauucuugcucuccccaaaaacauacugaacagauacuuuuaaaaauaauaucuuugcuacuuucaaauaucgggccagguuugauccaacuaaauauuuaagagacccaaauggaaauccuaauacugggggagggagggaauaaggggcaagagggcugagggaguuguggauuuguuguuuuuguaauuaucuguggguuuuuggggggaugcuguaagugaaauaaaaaaacuagauuucuucuuuuucuggcguauugcaucuugcaauuucaagacauuucagaaaugucuguagcagaauagcuccuuguaugccuaauccucagucuuguugaauaaaugcuaaagucaaagugaugugaaugaucuuucugaagccaaccaaaagcuuccaagguccucgggcacagacagcaucugccuuguagcugggagaagaccagugguguagaaguuuguaaccucucagaggaaauucaggaugcuggugggugccuaggggaggucucugcucagaaaugaacagagcacaaaggcugcaagcuggggcugggugcugggaacugggcccucagccacgcccugaggggcaguggcucguucggcccggcacuugggccaguagaguucgcuggggugaggggcuuucaaaaggagcgacucaccaaaaucaaauugauggacuaugggcaucauuuugcuuugaaaauucagaagaaaauagaaauuuugaaaauaucauuuuaaaauguuugagcacuauuuauuuauuuauuuuuaauaaauuguaaagaccuggaucaacugcuuggaagugagcauuauuuuugaauaaugcuauauaaugaaaaagaagcuauauaaugaaaaagaagaaauacucaucaaauguuacaaugggcuauuacaacucagcgugugagcagagccaaaacuugguuucaugaaaugacuuaaaauugaguaguucauacaauuaauuucaauucuacacacaagguagaaacuggauuugaauucgguuucagucacgggcucuugaggacucaguucuuccuuuuguggucuaauggccugcuaucccuucccuuaggaccacagugccaggcucaggccaagcugaaaugugucccucccacugggcuucagcaugccuacauccccuuucuagagucuccgcaggcggccucuggccugagcaauguaucacugagugcugcuggacucucauggaacucuagcaugucucuuuugggaggggccaggccagauuguugguuuguagaggagaacaguguccccuugucucaaauuuuccauggaagguggccaagaucuuccgcugaagcagguggcauuacagcgaauaauggcaaacuggucaccgcagaucacugggcugguccauuggaaguggagagugagguuccuagguugauguagcagaugacugagccccacaacagagcuagucggucacagccucugcaacaccaacccuaacuuugcaaagaccgccugggacauucauaaagucccaccccaaaccuuucuacugcugaggaaacaauuuugagguggaaauuaauggauuacuugugaaguaagcccacauguuugaacuaaaggucaccucuggagcauccaggaagauguugccaagucgugagcccuaccuaaguacacgagacguuuaggugcacaugugugugcuucagauauuuuacuuaaccgaguguguguuguguuuggccgggaucacuuggagaaccugggacucccuuccauuauaauuaauguauuucaugacuucucaguacaguugggaagguggaagaaaaauagacagguugacauucccuuuucacauuccucauuugaaacuggcugggaucgugcagccaaaaggagucauuauuuugcuuggcaggucugcaguaauucucaaaacuuccauugggugauuaacaggagcagcaaggaagcaaaacuucacccggaugaggguggaggaagggugucugugugugcgaguuuccccagggcugaugaggugugguuucugguucuuggcacgaugugggugcuugggaagauuccccugaguaaccgcagaauaagagggugaagucugaaagagcucuaggccccaugcccagcgucccaugcucccccucacaguuugugggacuuuuucuuccacaggguggcuuuggccgaaggggaccccccggagcuaaggugagccucaugcagugcccccuggagacucucuucaaacagcccagaugccgcccagcccaggagugaaaaacacucucuccugugaacccaaagcuucggagacagauaccaaucaauuuagaaaguugauuucgccaagguuaaagacaugcccgugacacagccucagaaggcccugaugacaccugcccaagguguucggggcacagcuugguuuuacacauuuuagggagacaugagacaucaaucaauaugugugagauguacauugguucgguccagaaaggugggacaacucgaggcaggggaggaggcuuccaggucauagguagauaagagacaaaagguugcauucuuuugagucucugauuagccuuucacugaauacacaguuuaccagaacagucaccuaugccuuaguuaggcuuagugaaaaacagggcgaaggaagcaauuggauaugccuuugucucccaugagcagagggaugacuuucaguucugucuguccuuuguccacaaggaauuucccugugggcagaaugugagggagguauucagcuuaaaaaaaaaaaaaucuggccaggacgguggcugaugccuguaaucccagcacucugggaggcugagacaggcggaucaccugagguugggaguucgagacuagccugaccaauauggagaaaccccgucucuacuaaaaauacaaaauagccaggcgugguggugcaugcuuguaagcuuguaauuccagcuacucaggagccugaggcaagagaaucacuugaacccgggaggcagagguugcagugagccaagaucaugccauugcacuccagccugggcaacuagagugaaacuccaucucaaaaaaaaaaaaaaaaauucuuuguagcuaucuuauuuaagaauagaaugggaggcagcucugucugaugcaguucccagcuugacuuuucccuuuggcuuagcgauuuugggguucugagauuuauuuuucuuucauccuccuugggcuguucuggcucccgaggcucugucagccgucuccuuaaacagccucuucugcagagucuagagaaaauggugcccaguggggacuugggguccaagugcaggaaacaugacugaggcaguagugucccgggcgggcgccucuuccagaacgugcucaccuaucuggccaucagcaacccgcaacuucccggugucucgguccucugcuuuaggucuaaaugaucccuguuucacaaagcuguccgaggagaggugaggcaagagugaggaacaauuguagaagugcagggagacagcuggcuccugugcucagugucucaccugggguuaccgcuuugaucaucuguuaccucuggaagagcugaguuuucccugguugcuuuccaagucccuggcccagaaaugacuguagagcaaagagcugacauugacaggaaccauccugacuccucccugcaucuucucuuauuucaaagggcaacaagggcgguccuggccagccgggcuuugagggagagcaggggaccagaggugcacaggugagugcuuccgugugugacugugugcccucugauauuucacaaaucauuuaaaaaaugauuggguggcauuuauauccggaaaguuaaccauuuuaaagugaacaauccaguggcauuugguacuuccacaaugcugugcaaucaucaccucuaucuagguucaaaacacagucucgaaggagaccuguacccauuagcagucacuccccaucacccuccaccccgagucccuggaaaccacuaaucucucucucuuuauggauuugcccacuauggauauuuuguauaaauggaaucauuuacuaggcagcuuuguguguguggcuugacggagcaucauguucuugagcuucauccacauugcagcauguagaagcacuucauuccuuuacaugauggaaggauacucuguuguguggcuacagcacacuuuguuuauccacucauugguugauggagauuuagguuguugccaucuucuggcaauugugaaugaugcuucugugaagauucuccuacacguuuuugucugaaugcuuguugcuuguauacauuuuaagcucacuugccuauucacgaucuggauugaggcagcugcuacugcagcuaagacaggauaauuguggguuuugguggccguuuuuggccagcagaagugagguuccaggcccugugggaugggcagaugccaugcagaggcuucucauggaaagucaccucauuagcacucacgauggucuuuuccuuccucagggcccagcugguccugcugguccuccagggcugauaggagaacaaggcauuucuggaccucggguaagccuguccuaauaccagcccccucucuagcugaacagagggcacauugccaagcaggcugagagaguuucucggaugaugcuauuguagacagaccucccuuuagcucuccucuuuggcaacaaaaaccccagauuuaaccucaggccuugcagugacuggcuacuucaccccaagaaaguaagaguuuccuuuuuuggugcuccaugggccucuaagucucaauucugcuccuuccaagugucccuggguggaaaucaggggauaugccucaggauggaauccuggaaaaucuaaaucuaccaaaaugcuuagauucugcaagguguuuccccuuuggucccuggagauagccccuugugcuuauguauuuuguauagugagugccucaaguucacccaugaguucagcacagaagauggcccuuaaacuugcugugacugcagauguuaucuugcaaagcagcuaucagcaaugaugagcagagacacacugucauugcugggcuaggaucaggugucacggaauuacguauucggguuucccucauggcugagaugauauugagggaggcauccuaucauuuauuaccaaaaaaugacuaauaaacugguaacgagcucaauauguugcuacauaaauguacaaaaauauuuuaugguggaagcaggcaagaacuugcuuagaaaguccuucucuagcuugaaagcugauaaauacauaucuuuagacguuuuuaaaaaacauuuacuuaacuuguaauuaaucaacaauuuaagaugguauagaugcaaagcuauucaaauaguuauccaguagcuccagaaacauuuauuaauuugcacuuuuucaccaucucuuuuauguuauuuguggguugcguagacuguaccacauuuuaagaguuaauuucauccaucaguuuauucauucaccuaacaggcuuuaacaugcccauauguaccaggugcucacugugagggugugaaaagggaggcagaauaaagucacauaaaaucugggagcuugccguccugucaggaaccuaggauauguacauuaauaacugcaacaugcauuaauuugugaaaacuggcacugagagguaauacucauguuuuaaauuugugcaugccauuucugugcauguuuauauuugaguccguagccccgugcucagagcugagugcuugggauuugcaggugggacagguuccaugccccuggcgggcucugacuuccaugcaggggagagucagguuucagagaccaauuugccuggacgguuggccacuucacugacacauuccuccccuccugcuccagggaagcggaggugccgcuggugcuccuggagaacgaggcagaaccgguccacugggaagaaagguuugucuuuagaaagguagagcuuuccugaggacagggaccagccaggcacacaugccccucucccucuuuggucagucugucugucccuccucuucaguacuacugguucccacuccagccuccccuguugaucgcggcuuggccaguggaaucauugucccccaacaauccccaccauaauucccaccaccaucccugccaccaaccaucucugcucagagggcuggcuuucuccuggccacagcccuccaucagcugccagguuuucugcuccucucuugcuuggcuugugccaauagugcagcacccucugagccaucagagcagccgggcagugcuugguacaguuucaguauaauauggaacgagcagucuuuaaacaugggcagugcacgcacaguggcucagcuaaucacauuuagaucauccaagagccccgacccugacuguccuggauaacagcaagucugcuguaugaaggcugccugagaaccuccuuucuaucagcuuugagauaaauuacaauuugucauaaccaguccgaaaagacugcauguucucuguaaaagaaaugaguuccugugaauccacgauggucucugccuggagaguguuuugggguuuuaugcugggcucaaugcccaccgccuuccgugccuucuucucccaguuguuacucucucuucucaucagcccgucccccaugccacgcuggugaaaaggacaaacaaaacccuccuggauucuuuuccaggaguuugcacaugaauguugcaauuuagaaaaucauuccaccgaaaucucaaaggugaagucagcauguugcagcacccuuaccuagagcaaaagcauggcuuggcaucacacuguaagccagccccaggccacagggucucagccauguuucucaugucuagggugagcccggagagccaggaccaaaaggaggaaucgggaaccggggcccucguggggagacgguaaggucacagcgcgcuuggggucaggcugucgcugacucuuugcuggaaggugcaggaagccaggagaggguuccaaauaaagaugagccuugcuucuuguauuauuggggauacggcuggaaauacugaaacuugcucaucugcggcaaauuaauuuaacaaguuuuauuuuauuggcagggguagagagguggggcgggccguggggagagacauuuuuuccccuguguuuuuccugauacaagagaauguagaggcuaaugaagcuuaaacuaccuucaucuuaggucccgcaaaugcuuugcaagcauaacuagaugaagcuuuucugcaaagaaguaaaugucauuuggguuaaaauggaauuggauuugauuaggucucaguccagauggaaacaauuucuuuugaaugagacaucuuaggaauagaaauuauuaccucaguaacucguuuuuuaaaugcuauuuaaaaaugccccaaaaacucaccaacaauaauuuugugauguacauuucuacguuacaaaagaauaaagaaaucuacgguccauugugacuuuuuccaaaaggagucauggcaccuaacacuguauaaaaggaccagguugaucugacuguuuuaauuccaagcaucaaaauauuuuucugucuuucauuuuugucuuuucaacuaacugaaguuuaaaaacgaaucuguuuguauuacuuuuaaucucagaagcacagggaaaaaaucagacuucaaaccauugaaggaaaucucuuccugauucuguuucuaguaauuugggucaacagaucucuaguuguugauaucuguugaaaacuguaaauuaacuaaguggcaauuccuacauauguuagagauaguaauguacaauucacacacguucuucugauucuucugauucauaauuaaugacguccaguucugaaugcuccucaugagagagcaacaggaacagaucugagcaugcuggggggagguguuggaaaggagggggucuaggggugaugacuuggaaggaagggaagggauauggggagggggaauaugaccugggccugagagauggaguucaguguuuugguuuugaaguagaaucaaagacuuacggaugcauagaaucaaaguaaccaucaagauuccugucaauucuaagauucuugggguugacgagucuuugauucuacauccaaacagaaucuuuaccaaaagcaaccagcaguucuuucuauguuaguccgccagugccauuuugcuacgggaguccuuugagcccaccgccuacagaaauggucuuguucacacuuggaagauaggacaggagcaggaagugugccuacuccuguaccuuagucugcaaacauuucaggagcucaaggauccacuucucaggggcagcggcagggcagagacggugguuauggugugccaggcauggcgaccuacagucacaucucuuucccacucuuagggagaugacgggagagacggaguuggcagugaaggacgcagaggcaaaaaaguacguaucugcugaggauuauccaagcguccuugcugccaggaggcuccaaggacaacuucugauguguuguguuuuaaaagaauuauuucuuuaaaaauugucuuuguauuugagugaguguuuucguuugaugacucagcagacauuucuuucuuucaaggucaauuuauuuuagaugaauuuaaauuagaaccaaguauuaaauaaucuauuuuuccuuuauagggagaaagaggauucccuggauacccaggaccaaagguaaauaaucccuggucggugaagcaucaucaugauuuugggauggcucugguauguccauggacugagaaucagaauaucuuggcauuagucuugggucagccacucaguuaacugggcuacccugagaaagacccuuccuucccuaaaauacucucucaucugucaaguggaggucauaauacguacuuguccugguguuuaugagauuuaaauaaaauaugcugcaaucaaaguacucuguaagcugugaaaugcuauaaccuacaugauaguaucauuacugauuaauuaaauuaagaccaucugcaaauaccacaaauauaguaguaacccacuggaaaagugaaucaaaacuaaccacuuggcugcccgggaaaagugugacccacacgucuccuggaugucuuaccccacggacccucagugagaucuucuguuccaaagcuuacugugccacuucucggcuuucuucccaggguaacccaggugaaccugggcuaaauggaacaacaggacccaaaggcaucagaggccgaaggguaaguuugcgugggccuuggcugcaggugaggaaugagaacguaugucucaaugugauuaacugcugaggcuuugacaauuauccuucacuugcacccuggccagggauagcacaggguggaaggaagggaauccugagccccagaccaauguccucagggugccaccauggcugugguccauggcucuccuccuguagguguauuccucuuccuccaacucaccuccagggucgccagcccagcucacuccaggcacagcacccaccugcagucucgaaucucauuaugggugacugggaagucugugcagucacuuugggccaugcccacccagacggccaggcaaugggagugaaugaggcauggcaacugcuucugaagccucuaggcuugcaagcgagccaggccaaggccaugggcuccucagacuacuggugcugagauuccucuuccuuaagcuacuuuuagcccugauagcucuuuucuuuuuauucuuugugugugugugugugugacaaggucucacucuguugccaaggucucagucugucaucugggcggagugcaguggugccaucuuggcucacugcaaccuccaucuccugggaucaagcgauccucccaccucagccucccaaagugcugggauuacaugcaugagacaccacaccuggccagauuauucuucaauggauguuuacucacccucuuaaaauggcagagucuucaauuagcaaauuguggccuagaucuguguaaagguugcuaacaguuauuuucagccugaaauguaguuuaaaaagaaacauaauuaucuuauuaauuugaucagugaagacagucaaacuagaucauuuaauaucccaaagagcuuuaaaacauuggaugauuaucuacacugaacgcauuagcuaauucacugucuguuaccuauucuccugggaguccuuaguaaucauauuagugguucuugggaaagcaccugucuuaccuuagccuggcagagaacacaauauacaacaccucuauaguuggugggggacucccauuggcuuuguugagguugcuugucccuaaacuugaauuuaagagacauuuuagcucccuuaaagugagagauuuuucguggugauggagucccuuggguuagaucacuuuuaccguaccuuccaacuauaggagccuuaaauucuccacuuucugacacaguugaacaauguuuguucugcucccucuagggaaauucgggaccuccagggauaguuggacagaagggagacccuggcuacccaggaccagcuguaaguauuuauccaguucugacccggccaccuggggcugggugcuuuacacguggucccugaaaacuucccaccaucugcuuugcucacaagaaaaugugcucucuuuguauuugcuugguugucaaaccgccucucugacaucaugaugcagcaaagagauuuugaauuuuagaguaacaagaaacuuuaaaaaaauagguuucaugggauauccugucaucuagggaguauuguaauuugccuuuauaguuuccuggcauaggugcauuugagguuuguguagaggagaaaccaaagaggggaaaucuaaauaccuuuugcuugcaucuuguagaagcaguguaauuaugccaggccuugguuugacaaugcuuccuguggucuaugaaauccccaagggagcuccugauuugugguuaaaucccacuagucaugcugccaccaggagccaggagggcauccucccacagcccuuccaaaccucuuuauugcuaauaccuuuguuuucuuauuugaauuucuccauauauugucccucaauauugaaauuggugaguuucaaaaaauaauggaaaagauaauucaggaguuggaaaaucauuccuagaaggaaagguucagggcuuaguuugguugaauuagggaaaagaaagcuggucaggugggucugauugcugucuuuaaguaggugaaguguuggggggagcacauuaagccaguuccugcagaagaccaagcaggcagaaauagccuccuggaaagacaacuaauggcccaugagaugccugcugggcugucaggguggugagguuuaggcaugggacacugagggaagccacgagucagucccuagagcuccucgggguggaauucagcugggaugcuuuagacacggagggagccagggcagcucaaugaucucucacugccccuucggcaggggacagcguaucaagcgugugaaagggagcucuuuucucaagagaagcagaaucuagacccagguucacucgugggcuuuacauggauugguggugagcuuccugguuucagaacaugagacuauuucaaaggccaaaugaccucccagggaaacacauuugcuccagaaucuucucuuuuuugcuuugcaagggauaagaucagguuuagagggagaggcuguaaacaaucaagguuauccaggggccccuuugucuugcucuguguauuucugggggccaaagccuguuuauucgaauuccccaucugcugugccucucaccuuucguuccuugguuuuacagggucccaagggcaacaggggcgacuccaucgauguaaguugcauguguccagaaugacucauuaaccucaugagccuuugauuugcucucuuuacauauucuuuuauuuucuuuuaaagcaaugugcccucauccaaagcaucaaagauaaaugccguaaguacaugauuuucuguugucucacaaugcauauuuuuacauucgaaauucucacaugguagaguagucucucacccuuucuucucuuugcuucuuuucuagcuugcuguuacgguaaguugauuuuggugacuuucuccuaaggaaaggaagccucccuuuuguaguaaguacaguuugucuuuaacccuccacccucuacuuuccacagggccccuggagugccccgucuucccaacagaacuagccuuugcuuuagacaccucugagggagucaaccaagacacuuucggccggaugcgagauguggucuugaguauugugaaugaccugaccauugcugagagcaacugcccacggggggcccggguggcuguggucaccuacaacaacgaggugaccacggagauccgguuugcugacuccaagaggaagucgguccuccuggacaagauuaagaaccuucagguggcucugacauccaaacagcagagucuggagacugccaugucguuuguggccaggaacacauuuaagcgugugaggaacggauuccuaaugaggaaaguggcuguuuucuucagcaacacacccacaagagcauccccacagcucagagaggcugugcucaagcucucagaugcggggaucacccccuuguuccuuacaaggcaggaagaccggcagcucaucaacgcuuugcaggucugugcucugugcgugcuguuggcaucucccuuucuucuggggcucugagaagguucucagacacguccaugcuccuuuguggcuucaugucccauagcuccuaaaacguccccaaugaggccaucugccugagaacuucucuugugaggucuccaggacaaccucguggcuccagcacuacagggacgccuacaugcuuguagcacugcccccaggucccuccucacauguugacagcucuugccgguuagugaugcuaguguuggugacacucucuaucuacuaacaagguggugugacuuguuugcuuuauucaugaggaccuggacguuugcauccuuccugucuccucccaagauggcccccugugcacacucugagcugugucuuacuguguacugggcauuugcuucccauaacuggcuggugagguuuguaucaucagucucaccucauggauaggaagauccugcuguuagugaggugcucgugagaggcuaggacccuaguccauuagacucugaaacccaugugcugaugauacccauuccagucuccacucugucccaaucggcccugaaggugaauauccaggguggcccuggaggccuguagucucucagugagguccccaaaacuaugccgacucagcacccccaaucuacaccacaccacugugcaaagcuuucuucagugaggccccaagggucagcccacggagaggccaagugucgcuuguaauucuauuaaauaacugguuuaauuguguguuuuuuuuuuuuuuuuuuuuuuuuuuuuuuuuuuuuuuuuuuuuuuuuuuuuuuuuuuuuuugagacagagucuugcucugucacccaggcuggagugcaauggcgugaucucggcucacugcaaccuccaccuuccaguuuuaagugauucuccugcuucagccuccugaguagcugggauuacaggcacucgccaccaugccuggcuaauuuuuguauuuuucuuucuuuuuuuuuuuuuuaguagagacggggguuucaccauauuggucagacuggucucgaacuccugaccacgugaucugccugccucggccucccaaagugcugggguuacaggcguaagccaccgcacccagacaacuaguuuaauucuuacaucaauuaauauuuauucagugcaguucuggcgauacuguucaagacagaugggugauggguaggaaggaguccacccgggagucaggaggccuuggccugguuccacacuccccccacccauuuaaaguaaugugcacgccacuuagcgucccugcgucucagauuuuucaccuguaaauugagacuggggcaggaugauugcuaaugucuuuccuuccacauuggauauucuaugcuuuuaccacagccugugucggcgaaagacauugggucaucacugccauuccucagggcuuguucugccgaacacaggaugauuugugcauagagcgcugggcuugggaauucaguguugaaguugggcuaccggccaugugcucuugauggggggauucauucacauaagucuguccuugugugggcugagggacccagaaccacgugaguuucuuagcaugguuucaacgagaucaaaaaauuguucauucauuaauuauuugcucauucauucauucaaacuagcuauuuguuaaaugaauaauuacuaaucgugugccagguacggcgauagacaggacucuuugcacccacugggagugauuuuguuacuugcuuuaaccacaccugagaggguggggaagggauggagcucccauauuguugcuaaaaauaacgauaagauuaaguuccuacuauuugccagaggauacaccaguuacuaacauuuauuaucuaauuuaacccuccaaaugacaccauuaggaagguauuaccccccauuuuacagcugaaaaaaacugaaacccauuugaacgggauaugaacuccagcucacccuaguagaauaaaaccuaugucuuucuauuauacucagagccuaaccccacccccaaaugagaagauauucccaauacugcccuauugggaaguuaaucuauuuuauugauguagcuuugauuuacuccucugccauauuuucagauauuacugaucauguacgccccuaccaaaauuguucuuuuguuuaaaccagaucaauaacacagcaguggggcaugcgcuuguccugccugcagggagagaccucacagacuuccuggagaauguccucacgugucauguuugcuuggguaagcuguuucucuaacaggaagaucugcucagcugcaauugcaaaacauaauauccaugggagagugagagaauaaugaugaucuguaaaaagagcuugaguucaauugauucacaaagccucguauuuaccagaguaaauacuacugcagcaguuucuauauuaaaaauggaccucccaaaacagagcuucucuuugauggcggauaauucauuuuauagguaacaaaggaggaggcaguuucugcuuaaguuuugacauuagaaucuagaaugaaaacauuggcacuagugacuuucuagaacauauuucuucaaagaguggcagagaaguaauauaauuuuucauuucuuuuaaaaaugccagcacaugguaugcuacaaagauuuuagguuagugauuuguuucaucuacuaaguauuaggugauagaaacugaaaucuggccauaaucaaaucaaggcaagauauaaauugguuuugguugugauguuuuuuuuuuuuuuuuuuuuuuuuuuuuagacagagucuugcucuuguugcccaggcuggagugcaguggcacaaucuuggcucacugcaaccucugcuuccuggguucaagcgauucuccugccucagccuccagaguagccuagauuacaggcaugcgccaucaggcccagcuaauuuuuguauuuuuaguagagacaggguuucaccauguuggccaggaugaucucgaucucuugaccucgugauccaccugccucggccucccaaagugcugggauuacaggcgugagccaccgcuuccggcccgcuuuugaucuuaugugaucauuuuaaucgcccaagucucccagcagauugaugagcuguguauccugcugugggugucacagaacaaauaggcugccaugcuucuuucuagacaucugcaacaucgacccauccuguggauuuggcaguuggaggccuuccuucagggacaggagagcggcagggagcgauguggacaucgacauggcuuucaucuuagacagcgcugagaccaccacccuguuccaguucaaugagaugaagaaguacauagcguaccuggucagacaacuggacaugagcccagaucccaaggccucccagcacuucgccagaguggcaguugugcagcacgcgcccucugaguccguggacaaugccagcaugccaccugugaagguggaauucucccugacugacuauggcuccaaggagaagcugguggacuuccucagcaggggaaugacacaguugcagggaaccagggccuuaggcagugccauugaauacaccauagagaaugucuuugaaagugccccaaacccacgggaccugaaaauugugguccugaugcugacgggcgaggugccggagcagcagcuggaggaggcccagagagucauccugcaggccaaaugcaagggcuacuucuucgugguccugggcauuggcaggaaggugaacaucaaggagguauacaccuucgccagugagccaaacgacgucuucuucaaauuaguggacaaguccaccgagcucaacgaggagccuuugaugcgcuucgggaggcuguugccauccuucgucagcaguaaguccugcguggcacagcaugugcccuggccuggcuuuaugcucgggccaggagaaguguaggaacagucauggaaaagacaaccgauguguugacaggaacuguuucauucauugaacagacauauauugacaccugccauaugccacaaaugcuuuuaggagccagaguaagcagggaacaugcagacaguauccuuguucucauugauuccuuuauuccaccacauuugaccaagcgccaccuagucauaaggcacucuugguguccuuaacaguuuacaaaugggugggcaaauggaucaaaugcacauuuauuacgcaugacauaauaggcuggcaugucgcgagagaagugauuucuguuaggggcaccggggaaagcuucuagaaagaguugcuuugaucggggcuuagccaccagccccgugcuuggauaccacugggucuuugcucauggggcucccccucccuggaaugcucuccaccgcacuucagcagcaaacccauauucaucuucaaaguucaauuccaauggcuucugcucgccguggaagcugcugcucccaaggccugcucaugguuaauccggacacccuauuuagggcaucuauuaccuggccuguugaucauuuauuugugggucugugguccccuagacugcucuuugaggaggugcagccuauuauaguuuccagagccuguguacagugugcagcccagggucaguacaggcaaggcuuggaacagaugagggggauuuauaaaguauaaauaaacauguauaugcuaaauguuuauuauuuaaggcaauguugaggucuaugaaaacaguauucacauuugugaaggucuggcccccaaaagauucaaagaaaaaugugaagcaaagguaaucccccagguucacccacaggucacuguuccugucuuccaaagauuaaaaacaaaagcuuuguucaacaaagcauugagaaaaucugaaaagcaguugcauuauaaucugauguccaagagucuagaacuuguugaacucuccacuugauuuuucuucuaucccugucuucucucucauguuggauaaauauaucuuuaacuuaaucacccaaauauugccaaauagaacauauuggcuuaccauguuuuauggauccaaugccaucauacuuuauguuuaaaaucacuggacauaguuugucugauauaguuaauucaacaauaauuaugggcuaaauaaauguuaugugauucauuuaacuuguugacagauuaauuuuaauuuucauguuauuagcaugcgguucaauuguuuucuuuguuuuuuuucuuuaggugaaaaugcuuuuuacuuguccccagauaucaggaaacagugugauugguuccaaggggaccaacccacaaagaaccuugugaaguuuggucacaaacaaguguaagugauuauaauuauugucuuaaaaauuguagcgcugcagggaaugcacagguccuccaaccaccuccugacuuuaugggaugaggaccuugaaauccagaaaaugugacuucccaaagguaaugugggucaugcuucucaaauaaucuguuuuaucaguuagcuuuugccauguaacaagcuacccaaaacuuaguggcuuaaaacaacaaccaccuauuuauuuucuuacuuaauuuauuuagagacagagucuugcuguguugcccaggcuggacugcaguugugcaaucuuggcucacuguaaccucugccuccuggauucaagcaauucucaugcuucagccucccgaguagcugggacuacaggugcaugcagccaugccuggcuaauuuuuguauuuuuuuuucaguagagaugggguuucgccauguuguccagccuugucuagaacuccugaacucaaaugaucugccugccucagccucccaaagugcugggauuauaagcaugagccacugggccuggccaacaaccacuuauuuaauuugcaauucuguggguuagcaauuuuuguuugggcucaacugggugguucuucuguuuucuccuuggaucccuuauguuuguggucagcugcuugucagcuauagagcugcuggucuagaguggucucagaugggcuggcucaucucugcuccauguggucucucauucucagcaggcuagcuuggguuuguucaccaggugaccuggcaggguucccugagagaagacaagugugcaaggccucuugugaccuagguuagaacuggcacacuguuacuucugccacguucuauugaccaaagcauguccaaaggcuaaccuagauuuaagaauggaaaacuaggcuugauggaaggacuugccacauuacauugaaagggcaugggcagagagaagguagauaauugagaccauaguuccaaacaauuuaccguaucuggugugaaaugauuacguaaaagaaggauuggauacaucaaaaaauagacuccaugucuucuuaaaauuauuaaugcugugauaacauguaaugaugguaauaauaggaagucaugugcauguucuaugaagacugacgggaggggugggagugggcaggacuguggcacccaugccgaugcugcugccuggcccaugugccguguuucaugcccugcuccaucucgggugccaacccuaggagcaaagagggcagugggggcauguaacagagggcuagcuggggugauguggcugcaagaacugagccccugcagcgugucagcaaugugugcuccuuaagagaaugucacagugugucaugcuuuggagggaagugcagauucugcagauucugaacuucguacacagaugagaugugaacgcaaaugauccuugaaaaaugacuaucuggcuuacgacuagcugacucucaagauggggaaagagagcccaucucuuccuacugcagacccuucugucuaucaccacuuaaguccuucagcucuuucuuuugaccucagaaggaguggcuuuaaaucucagcauagcaagaaugaauaucauugcuaaggccacuaggacccuuaucguggcacuggaugcuucauuuagcuuuguagccuccauuuuucuaggcucuaaugauucguauuuuuucucugaaaccuucccugaaauuggcucaaccuuuuuaucuuuaggaaaacagaaugaaugaaguaaccuaguauuugaagucuuaugauauuaacuugaaaauauauuaauacuuccuaggacaaguagcaagauaugacuauaaaauaauauauuuucuucuaagaucaagaaagcuaugaaguguggguccuuguuguuaugucuguuugauuaggcugcuauucucucuagauauugguaauagaucaagaaauuguaaaaaaaaauacacauacacaaaaauuaagagaaauaaaaaauauauauacucccaguaauaagcccugggagcaaaauaguacaugcuaacuuuauaauuuuccagcucaacauagcauuugauugaguggauauuuucuuauaauguaaguagcuaacuacugauuucauuuaauuuuugguguauguuuugguugguuaauugcuauaaugagaacauuguuggauauuauucauuauugucucuuauuuucucucugccuuuauuuuagaaauugaaagauguuuuuguagaacaauauaagcuucauuuuuaaugguucuauuuuucaauaugcuguuccauaucuuuuuuuagggaggcacagauccuuaaaagaaggaauuuaauauaugcacugcuauacauaaucuauaaaaacuauugcaugcauuuugcuaaaacaaauuuaauguagcucaugggguuaugucuuuauuuauuuuagauagcagguaaaaguagagguaauauuuaauuugucuuaacagaaauguuccgaauaacguuacuucaaguccuacauccaacccagugacgacaacgaagccggugacuacgacgaagccggugaccaccacaacaaagccuguaaccaccacaacaaagccugugacuauuauaaaucagccaucugugaagccagccgcugcaaagccggccccugcgaaaccuguggcugccaagccuguggccacaaagauggccacuguuagacccccaguggcggugaagccagcaacggcagcgaagccuguagcagcaaagccagcagcuguaagaccccccgcugcugcugcugcaaaaccaguggcgaccaagccugaggucccuaggccacaggcagccaaaccagcugccaccaagccagccaccacuaagcccauggguaagaaagcccuugcuagggcugccaucuugugacauccucauuuccugcuccaggguguguuccucaaagccugcauguaacacacucagaauacaguccuugaucugggcuuguacaccuggaugauguauuuuaagagguguugguuagggauuccagccucccacuccccauccugugcccucaauccugucuugcgauagggaugggaagcucucauucucucuggaaugucagugggggcacaguucaccucaccugaaaauugaguugucuuaaacuaaagggaaaaguuuccguguugaaauaagguuuuagcuccuauuuagggagugagagagacagaaagaaaaacgcugcaguugguucuuaggcagcaaggcagauguuucugggcugguguauggagccggacucgccuaccuuagaacaugccuugaaaaggucugggggagcccuuugcaacugcaaacuuugucucugccucauacccacagaaaaggggcccuaagcugugugcuguggcaauacuggguguucaguccagcagcuugaaaagucagagccuggaccaucagucauuccccaaggcucaaaucuaugcucaugcugaccaugagaaaaauauugaaagcaauggcaaaaaccacaaugacucugcaccaacuuaauauauuucagacugaauuagauacaaaagguagauggcuuuaaugagaccaagaguauguuauuuuaucauuuuccuaaagaagauacuggaagacacuaccgaaugucacaagcuguaaaggaaggcucaugauaaaauggaaauuaucuucauuugaugaacaguaugagagagaaagcagaauuccuuuaaaagaauuucaugucauacccuaaaauuuuaugacuuaauauauuuuaaauuauggggcucauuuuguagcaaacacaacuuaggauuaguaugcugcauuuccaaaguaucuucuuaacaggcgagauuuuuaauagaaaaaaaaguugaugaauaaugagauuuuucauuacugugaauuucacauuucauguaugcugauagauuauaagagcaauguuuuuuaggggcuugaacaagaaauuaguuccccgccucagcuaaauuucaagucaauuugucuguuaacacaucccuuucagauuuccucucucgcucaugcacuacagucauggaggauuuuauuuuuuaucuucacgcucugaucuaucuuucaguuaagaugucccgugaaguccagguguuugagauaacagagaacagcgccaaacuccacugggagagggcugagccccccgguccuuauuuuuaugaccucaccgucaccucagcccaugaucagucccugguucugaagcagaaccucacggucacggaccgcgucauuggaggccugcucgcugggcagacauaccauguggcuguggucugcuaccugaggucucaggucagagccaccuaccacggaaguuucaguacaaguaaguacaugaucaguacaagucgguaccugauuucuauguagaguaucaaauaggacacaaaggagacacuuacuuauugaaucuauucugaaauaaccacaaauucaaaaaacaacaacagcaacaacaacaaaacaacucagccugggugcuuugguggcagccuaagcuuauaaaacacagaauggaaaugggauuccaugugggaugcaguccugcccucuggguccugggcuacuuuuuggaggaagccagauccacgucgccugagcacagcccuuuccaacauugcacccgggaaagauggccacgucucccggugagggcuccugguugcccaccaccccguccagguuuccauguucaggaaaacaccagccagucacuggcuccuuagggaguaauggaggugucccugaagucucaccgccccggggguggaggaugucgauagcugagucucccugcccugaucucaccauaguugggcucugcccuuggcuggcuguuguccccaggggcccccccauuucacugaggccugcacuugagugcugucacagcuuuucuuaauuauucaugguccccucucucaucuuucuaaauucuucuggguuccccccucccauucuucuugacccccacugcuccaggaaugugaagggaaggcuccucuuuucuucaggccaaugcuauucagaucaaggaaccagcuugaggaaagggaauucccaccagugccauggauuaggcccauagagauaugaguccaaagacccagucaacccuagggcucuauuuuccuggacagcagcagaagaggcugucugggaagugagaggauuuguucagaaguucagggauccccucccgucgcuuauuagcucauggauccaacuuguagcccacagcauaagucguggauguagaggugucuuggaucugugucuuucaaucaccacuccccaacauaagacauuaaucacagcaggcaaccuuauaucagucacuaaggauucccaagcccuccuguuucugauuuaccuacgaguugcauauauuuuucuuuuauagagaaaucucagcccccaccuccacagccagcaaggucagcuucuaguucaaccaucaaucuaauggugagcacagaaccauuggcucucacugaaacaggugaguugugaaacuauuagguccauuaauggcacuaagaaaauacccaucuugauuccaauuuaacuuccuggguucuaagucuuagcccaggcaugacuucuaugggggaaaagguccacgucagcucugugcagcccaacaucaucuuauucugcauaaucccagguguaaauggagucuuacuuuaccugugaucagacucagugaaaauuugaugggaggugcuuuuggggcuaucacuagaauucacguauccauuagacauuucuccugugccucauacugggacucgaguugauuuguggucugugaugcugugaagauuggcguuucauuuacucagugauuuaaucuaauaaaaaaacugcuuagaagaacacaagacaaauuuggcuggaauccaugaaaugcauggguuuggaucugacccaugggguguucugguccggacauccuaagcacacaccccagcuuagugugugagucugugauacugucucucaugugcuugaaccccagagugugugcauagucuaugcuaaguuagugacugguuagguguaauucaggaacugacagcuguuacuugcuuuuguucuugggcagugaaacucugagagaccuggaaucucucauucagcagaauguggacuuggcuuguucaucggugagaaacugauuauuaaaauaguugauaggcuuugcuuaagaguguucagcaaagaaugaugguacuaacauaaaaaauggaaaugccaugggaauuuagauauaauacuguuuuauacaccugaagcaaaagcuuucugcuaacuaggggacaauucauuauuuuuugguguaucgucuacugucaggaggaggaaagcauuucucuucacaaugcucauuucuguaauugauuuuaaagguguuuguugagugagccuguuaggcgaccccaccauggugcuugagcucaaagagaagccacaaagaacacaguagauuuuccccaaaggugugggucaggacagauucaacucuaacuucaaaguugcugaaaucuguguaugucauuucucacucauugguuaacuucucccugaauacagugugggaaauagaaaaauuuuagccaauuuagugcuucauugagagaaaaagacuuggaguaaacuagagaucagagaucaauaaugaguaaacuagacagcaagauuuggggauguuuuugauucucuuaugugugguccaaaagggacaagauuguauaaacagugccuaauucauauaaacaacaaugucuuucagcaagggucuggcugggcuguuuuguuuuucuuuucauauauauauauauauauauauauauauauauauauauauauauauauguagagagagagagagagauggggggagagaguugugagguucagaauuaagaaggugcuuuugauccagaccuuuaacacugagaucgccugucuaccugugauaaagagaaaagagcuuuugaaauuggggcuuguguuucuuucaaggcugcaaguaguugauacagaugaaucuaaauaaaaccuuucuccuucauacuaauuggggcauaacccucagacccaggaugugaauguccucucaccauuucaugugugugugucuguguauguauguguguacacaugcauauguguguuuuccuucccagggugaagacauaaauuaccuuuuuuuuuuuuuaaaaaaagaacaaggcccugcauaauugaucucugaucucuuaaacuuaaugacuucauaguaacaaacaagcacuuaaccugccuuggccugaugaauauauguugguguacacacaguuauggcauuuuugagagcucuuuuugaauuacuagguuggugcgaaagcaauugcaguuuugccacugacaguaauggcaacaacuggaauuacuuucgcaccgaccuaauaaaugggacauuuacuuaaaaaugucuaaaauucaaaauggauaaccagaauuaggagaggaauccuuauccuccccaccccuaccaaccucucucccuccccuccucaccuucuccuauaauugucauuuuaacuauuuccccugggguggggggaaaauuuuuuaaugguuuuuauauauuuggauauaggaaaaggagugacaaugaaccacucuuuauuaaauaacuaaaaaaagauaauaacugcaugcuuacucaguaguugcauguauauuuugcauccaaauuccaaugaccacgauaugcauuauuucuccaaauauacauuuucuagaccauucaggcaaaaugaaguuuuaaaaauauauuuuuuauauuuacauguguccauuuucauuccucuuacuuucugcagcauccauuaauuagaaacauguuuacagagaugggucccuuucuuaguauuaaauaguagaugcuacuguuugcuuuuuuacuucugugaauaaaagaugcugucuuaagaaucuguauuuuucauaguuuaucauguuagauucugggaaccuggugaccuguguuugaaucugugaaggaauuuguagguagaaacacucugaaaugaaaagguuccuaguccugggcaccuaaggcaggggaagaggagaggaccaguguuaccauugguuuucguuugcauauguuaauguuugcccauuuugacagucacauugaauagaugcuuguuuaucaggaaugugagucaggcauguaaugcgagggcagucugguuggggcauuuuuuguccuccauaagaucuggcccuguuugguauguggcagggagacucucgccuuugagaugaagguugauucuguuaacaggccuugauuccauuaauauaccuagggcaucguuagcaaccacucaggauuccagcuuuacaauauuacaugauuugauuuucagugguuaauauuuguauuuuuuuaaauaaaaccaaaugaacccccacaaaaacaucucacuccacuuuuugcuuugcucggcaucuaaaagaauuaugcuccagccacuuuucugucacacaucugcugccuguaaauggcagugagcagcaguggaucuuucauucguuaccguggccuccugaaagcaugggugugcugggccuuucugccaccugcuuugucgcugcugauuuugacagugcuacguaguugcuaauuuugguuucaggcuuuuguuaccaccucccucuucucccuucucauuuuuagcuaaggaagcuuuggauagauauuuucuaugcauauuacuauuaaagcuaagacugucuagaauuucuaaacaacaacaacaacaacaaaaaucuaacuuaaaauuuacuuuuugcaguauugcaaaaugaauccuaaauuauuggcuuaaucaccuguguuaaagaaguuucaaugcagaaacuagacaaaacaacuaacaaaaucaccauguccuuuauuauuuauucuugaaauuagcaaucuguagaacugaucacauuuuguccgaguagacaugacugggccaauuguauagcccugaaggaaccaucauuuuguguuuacuaacguuuuacuuauugauucuaagaugcacaauuuucuucucauugggacacuucugaaacugaaaugugacuuagaauugacaauauaucaugguuuauugguagcauuuuguguuacuuaguggaacauaaaauaauggugcaucauaaaauuaagagcucuuauauuggauacaauacaguauuugguuggccauguuccaugugaauauauaucaucaauuagcauaaaaugguauauuugggggaaauaccugacuuuauguuaauaauaauuuaaagaacaaacuaaucccacagcugaaguaaguuaaauagcuacagggauuuaggaaaugguccucuccaggcugucuguuguucaucgcugugugaggauguuuucugguuaguugucauguguggguuaugaugagcccaaaggaguguuuuuuaucuugaagucuuaaaaaauagaagucuguuggucaagaucugaaagaguaaaauuuaaccacagcuacauuuuaaaauaaaguuaaaaauuggccgggugugauggcucaugccuauaaucccugcacuuugggaggcugaggcaggaggaucacuugaggucaggaguucgagaccagccuggccaacauggugaaacccugucucuacuaaaaaugcaaaaauuagccaagcaugauggcucaugccuguaauccagcuacugaggaggcugaggcaggagagucacuugaaccugggaggcagagguugcagugagcugagaucauaccucuucauuccagccugggcaacagagugagacucaguaucuaaauaaguaaauaaauuaaguaaguuaaaaauuugguaaguuuccuugguacccuuugaacugaccaaugcucaaaauguagacggcggaaaguguuuucauucaggcaaaucauaccugcauccaagguauggaaguacuuuauacuguaacaacaaugccgagugagaaggugauugaauuuucuuguuuuggggaccauuaaacugaugaggaacauguugaugauugcagcauaaacaccucucagucugucuuccuucaguuugcucaaggaaguacuuacaucgugauuuggaaaucaauauguuugggaaaugucaaagcugaugccuuuaaaaaugcauugaaacacuaugggaauaucaaacuaugaaaaagacaagauuuuccaaucaauauguuuuccacuuugaagaauacauauauuuuuugcugauuauaaaguuaacagauaugcauugucaagcauucaggagguacagagaaauauauuacacgauucucauugugacagcauugcuggcuuuugaugaaaaccaauagugacccgaugcauagccuuccuauuuuuuucuaugaauauuauugcuugugggaaggugcaugcaucgcacaugcacauccacuccugcacaucauuauuacaaaaauggacuguggggcuuagggugccuugcgccccaguguuuuugaaugguuguuuuuaggauguucuagguaggcaccuguggcuucugggaacaggugggauucccagaacaggguuuuaaccuaacauugugcuugccuccauuuccucucuucuauuugguuacuuuccugaagcccagugaccaauaguaaggaaguuucagcagacaguggucugagucaggcagccuuuccccucucuguuuuccaagcaaacuuaguuacauugguauucuagguuaggaagccggggaagguuguggauaauuuucaguccccauugucuuuuaggcucccacuagguucucaauaauaaagaagagcaaauuaaggaagacucagccaugcgcuccucucacauaaagagaaggcucuagcuuccuacagguuauaccuggggggcagacugauuucagagggaaaagaugaacaacuauugcauccaaagacgugucguucuagggaaaaguccagguuaaguucaacgagggccagccaucucccuugguacuccaggacauuuaaauacuuuuuuuuuuuuuugcuuuaaaacaguugcuuuaacauaugcacucauagcugaguagaguccagccaaaacgacaugucucagaagucaagauuauguggaguuugcauuagaagccuucuuaagaacauaaaauccuccguuuucaugcuucagaaguagagaaguacagguuuuugucuuugaauagugccggguucucaccucacuaauauauuucucuugguuuuccaaauaucuucuuguccacaguaacaguguccuuauuuuccacuaguaaaucuuacagggucucaguagugacucucacugaaauaagggcagaaaacaccagugccgugguguggaacuggagggcuaggguggagggccaaggaagcuggagaagccaaucagacggggaguggagugugcugcugugaggccacucaugggcuggguguccguggcucugggcagaccucucgugacugguucagcagagcccaggggacugggaauugaacagcuaaacacagauggucaggacugaagugcacuugaaacaaauaaaauagagcaaauaggguccauuggccaacgcucugggaaggaaggaagaauagggagaucauuugacgccggccucacgcuaacagggaagccaccaguaaaugaggaauaaauuuugaugguuaaauuaccuugccuugucaguucucuccaggaccuuccuugacagccaggcauuuuccuucaguuauuggcauauuugagagaaagaagguuguuuuuguaaauugucuucauuuuauucugacuuccuggagucuucaaaggcucucguggggaccacuggcuuucugggcccugagagcgucugcaacuaggagguguuguaacuguggagccaccagccaccagccuggaauuugggugacagcagcaaccaggaaauguuuuagaccaauucugagccucaguccugugcaccuuugagucugguccaucgugggugauccaagcuaugauuauccacugaagacuuagguuuuccuuguccuuuuugguaucuaucugaagcacagaugcucaccaccuccgcagcugugagcagccugccucgcuggggacaaaggagauggagaagcaucucuuuguaggggagagcuggauaauuccagccuguuagcuacucacaggaacaugcagaauuauuggcuccagggaguuuuggagaaagaagguuuacguuuucaaacuuacagauaacaguugacaucaaugcuucucuuucccagaacaaucuggaguuugccagaaaacucuguaaacaggagucgugcugugugugaacuguaaacucuucucuccaggcgucgaggggaccuuugcuuuacuuugcagcugggcuacaucagacgugugcauuggaaacauaaacuuccuuaacugggaaaagaaugcuucucugucuucaaaauaguucugcuaugugacauuuuugccaucaugaauuuuacaucagugcuagcucuuuguuuuacguguuucauuuggcaggucacaaaggcucuuggcuaccacacauacgugcauacacacacacacacacacacacacacacucauaaaggauuuucuuuucugcuuuaccuuuaauuuucagucuacuuggcuuguaaugaaagguagagccuuauuuuugaacuauaucccaacagaaucgaauuuccauuuugccaagaauuauaaaacccugagguuuuaaaauucaguuucuuuucuggggauuuaacauggaaggacuuggagggcaaauggcccagugauuggaaaggggaaaaacaauucauuucauuuaaaauuauucaauaaccauugccagcauuugggauucugagugcuguuuaugaagcccuuucauugauauaauuucaucuaucucucacaaggcuguaagcaauuccuauguccauauggcagugaggaaauggagauuugagcagguuaagggaguuuucaccuggaagcucuucuuuuuuuuccuucugccacaguagggucaucagacugucagccccagcacugggagccgaguaacacgcauguucucauuaauauccuuuucucauguuuuuauuaaagauauaugcaaguugccgaaagacgaaggaacuugcagggauuucauauuaaaaugguacuaugauccaaacaccaaaagcugugcaagauucugguauggagguugugguggaaacgaaaacaaauuuggaucacagaaagaaugugaaaagguuugcgcuccugguaagugauucuuccuuguguuuauggcuucugcaaauaagagauucaggucaauaagucaccuugaaaaauauuagaagugcaaugauuaugauacaugugaaaaagaagauaaaguguauccucagauaaggaagacguucaaauacaacccaugaaaugucuuuuugaauuccuauuuuggguuucuaaaaacauauugucccuugucauucuucagaaauguuacuaaguugcuguuauuuguaaaauauugcaccaaaaaugauuccugggaagauaauauaaugaacaacuacagauaacgccaaagauaaacaacccccacaaauuuaucuuuuaaauaguuuugcuuccuauaaauaacaauguugucacuggggccauccaguaucuccauuauauugugcaguucaacugguaauaaaauaaacacuuugaacagagccuggggucagugccagaauggggagaguucaguucguauaaaggccugguagauggugcagggcaaaagaaugggaucagauuucccagacaucccugggccccggggccccaggccaagaacgucacagagggccuuugaugguacugaguagaaaagugggacaggugauggaaaccagaggcugcgggacugugucaugauaaugacagugcccuuuugggucaguaauguggcuuuuccucucuucucucggcuccucaccucaccccacccacccccucucucgacgcucagugcucgccaaacccggagucaucagugugaugggaaccuaagcguggguggccaacaucauauaccucuugaagaagaaggagucagccaucgccaacuugucucuguagaagcuccggguguagauucccuugcacuguaucauuucaugcuuugauuuacacucgaacucgggagggaacauccugcugcaugaccuaucaguauggugcuaaugugucuguggacccucgcucucugucuccaggcaguucucucgaauacuuugaauguuguguaacaguuagccacugcugguguuuaugugaacauuccuaucaauccaaauucccucuggaguuucauguuaugccuguugcaggcaaauguaaagucuagaaaauaaugcaaaugucacggcuacucuauauacuuuugcuugguucauuuuuuuucccuuuuaguuaagcaugacuuuagaugggaagccuguguaucguggagaaacaagagaccaacuuuuucauucccugcccccaauuucccagacuagauuucaagcuaauuuucuuuuucugaagccucuaacaaaugaucuaguucagaaggaagcaaaaucccuuaaucuaugugcaccguugggaccaaugccuuaauuaaagaauuuaaaaaaguuguaauagagaauauuuuuggcauuccucuaauguuguguguuuuuuuuuugugugugcuggagggaggggauuuaauuuuaauuuuaaaauguuuaggaaauuuauacaaagaaacuuuuuaauaaaguauauugaaaguuuccuggg

SEQ ID NO: 12806 - RNA, 615 nt, Homo sapiens
gaaggugcugagggccuggcuccugugccugcugaugcugggccuggcccugcggggagcugcaagucguacccaucggcacuccauggagauccgcagugagugccuggaccccugucagccucccuuaccccacccugccucaccccagaaccuagugcagccuggucgcucgagaaccuggcaggaacggggugcgcgggaggaaagggaagucagucuuggugcuuuuuugaacuccugcuucccaaagccagcccacgcccagaaauggccucgccagaaccucugggugccuguuccucggguggcucccagcauggccuggcgacugggcugagaggcccugccugugcacucugccccgcugccucugggagcacagcacacccuggggacacgugcccauggucugcuccagcucuuuccuuuccagccccugacaucaauccugccugguacgccagucgcgggaucaggccugugggccgcuucggucggaggagggcaacccugggggacguccccaagccuggccugcgaccccggcugaccugcuucccccuggaaggcggugcuaugucgucccaggauggcugacagccagcuugucaa

SEQ ID NO: 12807 - RNA, 12340 nt, Homo sapiens
uuuaagugaaauaauagauuuauucaaagagaaauaaaauguccuggguaaagcuucuguaauaauacuauuucugauacuguaucucugaaaaauggcuaacuagucaccuuaucaauacauuuaaggcaucaauaauagguaccacugaggacauacauugugaagaaagagaagaauaagucaaauacuaaaacauacuuaucaugacaacucaaggugacaugaauauuuaaugaaaauuuagaauauaacaacauaugacucucauucuguggacauaaaaggaaaaauacaguaauucauuuuacucauuacauuuuacaaaaucagcccaaugaagcaguauuuuuuaauaaaaacaguaauuuaauuucaaacaaauauauuaccauccuauuccuuuaucuuguauauauguaucuaauuggcaaaacauacuuuacugaaaucaguaacaauccaauccaugauacuucaauugcuucgaucaauaaacaucuuaaauuugaaacucauuuuucuuaugccauaagccugauuaucaguucuauaaaaacgcuacacccuauugcuuggcccauuaaguguaacuagucuucugcacaaggcuaaguggcuaagguacuuuugaacaaccacacacaauucaucaagcacacacacucacuccugcuccucucacacacggccaccagagcagcuccccuaguucucuuguuccucauagugagcauagccacuagcauagguccuuccuaaauucaaauuaguaaacaaaucugaugacucaguaucugaauccuuucugccuucaucuucuuccucuucaucauccucugcuucauacucauccuccuccucaucgugguagcugguaucaccauacuuaucagaugaaagguucuuccaauaagcaucauacccagaagcuccaucucccucuucaccuccagucugccugccaaauuucagggagcgugcuauagaagacagacaaguacaaggcauuuuguuaguuccaguucucuacauucucaucuuccucuauaaaauuucauggauuucauuggcugcuucaaucccaaaugaaaaaauaggucacauuuuccuaauuuuuucaccugagucuauauacaacaccauaaaaaauaaaaauuacaguguaauuucauuaaaucuagaaaacaaauuagaccaacagaccacuccaaagguauuaaggcauguuuaaaacaaaaauaccuuccguuuggccacugacaguuuauuuucaaaucacauaaaucacagaauacagcugauuucguaucaguacauuuuucuuaagacagcuauuuuacaaugcagaugcccuuaaaaacaaagccugucauuucuucugccuuaauagugacacaaaguucagugcagaagaucagcaaaaucaucagucucaccucaccaugcaacuacaucugugauuaaacaaagcagucagucacuuagaauuaugguuccauucugauauguuugguuaagagucaaacuucucuuuaacaaaauugcgagcugcauuacuauaagcaugcuuauuccuucacaaaaaaaguuacauaaaaaccauaaaauaauuuccuauaguagugcuauauuacauaaauaaacauaggugcucaaauaucacacaccuaagauagcuucagagugaauuugacuucuagguacuuaaaauuaccaccacuuuaauauuaaggaauuauagcuacucaacuauuuaacaaggaagacucaacaaaaauaaaaaaaaaucacucuuuaucuuaaauuucaguauuugcugucauuaacuaaggcaaauaccaaauaucaaaaugaauauuggucuauuuaaguaaaacugaaaaacuuuacccacauauuuuccuaagcuguaaaauuccacuugcuuaaaagaacacauucaucuuuucaaauaagaagaggcaauaagaaaaauagaccaaaaaaaaaaaagauaaacuuugucuaaguaugaaagcaaaaaucacuuccuuaguaucuuaagggccuuacuugacaugcuaagguccuuagucuccugaguuucaugcccacauuuaggacaaggaggcuguuuuccuuuuucuugcuuaaacacuuugcuccuuguaugaucaucacagaaacaagccuguauaggagaagcaaaauaaaguaaauaaauaaaaauguaaaaauauacaaaaagacaguauucaguguuuuaaagauauagcuuuauuaaggcagugagauuaacaauuuuguugggagcagucacacuucucauuucauuuucuuaacagaaaugguuuuugucaggacccuucugaacaaugaucuaacaaaaggcagacuauauugaguaugacauguaaguacauuuagcuguucacaaauauuucaguacucauaaggucccugaugaaaugaaauaauggugaacagccuauuuacucucacacaguguauggucuaacuagggauggagacagugaaaaggcaauuacaagacacuaagcacugaacgggaagugcagagggaagggcacuaaagcagacaugggauuugggaaaggcaucuuagagacacgaagucuuaauagccauaugaagaaugggagggcaauaggguaagccaagauggaaaaguauuccagacaaagaaaacacagauaaugccugaacaccauuugguaaaacuagaacagaguuggaagauaaauaagacauaggguuaggaauauaagaacuagagaaacgcuucugagaggaagggcauuggcugcaucuguuuaguaaucuuugacgaacgaaugcuagagacuaggccuaaggacacagaaaaauuuggaaaucuuuacccaaacucuucuaagcagguauauuuugacauuaauuaaaauagacucucaucaucuuggucagaauguucuccacuaaaaacacagagccaggauuccagagaaaugugcacuagccacagcucuacuaaaaggugacuggaugaccauuggaaagucauguaagcuuucucaacuucaauuccacagucucaaaaauaaaagaauuagacuacauaauuuuaaggucccuuauaaauuaauuauagcugcauauaagccaaggacugguggagggguauagagauuaaaaacaaaaucuaaaaagaaaaaaacgcauugguauaccuuacaacggagacaugagugcugaccaagccgauugcaugaaacaccugugggaaauagauuaauuuuaaaaucccguuauuugguucuuagaauuuucuuuugucuuuuaucaaaucacuaaaagcuugcaauggaauauagccuuauagacagcugccugucuuuuggguucaaaugcuauaaaacacacaaagcucccaugcugcaaauaaaauaauuaaauuuauuauuauacauucugcaaaaggcgacgaaaggcucaaaaaugcuauauacuucgagaugcucuuuuaaucugagaauuuuauauauaaauauugcaagaauuauauacacaugcauacacauugugugucuauguguguguaguauguauguuguauguauaucacagagaugacuuaucuacuuuaaauuuauaaauaaguauaauaauuaggauuucauaccagaacaagaaccaaauuaaaggaagagaauaccuggggaauuucggucuuuuuccuauaauaguaacuacuauuuaaaaagggcuuuuuaaaugccaaguaccacaugcuauuguuuuauauggugucucauuucaaugaaccuuccaagaaaaaaacuauguguaaagaugauacuauuacccagucagcaaugcuggcucucaacuggaaaauacgugagaauuuuguguauagguuaaauacaggugccuggcacccaccacggacuuaaaagauagaaucuccagggaugaggccuggacaucuacauuauuuuuaaaaccuccacagguauuuuugauauacaguccugucuaagaaucacuagaaccaacuagcagaaacaaacagggugguaucucuuacgggagggcauuuggaaaugggaaggaagggugagguuugguuuuuuauaauaauuugaagguaaaaaugacaugugguacucugaaccacgaaagguguaaguccugcaaugccugaucaaaucaagccuacaaaaugaaaaacuggcccaaccaauaugccacuggcaucccugcugaaaaauuuacaacuauauucugacuguucuguuuucuagaaacagaaaauaaagacugaguuaaauuacaguucaugagaagcaguauaaaaaaacuugauuccuuuuucauuaagauuaauaauuauacuauucagaaucuuggguauaaagaacaucuaauacuuaaaaacuuacauuuaaauguuucugccucuaaaaccuggcagcuggcuugaugcucaaauugaucaucuucacagagaaaguuauggcaaaaagaacaacugaauauucugccuccuauuggauuaaaaaaacacaaauguaauuaagauaaacuuuaauuuaaaaaaacucauaucuauaauacugcuuagaagagaugguaaguuacuuuggagauacaccaaaauuguucagccauuuuuauucugauaaaagcuaaaaugaaaacuguugaaguccuugaaacugaacugaaacugagaaaagggggcucuuacucuccacuagcuacccauauaacacucacaaugcucaaagagacuaccugcuccaccacaacuucccuccauguuuggguaaacaauacuagcauugacaauaacagacaguauagaucccuucucuaacuacacugauaaucaaaacaguaccaguaguuaggauugacaguauccugaaaaaaaucucaaaaacagcauucaaaauguuucaaagucaacauucaccuauaacaaagcucauuacuugugucuaaugacucaccauggucccacacgccucguucacauucaacacacucagcaucgguaagagggcaggcacaagcauguguacugagacauuuccuaccauggcaaacccaagcuucacagaagucacauauugcacccuguaaccaaggaacaagaauacauaaucauuaucaccugaccaccugcaaccauucuuuaaccacggcaaccaucaaaacuguauacauuuagcaauuuaucaacccucaaugauaguaggccgcuucauuuaaacauuuuacuacucacucuaagccaaaaauaaaaaggguucucugaaaaacaacuucuuaacagcuauccacaauauacaaaacucaguuacauaucaaaagaaaaaaagguaaacuguacacuuauccuaauauuauuuaauuaagccaaagagauggaaguauuuuccucaaaaugaauuuaauucaaauaaaguuugaaggaaccaacagcuuaagcuuucuugucuauaauaauuccuguaacuacacugaauuuuuaaauacuaccauuucugauuuuuaaaauaccuucuuaucuauauauuugcauagcuuuucuagaauuacugagaaauacgaaacuucugccagcuucuuuuuuucucuuaugacaacuuauguuuuaauaauaauuacauuucuuuguggaaaaaauuugaaguaaaauauauggaacuaaaauacaggguaagauucuccaauucuauaucaagaaaagacaauaacaauauguuucaauaaaacauugacaccuaccaaauauuaaaagcuagaaagaaucuuaagagaguaggaucagacaaucuuuccuuuauaaaggaaaagcauggggcccaagacuaaauccaagucccgaguuggauuacaggugaggugagauuuaaagccaggauuucagaaucucaauucaguauucuauuauucaaggcucugaaacaaauguaguaaacaacaaauaggaagaauguuuuuugacuugcaaaaauggguuaucaguauagcuagcaaaucaucaacuauaucucuuggaucagccaggguucuugcaaaaaagagaugguacucucaaacuagguaaucuagaagaguuuuaaagagauaauuugcagaggacagggaaguucuuaggacaaacaggagaggacuaccuggccauauagggagaacugugguccuuagagaaaggauaaaaccaaaccaggauaaccugguacggagugagaugaaggaauaaacacccagaucuuauucuccugcuauucucagggggaaucuggggaggcaaauagaagauauccagaaaaucacuuuucuagaauuuacaacuaaagauauaugacucuacuuaaauguuuucuuuauguaagaagaaauuauucacauucaaaaaacagugauuuuaaaaaaugaauuuggcugaacuuaagcuaccaaggaagacugaaaguguuuuugaauaaagauaacuugacaauccuauacuuaaaauaaagagcaauucacaagaugauaauucucgcuccuugcuucuauaauauaugcacauaugaaauauaucauaggucucccucauaauagaaguuuacauguucuuggaaauuuaccauaaauaaaauauuccauuugacauaaauauaguaucauuuuccucauagauuaaaauuugaacaaaauuuuauuugaacauaaaaucauacugcaauacaguaaaacugguuaacucauauuuagaaggaaaacauguuucaggaaaaagagcaaaauacaucacauaauccaguugguuuuauuauucaaaaagcugaauuuacuuuaaaaaauccuauauguaaugaagagguauguuaaauauauacacuuuuuugaaauguaaaguuuuaaagaacacuauuauccuagguucguuuggaacuaaguugcuuauuuaaccaaaggcuuaaacguugguuaagcagggcuuucgguacacuaaauacuguuuugugaagucugguuaagagauauuagaaagguaccacugaguauauacccaaaggauuauaaaucaugcugcuauaaagacaaaugcacacguauguuuauuguggcacuauucacaauagcaaagacuuggaaccaacccaaauguccaacaaugauagacuggauuaagaaaauguggcacauauacaccauggaauacuauacagccauaaaaaaugaugaguucauguccuuuguagagacacggaugaagcuggaauccaucauucuuagcaaacuaucgcaaggacaaaaaaccaaacaccgcauguucucacucauaggugggaacugaacaaugagaacacauggacacaggaaggggaacaucacacaccacaaaccggggacuguugugggguggggggaugggggagggauagcauuaggagauauaccuaaugcuaaaugacgaguuaaugggugcaccacaccaacauggcacauguauacauauguaacaaaccugcauguugugcacauguacccuaaaacuuaaaguauaauaauaauaauaaaauuuaaaaaaaaaaagguaccacugagaaaugaaauucuguuuagaucagcaugaaaaguuuccaugccuuguauguucccuaauaagaaagaaagaagcagcuagaaacaaguggguacuaagggaaaaucauacaaaaagcaugccacucauaauccagauaacuacagauugauugaaacaagggacaaagcaaugauauuuagaaaaaaauaaccacugaucagaaugacauuuucuuauccuugaaaacguacuagucuaagagauaauaagaagcuuaccaccauugcaaggccaguacuguauacaccagcaugcuuuaugacacagucugaagacuucaucaugcacuuuguuuucccuaaugaagaaaaacauuugcacuguuagucuugcaaaggaauacauaccaguacucacgaauuccuccuuuuauccagcccaaguuccugaggaaauaauuuaaaaacuaaugaaauugaaucaguauuuacugcuuacauaacuagaaagagaaaauggauauaacugagacuucauuacucgaaucagacuuuucagauuauacauuuacuaauaaaucuguaaaaugaacuauacaauauauaugcuaauuuguacuaaaucagaaauugcagguuaugcuuuguaaucuaaugaucauuuuaacaguuuaaaaacuuaucaaucuucagauuauucaaaacaauuuuuaaaggaaugcuuuuuauaacaaauuuuacauuuuauaauucacaauaaaaacugugguuugaaguuauuucuuuccacagaauaauaccucaaaccaaaccaaauaaugauuauguaacuuaucgaguuaauguaauuuuauccaaacauaaaaauuuacaacgaagcccccaguuaaacauuuucccaacaaaauuuugaaauagugcccaaauaagcacaauaaacaauacggugauacagcuacaaaucaccacacagccacuaaaccucugaucuagaagcaaauuaaauuaccaacucaaaacacuaucaggaaauuugcuuaucagauauuaugugagaguuaaugaugacauuaaucauccaucugagacuccacaaaauggaacacaaaagaaacaauuuuccguuaucuugauuuccuaaggaacaaaguuaguaggaaaugggaagagaaacuggaaaugagaggcagcagcuacccaacuguuccauguccaacacuaagaaucaguaaaugagaaauguauccaucuaacaacacuacaaaauuuaagcccagagacacugaaaauagggguaaguccuagcaagaacuuaccuauuaaucuuccacaaacucuguuuccucacucuacauucauuacuuuuugcaaaacaaggcuaugaaaacuaccauaugaguguuccauauaggccaguuuucucuuuuucauuaauuguggaauugaaaagaucuucuuugaaagcuagaacuacauuagaaauauucagggauauagcccuaaacacuacuaacuuucuggaauauuauuacauauaaacacacuuaaaugagcauaccccaaauuguucuaccugaaauuauuauuauuaucucauaaauaaaagcaauacuuguucaucaaaaguuggggggggauguaaaucuagaguaauaaaguuaauuggguuucuuuguugcaagucuucagaacuucuaacauauaaauauauaauagaaaucucccagaugagaaugaaaggaggaugcaugcaguauuucucaaauguauaucgauauauauuuuucaagaaauauccauuaauauuucaggaagucuguggaagacuauuugggaaacacccaucuugcuaacauuuaguuuuauuuuguauaaucauuuugggguacaagucuccaccuauacuuaagaaccgggcacaugacuuaagaacucuauuuaaaucaccugggaauacaugugaggaaacucaugaaucauaugguaagcaucaaacacaaaaacuacugaucacaaaauaaguaccagguaaauguggaauaaaauuauucccaauggucuaacacacugcagguaauaucagcaggaaucaaaauguagauaaguaaacaaacagauacugacaagacuaagguaguauaacuaaaaguucaggaucaccaaauguuaugucugaaaucugaucuuucacuguuuaaaaacacuuauugguaaccuguaucuaaauuguaccuuaauuauuuuccagcauuacaucaaagagacaaaaccaaggcuugauaguuuuuugguaggcaaaauaacauguuuuguuauuuuguuaaugguaaggcauaauauuaucaacaauuguaagcacuguaaccaauagcaacaaacccacccaaguucaaauuguugaacuaccaguugauaaaaagcauauguccuuaauuauuacaaacuuaccacacugugcacaaauugguaacuucuguacagaauuacaaaaguagcaaaaugcucuauucuucugccgccuugucauguaaaauaaaauuuuaaauuauggucaaugucagauaaaaagucagagggacaauuuuauuaaagguagauagaaaaagaaauaaaauuuaccucugacacuugucacauuccuguaacauauaaaaauaucacauuaauuuuucugcugacugaaaacugcaaauuuacuuguauuacaaagaauaaccugcuuuucagguuaaaauuuaagugacacuacaccaaagccccaacuccacccauguauacaagcaccuacccaugcuuaaaauaacaaagguaugcgagagugauacuccggguauaugauucccugaagaaguggcauuaucacaaaggaggcuaaauacauugguaguuucuuuuucaauuguuuguaaggaauaaaauaccacagaaugaacacaagaacuauccuuuugauaguuaaguacauucuaagccuuaugaaacguuaagcacauauuauuccaaaugaagugggugacccuuaaaauaaugcauuuaucuaaggcaccguuccaaagagaauacaaaauaauaaaguucacagaaaauccagauuccuaaacaugguuuuaaaagcucuccacaaucuggccccuaaucacuuuccaaaccuucuuggccuauucuuuuuagacucaagucacuaauggucagccauucuccaaauaugucuuauauucucucuucuccaugucuuuacuuauucgaacacuuuucccugaaaagugccuccuaccuguugaaaguucuggugaaaaucccaccucuucugugaaguguaccccuuccacacacagccaacuuuaucaccucuuaguccuaauaaauacauuguaccuuuauugaagcacuuccaaaaucuagcugucauuauauauauuuaggcaugccagucauucagaaccucucuucucuggaaaggacucuuaaacacagaagacagccucacugucacaucugcgcuauguaaucuguccucacccaaccaaccccaauaaauguuagcccugggacaggcacugggugaaguccagccuuucagaguucuuuccuucucugaggcacaauaugugaugugagacaugcaagcuaccuguaacuaugaaacccaacaaauggaguaagacaauaugaaaaaauggaacuaauaaggaauaagaaacaaaagcaaaagauagaacuacaaguuguuccagguuccaauuguccccgagucccagguauauccuuccccuucccagcaauaugaguuauuccauuauccauucaauaaacuauuuuucccuaagauuaauuuaaguuagauuucugucauuuauaaacaaacaaauccuaauauacaacauaacugagcuauaaacuucuggaaauagagaccauguaauucaucuauguaucacuacccacagugucugaaauaauaccuggcacagaguagaugcacaauaaacguuugcuaaacuaagcuacauuaaacaauucauguauguuugacaaaaggagaaggaaaaaauaggaacagugggaaaagaaaaacaaagaaaggaguggaaauagagagaaccggaauaacucuacagucaaugaaagagguaaugaugaccuaauuguuugcuuuuucgcauauuucaaaaagcauauuucaaaagcagccaccauucaaagcagcccagaaauuaucaggacuaacccacuuagcacagguagauaagguaauagaaugggaagccaacagauguuaaguaggaaguucagaaaagagaaaugaaagaauugcuaagaaaauaugaugaaaacccaauaagacuaaggcauuaaagaaacuggaagaugaaaguuucuauuaucuauucuuguccaauaucuaccuuuaucaccaacaguauguaaaguaauaugcuagguuuuauaauaauauaaaauccaacaacaaucacugccacucagugaaaucaacagacgugccagagauacuaaauucagcaacaaacuauaugcaaaaacacugucuucacuaaaauuuuauucagguauacgucagauaaaauaguauauaguuuuuccaacuaccaacugauaucaaaaaaagcugauaccauugaggcauuacauggauguuuagcuaaaucuauagugcuucuugaugcucuuaguuguuuuucacguucucggcgguucucagccuucuuccucgcaccagucuuuuuuuuaggcauuuuccccuauuuug

SEQ ID NO: 12808 - RNA, 34916 nt, Homo sapiens
uucauuuuucucaguguguuaugcagcaauuuauuaaaguauuuauugucuaauaaauacugccaaguggaauauauuuauauaacugacuucguggggugguucaaguacuuacuuaagaacuaugugacacaacaguuacaaaacaaaaggcagaccuuaagauccggaaucaauccuuuagcccagguucacuaaacuaagcacaguaaggaggaaccuggaaggugaaguggagauggccuccagccucuacgugggagggacucccuugaaggcugggagugaaccuuccugggaaacuagggucaagccucucgggaacagugggacauagggauguaugagucacagacaucagugugcaaacaccugguuugcuauaggaagauaguuaccaaaugaaugguucuauuuccugauucuggggugccagggcucuuuucuucaaugaggccacacuguacaaugucccaguccucaaacugaaauggguacuuggcucuuaaaacucccuggggaaggaaggggcagcaccaacacuucguucaguucuuacuuguggcuuuuacacaacagacccccaggaggcaucuaagguuuacaugaagccuuuaccacugagguccucgcagcauggauaccaauuccacucaaucaacugggugauaaaaccauguguguguguugggugggggccagggaacauuacaaaacagauucugaaaacgcaaauuuuuagaaucuuacaucauccugagccaaacauuuacacaaaaggauccaagagcugcuuuacuaaaaacuacuuacagucauaaugaugacguuuucuauauaaacaagugcuugaaaaguauuuuaaagcuuauucuucugagcuuauuauucuucaugcacucuuuucaugcuuuuaacaucuuuaacagaagugucccccuuugagguguuauugcaaagauuaaccucauuccagcacagggccaacuccccacaccuaccucacgugggaagcagaauuuccgggccaugcugagcagccggcugccugcuccaacaggaaggugcacaccuacacccagggaguccagauggaagccacugaaccgaguccuccacagacuccuuccaccagacugcagcucucaccaauggaaugagaauggcuaauucuguacuguuucuggcaggucugaugcaugaguaaccuugucuaugagucuauuuccuggcuaagccugagcucaugcuauguaacauuuugcaacacuauuuccauagggaaaacugaaaagagcuagaggguucccaaagcccuggucugggccuagccuugacuaaccagucauccccugggucucuucauugcaacaugccacuuccccaaccagggucaucaugacagugaaagcacagcaaaaugcccgugaacuacaaaacaucacacaaccagcagccugcaggccacuacgagccaguccaagaugccuauaaugguuuuaacaaggaaagacagcauauucaaaagcaaacacaaucucugaagggucaagaggugcucacaguauaauaacucaaaagacuaggaaaaaaaaagagaaaccuuuauuuacaaccaugggagucccacaggaguacacaaaacacacaaugugcacacacacaaaaugaaccuuuuaagucaauaccaugcgugcuccuggccgcgcgccaccccucagugcccuauccgcaccaccaucacagugacguugucggccgagccccgcugcaccgccuuguuggccagccuguugcaggcugcuucguagcgggcgucggcugcggacuucccuucccgggucuggaucuuuucauccuaccagaugagaaagggaaugagugaauggagugaccccgcacccugucacuuuccugagacaugacugccaggaagaagagcugcucuggucuccaucagggcuggcaggacaaacugaccagugagucaguaggcagaguucacacugaaaaagggcacaagggcugucccacaaugggaggaaauggggucucagaacuucuacuucucugaaaacuaagacacaauugggacaaccaccacccccgugugagauuucucaccucgagacaggacaagaugaaguucacggcuucuucugggguaaagaccuugaagagcccaucacaggccaacaaaaugaaccuacaacaccagggagaaauauaaacggguuuuaggcccaaccaaaaaauaaaaaauaaaaaaagggccuggagauggagauaaaauaaauauuuguccaacuauucaaaggcuaagguuuuuuuuuucuuuuuucuuuuuuuuuuuuuuuugagauggaguuucacucuuguugcccaggcuggagugcaaugacgcaaucuuggcucacugcaaccuccaccuucccaguuuaagcuguucuccugccucagccuccugaguagcugggauuacaggugcccggcaccacgcccggguaauuuuuuguauuuuuaguagagacaggguuucaccacguuggccaggcuggucucaaacuccuaaccucaggugauucaccugccucagccucccaaagugcugggauuacaggcaugagccacagcgccuggccaggcuaagauuuguuuaaacccacuuaauuucugagacaaagguuuaaacuacuuacaaguauuuguggauaggauguuauacaucaaaacugagacuauccuucucuucgccaauuaacagaauuauuaauuaccucaaacauuaggugcuguacuuucuuaggcaaacuccagaaaaaucacugaauaaaaacauggguguuaugguaaauauacaagaauuuauaacaccauaggccuuacaccacuuccagacauaaagcugagaaugagcccagccucggugaaacauccuugggcacacacugcacagcuuggggcugcauccaagaccgaggcccaagaaggggcagcugugcguguuccuguguuugaaaaccacaugcucucccuuucagaaucaaaccccccuagaccgucccuggaaucuuucugaacaccaauggauucaaugugacaguucuaguuuuccuggcauuggggguggggaauacgcauccccacagcuuugcgguauaagccacccuccuuuucucacuguaauaucugugggguuuuuuuguguuuuuuuuucuuuguuuuuuguugcugcugcugcuguuguuguugaggcggacuuucccucuuguugcccaggcuggagagcaauggcaugaucucgcucacuguaaccuccgccucccagguucaagugauucuccugccucagccuccugaguagcugggauuacaggcgcccaccaccacgccuggcuaauuuuuguauuuuugguagagaugagguuuugccauguuggccaggcuggccucaaacuccugaccacaggugauccaccugccuccgccucccaaaguguugggauuacaggcgugagccaccacacccagccuguuuuccucguuuaacuaggcuuucacucggccgcuacuugccgagccuaucguccaugcugagaacaccguggggccuaguccuggcaggcucccaccccuuccaguguccugagacucagacccucaauaaccaaucacacagacccaugacuacaacccaggaaggcgagcuaggaagcaaagcagaaggugcauccuucagaacaccagaggcggcggcugcuggagagaugauggaggaccccgcgguacgugagaacaugacaaacacacugaagaagauguggagaauggggcaguggcucaagacaaggccaagcaggcgagugccaaagcaaggcacgcgcucuucauccgcagcacuggggcgggacucagagcagcacucggaggcccacucgccacagugccacuagugucucuggccuccccucaucaacucagugcugugaauccugcuuccgggagcuuuccuugaccccuccugcuacugccuuaguucagcccuucaucaucaggccagggcugcugcaccgcugcucacaggccucccuagccccauaaugccaucuuuaaccaucaccuguugaggcccugcccucagccagcacggugccguacccuuaggcauggagaacaggagaugaacaggugaacugucucuuucucaaccgauccuggcucuguguaaaaaccuaugauucuccaccaaugaucaacuaaaguucaaacucuccagcauggggcugagggccggcccuucaggaucugcccccaaaguacccugcuaucacuuucccaccacucccuccgucccucaagcgccugucuggccaugcuuucacacugucacauuuuaaugccuuacuguguguucccucugccaggaagccccuucuccucucucugacagggauaaccccuuccccuacugccaaagaccccagcacacagcacaugccuaggacacacuggacugcagcugcccauccccaugugucccccccuaccacuguggaccccaccagagcagaaaccacauuuuguuuaucucugcacccccagggccuagcaccaugcacaccuucccuccaacaaaggcuugauagaaacuggaagugaggaagagaaauaaacccacaugcacacacaccugugccucuuauagggccuuuuaccugucauugggggucagcuggcagcgucugaugucgggcacagaggugacaccgcagcgcuuguacugcccguccccaauggagcgugacaccucuagcacgcccaaaacacgcccaucccuaaaaugagaggaaaaacauuucagacucuaccugacagauuauggguccacaguacuuagaaucucaccuuaaaagcagagaauggaagugugaaagauacagacuguggaauucacauuauuaaccacuacugacauuucuugaucucaaauaugcaggggugucuaggccauuaacugcugcccugggguagggacccugcccagcugcacaugggugggaacagcaccuccaguggcugccaagcagugcugcccagcuuaaccuucgacaggacucagcaguucucaucacacaccuaggucccaacuccagaaucggauuugacugacuggguaagggagccuggcaguguuuuguaucuuaaagcuccuugaguguuucccacaugcagccaggguuaacaauagcuagaacagagggauauuuugcauuucaaucuaauuagauuuggaaaaucccugaaaguggcuauuccuggauuguggagcacauguccuuugcaucaaguacagguacgguuuaauguuaauguaaaugacaguauccugcauagcaucauaguuucacccauucuauuuuaggugaggggauauggaggagauggggcagugaucuacaaaugggaagagacaucuaagggacaguccuauugccaaggaaaaaccauuuggggaagccuacugccccaaagaacaauucuggucuaggcugcagcacugucaccuuaggcagcugcaagcucucuccccuucaggcccuuguuuguaaaggcaaggcagagaaccauacucaacgugugagagagcacuccgcaaaugccacggcugcgcaugggcguuuaagaucaccacggggcucccaaaucauggaccaagcaaguucaggagaugcggugcagauggcugcacaugguaggaaaugcuuccugggcugcuguccuaaaggcagaauucagccuggcccuucucugggccccaguuacccucucaguggcucacaggucaguauccguaacaaacauguuuuuucuucuucaaagacuucugcugguaucugcaaaaagccuagcgaucuucuaggauacaaacuguuaaauagcaagaggaaacagugcacaggggaagagcugaggacugaagaugggugggggcaccuggccuuaagagugccacuucaggaagcagcucacaguguaaguacuaugaaaagccaacaaaguaccucucccaugaccaggugacugggugucugguguggcuuccggccaucccagucauaaauccauccuguuucaacaagauuaagauuacaaucaccacgucugcaauggcaggucccagaagaccaaguagcuaccagcaacuucugguacugcacaacacaguacagacaaugugaaacaaucucuaagucuaaagaaggacaauaugagcagcacaggaacugccaucucucauucucucuuuuuuuuuuuaagagacagggucucccucuguugcccaggcuggagggcaguggugcaaucacucgcugggcucaagugauccucccaccucagccuccugaguagcuagaacuacaggugucaccaaguccagguaaauaaaaaaaaaauuuuuuuuguacagaugggguguugcccaggcugguccuuaaacaauuagccucaagcaguccucccaccucagccucccaaagugcugagauuacaggcguaauguggccucauucuuguuuucaaaguuccauauacagaguaguaaucuuacauucacugaacugcuagaguaacaggagaaagcacaauggacagaaugacagaucccaggaaacgcguuugguaacgaugaggcaagcugcccuggcacuaugccuacacucaaugcgauguccuacguaggaugugcacauucaaauaccugucaguucaacaaaggccaaucacagagucccaucucugagaucgagcaucacacaaggguaaauccaugccaccucuguucuggaaacuuugguacaaguucaaaaggaucaccacugaugaagcugguugggacucagccccaccagccccacaggcuucguccuucccagucugcuuuauccauuucaccggaacucuuuuuuguuuuuaagagaaaagguccugcuauguugcccagacuggagugcaguggcuauucacagacaugguggcgcauuauagcuucaagcuccuggacucaaaugauccuccugccucagccuccaaguggcugggacuacaggcgcaugccaccaauacauacucuauccacauccauuucuuagaaagucugcgcuacucuagacacaauagaaagcugucuguuucacagcagguucuccccguugcccaguuuucaaaguucaaacaaacugcccaaaguucauucucuuuccccuucccucaguuucccccccacccucauaauuacaaugcuuagcaaguaguggcuuuuuuuuuuuuuuuugagacagagucucacucuauugcccaggcuggagugcaguggcaugaucucgacucacugcaaccucugccgccuggguucaagugauccuccugccucaaccucccgaguagcugggauuacaggugccugccaccgugccagcuaauuuuuuuauuuuuaguagagaugggguuucaccauccuggccaggcuggucuugaacuccugaccucgugauccacccgccuuggccccccaaagugcugggauuacaggcgugagccaccacgccuggccaaguaguggcauuuuaagucucagccuaccaagccaaucugccugucccuugguaccagcccucauuaggacuggccuccugcccuuacacacuuccaacuuuugcuuugugcugcuuuauuucucuucucuguuuucugccaaccagaaaacuguuuuccuacuguuggacaagcuguucaacagugucuucagaucuuagcuaguuuuguugauauuuucuguucuuucuccagagagagagagagagacugggugagacugagacauccuacuacuuguguguuuaaggcuaaucuggcugcuaaaggcagcuggaagcugcuuggucuucagcuccucuugcaugucaguaaaagcaagacacagcuggucucaauaaacagacuauccacaagugauguuugcaaaguuaagguugggagguggaagcuccaucuccugaccauccaaagacugguggaugccuaaauccaacauauuaauacaaugagugcuacagagauaaccaaagguacaaugcuagaacaguuacuuuugguuaucagaggccugcacuugaucaaguucuaggcacacaguacugacauuuaaauuuaaaugcuauauguaaacuucccaucuguucagcugccuuccuuguaaaauaaaaauaaaacuugucuuaaucuucucagaaaaauucacugcuacauagcuaccuucaauguaagaaaguagaaaaaaauaaugcacaaagauuuacauacuuuuguuaagaaauacuggaaagaaucaagaaauaggaugaaggggacagggaugaaagcaugacaucucuaaaugucuuuuuacucaauuuagauuuugaagcaugcaacagggaguuuuucauguuuuuuauugugguaaaauauacaugacauuuaccaucuuaaccauuuuuaaguguacaguucagcagcauuaaauauauucacacuguuguguuaucagcaccaccauccauccccaggacuuuuucuaccuucccagacugagauuguucccauuaaacacuaaccccacgauucauuccccagaauucauaccccacaccccccaauaaccaccauucuacuuucugugaacuugacugguaccuccuaugagugaaauucuaguguuugucuuuuugcaucuggcuucuuuuacuuagcauaaaguccucagguucauccauuuuguagcaugggucagaauuuccuuccuuuuugagguuaaauaauauucuguuauauagacaucucacguugcuuaucuauucaucugucaaugaacauuuggguugcuucccccuuuuccccauggugaauaaugcugcugugaacacagguaugcaaauaucuguucgugucccugcuuugaguucuuuuggguauauacgcagagguggaacugcagaucacaugcuaacucuguguuuaaugucugaggaacugccauacuguuuuccauaguggcuacaccauuucacauucccaccagccaugcacagggguucucauuuucucccuguaauuuauaaagggaaaaaagcccuuuauaaauuggauaaacugaaaacaauaaacugaauaaaaauaaauggaaaacuaauaauauuaauaaccaaaguggcaaaauaaccacaguaaaaacaguuauuucacuuuugcgcacagugccaacaguacugcuuuagugagguauaucuaaggacaagagaacagcaaggaacacaaacuaaaguuaggauauuuuuauuuuuugagacagggucucacucugucaacuaggcuggagugcaguggcacaaucauagcucacuguauccuagaacuccuagacucaagugacccuucugucucagccacccgaguggcugggaccacaggcgcacaccaccagaacuggcuccauggugccauuuuuauuuuuuguagagauaaggucucacugcguugcccaggcuucucucaaacuccugacguggagcgauccuccugccucagcuucccgaugcacuggaauuacaggugugagcccucugcuccccuaguagugauaauuuugauacuaugaaacuguuuuaacaaauaaauauacuguuguuaagaaccaagauuucuagcauuaagagaaacgagcuacaaauauuaaaccaaagaagagaaaacucuguaacguuaaauaugaguaagaaauagcacuccaagcuugcgauuuaaaauguguuguguuuccuagcuuugcaugucuugaguggacauagaacuaaugacacuccaacugaacugagcacccgagaacauggauuugggcuuuuuaaaaaaauuuauucccuacacugauguaaaucaauuauuauuauuuuuuuuuaagcaaaagucuugcucuguuacucaagcuugaaagcaaugguaugaucucugcucacuacaaccucugccucccaggcucaagcaauccucccaccucagccuccugaguaggaccacaagugugugccaccccaccuggcuaauuucucuuuuuuauuuuuugguauuucuuguagagaugggguuucaccacaguugccaaauuggucuugaacuccuaggcucaagagauucacccacuucagccucccgaagugcugggauuacagaugugagccacugcacccagccuggauuuuggcucuuaaacauuaauacacacauaugaaaaggacacaggaaccagccagcaggaguuuccacuggccauaucugaaaucaagugagcagcagaaaaccccaugacugugacuacaacacaaugaauagucaguuggcacacagugauucacaaaggaaggauggagggaaagaagcagaggagugaaaggaaaacacugauuuccacaacuauaggugacuaucuuccuuucaaauggauaaaggacagaaugaaacauugacccugcuuuuuuagaagaaucuaugauguucucuuauugaugauaagaaguuucuuuacagaaugcccgcuaauacaugugaaaagaaucacagaauauggaaaucaucuuugacaucccugaugaaauaaugauuuagggaugcuaagaccauuaggugaaaggcugacaggaaacagaauauucacaagguaccagugaaccuccccagauuaccugcugaugacgcaaggcaacaggagcauccggcugucaccaccggagccaagugcugggauuuggcaacuuaauuaagggucacauuaugugccuacugaagugaaggacuacugaguauacagcaucccccauaaaacauugcuaaaaacaucucaucugaaucuaaagaaggucuuacaccuaacuuccaguuuauaggaaauauacagaaauaacaccguaaaaaaauacgcagguucagaauauuggugacucuguacaacugcuggccuauaacaugguucaaagccugguaagaaaugagucucggcagggugcaguggcucacaccuguauucccugcacucugggaggccaaggcagaaggaucacuuagcucagccuggaaaacacagacagagacccugucucuaccaaaaaauaaaaaaauagccaggcacaguggcacaugccuguggucccagcuacuugggaggcugaggcuggaggaucgcuucaaccucagaggucaaggcugcggugagcugugaucgugccacugcacuccaggcaacagaucaagauucucucucucaaaaaaaaaaaagaaagaaagaaaaagaaaaagaaaaagaaaugccaaguccacggcagacauggaugcugacuagacccugguuugaaacaaagauacuuuggggauaacucgggaaauaaaaauauagacaggguauuagauaacuuaaccuaaggaaauauuauugucuuaggugugaaaauucucacuaauuaugucaagaacguccuuaucuucaggagaugcaugcuuaaguauuuaggcuguuaugucaucauaucugcaacuuuuaaacagcucagccugacacacaucuauacagacuaaacaugacacaauguucacugcuaguagauuuggaaauguuuuacuauugucaaguuucuucuguaugucugaaaaauuuaaugauaaaagcugagaguggggcagccagcccuggccucaggcaggagaacagaccacgacagggcucugcugcucaggggcagcgacccacgcugcuggucucuuagccucagcccuucucugagaugaaggagucacccaaaacccacacugucaaaugauuucucuaaggcauguaaacacuucucugaaucagguaaggacugggauauaggaagcaacugcaacacaacuggccuuacuuucagccaucggacugucaguauccaauuauuuucaaggaguucaggcaaaagcagaaugaauguaaaacuuacaagaaaggggagaagaggugaugcuuacgcucauguuagagucacauucucaggcaugacuguccacaguaguuaccaggacaguaguuacgguggcaaaaacugggccaacagcacugcuugaggccugaaaccaggccuauaaucccaucacugcucauguaaacugcagcgaccgugaaugaaacugcuucuuacuaauccaagagcuuuuugaacaaacgcuaaggguuccaacuacucuccagaaaccucccuguaccacugacuagauucagccuggagcaauaaaaaaggcuuccccaaaugaacaacagaagagaaacuacacuucaaaggauagguaagugcagucuuauacuaagagaugacaucucucuuaucucuggcagaaaauaaaauuuuaauagucaaacuguacaacaaaccagaaaauacuccuggucuaauucauaaugcaauguccuugaaguggaauucuaaagaaaagacuuaugcccuccuuuagcugccuuggauagaagcagauaauaaaaccagagcagacauaugguuuucaaagauuuaaagagagagugaaaugaaacugcaaaagacagagccaaguaagacaugguccucugugccaguuguucccaagaaguccaaagacauuacuuaacccgucuuaacuacuucagauuuucucucuggagaauucaccuaaaacuguaacuuauucaaugugaaaagugacagguuuuuuuuuugguuuuuuuuuuuuuuugagauggagucucgcucuguugcccaggcuggagugcaguggugcgaucuuggcucacugcaagcuccgccucccagguucacgccauucuccugccucagccucccgaguagcugggacuacaggcgcccgccaccacgaaaagugacaguauuuaagaaacuuccuaggcacagagaaaacacugugaaugguaaauaugaauuuguccuuuugcaaauguagggaggcaaguuuccuuccacguggacacaugugaaaucuacaacugucauccaccuaugucaccaguguuagaucucagacagagccucgucacacugaagacuacguaacaggggaaguucuacuccuugaaggucucgggacccuucuacagcuaacagcccuccuucccaugagcuccucucagucccuugguuaccugacguuuccuccagccuucuguauccucauccgcucuucauacugaguuggauuaugcucuuugcugaggcuuaaggcugcauguuuuugacucuccucauuauaacgacacaagauugccugggaagauggagauuguaauagucaugaaauucagugggcgcagcaucuaaagguaccaguugaaaaaaacaguuaacaauggaguuugaagaaaacaguuaacaauggaguuucacauucagccuccugcugauaaacguaaguucagagaaucaagcagcaaagaagugucaaagacacaacaguuagggagagagucgccccugguuuugauaucaacucugguacaaacucugcugaauaacuacagacaagugcucacucuggcuguugucacauuugugacaugaaaggaagcacucaacaaguaucaaggucccuuuuggccuggagucuagaaggccagagacauguccaugagccuauggaaggcaaagaggagggcaagcguugugcaugcuggccgagugccagguaggccguccacaccagugccuccagguguucucgccccugccagguucauugugucuguuuuacaggaagacacugaggcacgaagaauaaguaacucaauaaagucacagagcagagccaggauucaaauuugggucugacuccugucuuuguuuuuuugccaauuuuccucuugcuauuucugaagucauguggucuaaacacaugugggcuaaggccagucuacuaaagggccaccagaauguaaacuccaccaggcaggggcugucaucuguuauagucucugccauaccccuagcacuuaguauuugaugaaucauccccccagaagcaucguggggaggggucuaaagaugcugcuuaaguguggacagucacuugauuccugugacugccuagggagcaaggaggccgggugaaaaagcggcaacggaacggaacacaugguccugaugcagaggaggcagggucugcauccagcuuuccgcagcagcacccucuaggcuuuacagcauccccacgacugucaccagggggaacaacacccugggcuuucucccucagccagggaccgggcucgggugaugaauggcaccucaucugguauuuucuagcuacagcucucaaguuacucugaaaucacaguaacuuugauaggcagggguuaaagcuuuucauucauuacugucuaaggucagagaaaggaaauaaaagaagauuuaggcuacuugcauacugauuacauucugauccacagcaucacacacacaaaccacgggaggaaaaaagaaacaaaaaagacgggaucuggguuuuaaagcacaagucuaucauagggcguaaguuccccagagaacaaacagccucuagcugaguugcuguucccuuacccagaaguuaaacugcagcagaacacucugcagcaaccccagaagaaagguuucaaccagacaccaucacuuuaaucuuauucaacaaguacgugcuaaagucuuuuccccauaaaacguauugucaucuaaguggguggcuccagagccacauacccgacuaucuccgagguuggcaauauaaagaauguugucuacagccagaacacacguggcaguggacccaucuuuccaggcaggcuuccuggggggaaacacaucagaaacacagucaccaccaauagcccagcacuuugagacuaauuuccagagcucaaugggaaguaucuuauauuucaaaaugaaccauuuccuugauacuugcuuuuuuucuguuuuagauuuagcuaacgguuauaaaagcugagugcuacgcacuuuucagacagugagcaauaguguuaaaccacaucagaagacugaaaugcauuuaggaaaacaccacacacaguccacucaaacuucaucaucaaguuauacuuacuggcuggaagcuuguuuaaggaacucuucaucaguaugcuugaaaguguccaaaaggcaucucuucacgguuuucucuacacugauuacaucuccuauuacagaagggccaaaagaaaacaaucucucaaggagggaagauuauccuccucccacugucauuuugguuuguuuuuuguuuuauuuuuuugagacggagucucguucugucaccaggcuggaaugcaguggcgcgaucucagcucacugcaaccuccgccucccagguucaagagauucuucugccuuagccuccugaguagcugggaauacaggcgcgcgcaaccaugccaggcuaauuuuuguguuuuuaguagagacaggguuucaccacauuggccaggcuggucucgaacuccugaccucgugauccaccugccucggccucccaaaugcugggauuacaggcgugggucaccagggcuggccauuuuguuuuuguaauuucugcacaucaauugauuuucaagcaugauuaagaacaaucccuauuucuuuccuuuuuuaaauuuuuuuuucugagacugggucucacucugucacccaggcugcagugcaauggugcaacugugguucacugcagccugaaccuccuggggcucagaaaauccucccaccacagccuccugagcagcugggaccacaggcacauaccaccauguccaguuagguuuguuuuuuuuuuuuauagagauagagucucccuauguugccaggcuggucucaaacuccugggcuugagugaucuucuggccuuggccucccaaagugcugugugagccaccgugcccagccagaacaaucucuguuucuuuccucacauauaacacagugcuauuugaaguugguuuacuaguuuuccaguaaaggcaagacacuaacugaacccaaagacgauugacaaaaggugccuaucacuuagaaucaugagaagugccauucuaagucacaccugcauggccgcuacuccuggaagccuuggcauccacuccucagcaccacucuuuuaagacucaucaaugauucucugcuaaagccaaaauaacacaucugacugcuucacacagccaaccaaacagcaauaaccaauuugaguaucaacugauuuaguucucagucucaccuuuaggaaauuuucugauuaaguuuugaugcaaauucugugcagcaaauuuugaggcucgaauuccuccauguccaucaaaaacagcaaaauaugaaacccgaguacugaaagaacgaauugagaguuaaucaaauucucacagcaaaaaccacacuuuuccauuaaagcuuuuaaauuucgucucaaagagugaacauuaauaagucagaggaagucacacugguuaagacaccagucacacuguuacaaaugggaaaaaaaaggcuuuaacugagacaaauauuuaaguaacuuucacagcauuuuaucuuuuuuuaaaaaaaaaauacuugugugugggccaggugugguggcucaugccuguaaucccagcgcuuugggaggccgaggcaggcggaucacgagaucaggagaucaagaccauccuggcuaacacggugaaaccccaucucuacuaacaauacaaaaaaauuagccgggcgugguggcaggcaccuacagucccagcuacucgggaggcugaggcaggagaauggcgugaacccaggaggcggagcuugcagugaacugagaucgcaccacugcacuucagccggggugacagagcgagauucugucuaaaaaaaaaaaaaacaaaaacacuguguguguguaggugugggaguguuucuggugaagacugcaagaccugcuaaaggucuaauauucuaaaagagauguaacacuuuucccaguauuuuacauuaaauguuuaaaacucacauuugcuucaaagaucaagaucuguuaauucugauuuuucacugacaacaaaacuaaaauucagaacuccguuccuauuuaaaucggauuugguuuuaaacauuaacaaacagaucaaguuauuuaucgaaaacaguaaaaaauacagucaugcaucacuuaacagaaaugcauuguuaggugacuuuguugugugaacaucauagaacauauuuacagaaacuaacacggcgcagcuuacuacacaccuaagcuacauacaugguagagccuauugcuccuaggcuaaacugcacagcauguuacugcacuaaauaccauaggcaguuguaacacacugguaguauuuguguauuuaaacauaccuaaacauagaaaagguacaguaaacaugguauuauggcugaacacgacagcucacgccuguuaaucccaacacuucgggagguggccaaggcaggaggaucacuugaggccaggaguucaagaccagccugggcaacauagcgagacccccaucucuacaaaauuuguaaucuuaugggagcaccgucauauaugcaguccaucacugacuugauguuguuauucagcacaugacugcauaagagcagggaggauauuacagaauuguuacucaaauaaauuuuaaauaucucauuuuuaaaaccuaucuuacuacucuuauucccauuccccuuucaaauuuugccagaaaacccacauauauggaauaaaagacaucaaauaaacuauuucaaggaaaaaaaaaaaacaaaaaugcccacgagaaaugacauuuauucuagagagcugcuuuucuuucaaguuuuuuggaauuccuuuucaauuuaggacauccugagccaugagaaaaaaaaccucaucugguuuauaacucagagcuguucuuacugccuguuauuugcaaggcaugauguaguguucccaauuaaauuuacacucaauggaucugccuucuugggcuccagaggucccuuuccugguuuuaaugcaaaucccaggcuggguaugguggcucaugcgaguaauccuggcacuuugggagaccaaggugggaagauggcuugagcccaggacucugagacaagccugagcaacuuaaggagacacugucucuacaaaaaauucaaaaaauuagccggcugugguggcacaugccuauggucccagcuacucaggacgcugaggugggaggacugcuugagccuaggaggucaagccugcaaugaacuaugauugugccacuguacuccagccugagcaagacagcaagacccugucucaauggguguguaucucguccccucuacauaugaucagcugcucugcagcagccaucaccucaucuccaugagcagaccucaucuacuggacaaacgccaucagcccaaacggcuccagcacacuguauguuaaugaccaacuggugucaguaaagguacguaauguauuuauuauguaauucugaauuauguaaccuauguaauauguacuauaauguauguuuacagccaacuuaauguccuaccuucugguuuuuuuccaggcccaagagcuuauccagaaggcuucauuuuaguuuguauaguugcagcuaauuuuucauugucugucuuuuccuugacaucauuuugacuuuuguucuuccugggcccugauuaucuguacuagcucugcuugaucaccauucauacuuuaauuaguggcuuccaacucuuaucuucuaggucauggauuaaaaauauucucugccagaagccgcucaguugcugguaaggaguaacacacgcugcagagccaugcuaugaagcgucaucucccgcucagcagggcugcucaaccgcgacacuacugacauuccaggcugaacaauucuuuguuguggggcugcccugugcuucuaagauguuuaccagcaucccuagucucuacccaccagaugccaguaacaacucccucccgcaguugugacaaaaauguacccaaacacugacaaauguccccugggcggggagcaaaaucaaccccagcugagaaucacugauguacaaucaagugauguguuagauuuucuaguaaauacaaacuagccaguccaaaaugccagucagaacccaggagauguuaaugccagccgggcuuccuaccacaugagacucacaugagggacgaugggggccuacacuccucggugaugucguucaggaugacgugggcauccugcaucuccucccucucacccuuccgcucagccacauagcccuucagaccaaagaucaccgaagaggcuaaggaaaagagaacaaaagagccaauacaaaacugugcccaacccucuggaaacccuagucccagagcaaaugagagggaacuaugacugucugacucagcaauauccuaauggcgcaaacaaauaagcaauaccccuuaaggcaucucccccagcugcaagucuauaacucaaaucggagcacuguuggacagggugagcucuaagagguugcacagggacacaaaagaggagucagugagcacaaaacaacucugucuaggguguaagucaaagcaucagggcaagggaugugcugccaucccagagaagugagauucaaaucaggcaaaaggaucaugugcaaauuagucuugugauaauugaauaaggacaaaugcaagucaggagaguuuaucucaaaagcccuuaagaugcccugaaaauauguauuuccaugcucaaggcuggugaagaauuugaacaaacaguaagaucagcugcuuuuacuucaacugaggaagaaaaggauaaaagauuccaaugcaggcagagaucuauuuacauuuaaugguuagacucauuuaagcuuauuuucugauaccuaaugccagacaaauaauaaaaugaacacugugaagagcugucuucugggaagugacaagcuaaguugaagaugacaucuucccagcaaagcuacaaguggguuuuuucacauaccucugccugcaucauacagcuuucacugagguaaucugugacaaaggacaaugcagucaaugaaaaucccacagcucgggccaggcacgguugcucacgccuguaaucccagcacucugggaagccgaggcgggcagaucacaaagucaggagaucgagagcauccuggcuaacauggugaaaccccgucucuacuaaaaauacaaaaaacuagccaggcgugguggcaggcgucuguagucccagcuacucgggaggcugagguagaaugguaugaacccgggaggcggagcuugcagugagccgagauggugccacuccagccugggcgacagagcgagacucugucucaaaaaaaagagaaaaaaagaaaaucccacagcucaagaauacuuuaguaccacaacugaaguauucucuuuaguuaauacuuuucguuuucuuccucacuaacuuugacaaguuacacaacugacuacaaauuucaacggcuuuuuccaggcuuagggaagcugccuacuaagcuaaaucacguaauucaaagcacuaauugacaaacugcaaacaaagauuggaagucagagagagacuagguggucaaaaaacuaaccauucacugcagaaggcuaagaaaaaaaccaccuguauuuuuuaacucuugaggaacaaauguagguuuccuaucugaucaaagguaggaucagagauagauguacaugaaaaguaggagaaagcacagagaaacuuggaaauucauuugcaaaaagggaacccuacuuauuucuuaaauacagacauaaaaagaaaguauuauuagaaagcugaaacugguuuugcucuggguuguuuuaaaauaugaagucuaauacauuuguuuucaaauugucugaaaaccuuuacaaacuuucuuuuccacaagcucuucacugccauucuucucuuccucggagguuuuucucuuugcuccuuucccuucagucuuuaccaucugggauauugauguggcaagagaaccuggaaauaaaguaaaagccagacagaaacacagcuguagacuguuggaaaaagucacuaguagacugggcuucauccuagcacucaaagacaaggucauuugaagcaaggacuggcagacacaggcagacccaggaguugugucuucaugguuggcggggagggggaggggggucccacagugagagaacauaaaguuaagauccaggcccugagucaaacugacccugcugaagggguuuguaaaagacuuuucccagugguaaaaauacaugguuuuuuuuggccuguagcauauacauguuuuuauauccacaggcucuuaguguuaaacaaacacuuacaaaaucuguaagcaaacuaacauauccuaaucacguuccaaaaaguaacaaguacucgaaaaggcucaaaaugagguaaauggcagccuuuaagaacuguaauacauccuuucaaaggcaaaauaaggcugccacagcuguucccacuagcaaaaggaugaaucuguacucaaagcuaagggaaucugcaguguauguguuugaaaugagaaaagucaaguuucaaagaggugugcaacuuaaucuuucagucucagcugucuucacccgugcguaacaugguaagaauacugucaucucagagggauguuugaaaaugggucaggacaaguaggaagagcauuugucacagugccuaacacaucaaucuccaauaagggcagcugcuguccuaauaaaugacuugaaauguucucugcauuuagguauaaaaguaugcaacagccagaugcaguggcacaugccugcagucacagcuacuucuggagacugaggcagaaggaucacuucagcccaggcauuugagaccugccugggcaaaguaguaagacguuucucuuuaaaaaaaaaaaaaaaaaaaaaaaaaaaaggaugcaaguacuuauuuacuuacucaaccuacucuuugccagacauuucuucuucuuuuuguuuuugacacagggucucauucugucacacagacuagaaugcaguggcaugaucacaguuuacugcagccuccaacuccuguguucaagugauccuuccaucucagccuccugagcagcugggacugaaagcaggaaccacuacacccggcuaauuuuuuaauuuuuuugguaaacacaaggugucuuuuuuuuuuuuuugagacggagucuacucugucgcccaggcucgagugcagugacgcaacgucagcucacuacaaccuccaccuccaggguucaagcaauucuccugucucagccuacaggagugcaccaucacacccagcuaauuuuuguauuuuuguauuuuuaguagagacggaguuucaccauguuggguagguuggucuugaaccgccugugucagacauuucuuagugcugaggaaaaaguaaugaaaauguuccugcccucaagaagcguaaauuaguugcacaaggcccuauuucugcaacaguauaacauaauacacauaugcacccugcauaaggcaacacagauguuuccaacaguaucucucccaaagguccccauuaguguccuguggcuuacuguauggguuccaguuuuccccauauggaugugaaacuuucuuccuuuaaaauuccaaaacagauggccagguguggugguucacaccugucaucccagcacuuugggaggcugagaugggcagaucaucuaaggucagaaggucaagacaagccugaccaacauggcgaaacccggucucuaauuaaaauacaaaaaauuagccgggcaugguagcgccuguaaucccagcuacucgggaggcugaggcacgagacucacuggaacccaggaggcggaggcugcagugagcugagaucucgccacugcgcuccagccuaggcaacagagcaaggcuccaucucaaaaaaaaaaaaaagaaaaagaaaaaggccaggcgcagcggcucaugccuguaaucccagcacuuugggaggcagaggcaggcggaucaugaggucaagagauugagaccauccuggccaacauggugaaaccccgucucuacugaaaauacaaaaaauuagcugggugugguggcaggugccuauagucccagcuacucgggaggcuuagacaggaacuugaacccgggaaguagagguugcagugagcugagaucgcaacacugcacuccagccugccaacagagugagacugucuuaaaaaaaaaaaaagaaaaagaaaaagaaaaaaagaaaaauaauaaaauuucaaaauaaagacaccuuacagguuuguuauugacuucuaagcaaauuacacuguagucugagaauguagucuguacaagaaacagaucauugaggcuuauuuuauggcuuaguacauaaucaacuuuuguaaaugguuccugcccgcuuaagaauguguuaucgggccgggcaaggucgcucacaccugucaucccagcacuuugggaggccgaggcaggcggaucacgaagucaggagauggaaaccauccuggcuaacauggugaaaccccaucucuacuaaaaauacaaaaaaauuaggugggcgugguggcgggagccuguagucccagcuacuugggaggcugaggcagcagaauggcaugaaccugggaggcagagcuugcacugagcugagaucgcgccacugcacuccagccugggcaacagagagagagacagucucaaaaaaggaaaaaaaaaaaaagaauguguuaucggcugggugcaguggcucacgccuguaaucucagcacuuugggaggcugaggcggacagaucacaaggucaggaguucgagaccagccuggccaauaugggaaaacccugucucuacuaaaaauacaaaaauuagccaggcaugguggcacacgccuguagucccaacuacucaggaggcugaggcaggagaaucgcuuaaacccgggagguggagguagcagugagccaagauugugccacugcacuccagccugggugagagugugagacuccgucucaagaaaaaaaaaauguguuaacuucucuagaaaucuaaaacacuagacccaagauuauauauccaaaaaauuaagcuuguuaauaguguuauguaaaucuucuaaauuuuuuacuacuuugccuuuuguccuguagauaaauaagagacagcuaugcuguaucuucauuucuucuauuaaaucccuuaacagccuucuuugaacauauuaacuuuccuuuuuuuuggagacagagucuuucucugucacccaggcuggagugcaauggcgugaucucagcucacugcaaccucugccuccuggguucaagcgacucuccugccucugccuccugaguagcugggacgacaggcacaugccaccaugccuggcuaauuuuuguauuuuuaguagagacaggguuucgccauguuggccaggcuggucuugaacuccugaccucaagugaucuacccgccuuggcuucccaaagugcugggauuauaggcgugagccaccacgcccagccagaacauauuaacuuucauuacaacuaaggguacuaucuuuauugggaagguuucaggccacacugugagugugaggaugcugcaauuuuuugguaugggucuacagcccugaagauugagaauucuuauauaagaugacuggaguacuuuuccuaaaauauagaaaauauaccugcauacgaaaugggauuaccugcauuccccacugcccccacaccaucuaucucccaaccucuccuaacccucaccuuccccaaccagaggagcucuaccuaagaaguucucaugagacagaaucauaccuuugccgcaauggcaacaggaaucugcucuauucuucccuucuacuuaauuaggacaugaaaaggaacauuuucaggaggagguagagccaaugcuacuagccucgauacauuugagucaagcacucuguuuaacaaggcaaaucggaauaaugaacucugaauuuuuaaaaaauguuaauaacaaaguuaagaguaaauuagugaacucuuaauucuuaaaggcaguuccaacaaucugaaccucaagaaguuaauaucaccagaaagugauacaguauuaucuuugugcuuccaauuaaugugccuguuuauaguuuuaguaaaccuuaugcuguauuaugacuuaaugucauccaaaaucccguuaaaaccuauacauaaauuucacauaagaguaaaauacuauguauuauuuccaucagcaccuuggauuuuuccuaccacuuaccugaaucgccacugcuagcgggugggagaucaucaaaaagcaaaggucccccugauccugaaacacagcagaacacuuagugagcccacaaaaaauauguaagacuuaaguuucagaauccaucccaccaggacaccuauguagguuacugaaauaaacucaaaacuuugcgucaauccaguggcaacucauacugcaaugaauaauaucuugaaccuauuuuaaaguccuauuauuucaaaggaaauaaaaaucugccuuaaaaaguuaaauuguacuucagguaguaaaauaaauacucaaaugaaccagagaaaacugcuccacauuuccucgcaguacuucucagggcuagcgacuagcagauuuuucugccuuaccugaugccauggauucaaaacuuaaagacaguccaacaccuaaaacaucuguguguugaaaaugggggaaagggaaaaagauugagacaacuacaaucccaggaugaguagagacguugacacacaccugggagagccugaagacuguaccugagucaguacugcuggccggagggaggucaucaaagagcagggguccuuucugagcuucuuucccuaaaacacagaaaaccuguuuagagagcauauggucaucacccaggacagauuuucaaagaggaagaucauguggucuccccugcuuugacacaaguuugcuauuagauucuaauuuucuccuuccuguugggcaaauuuuuaaaacauauuuucuuaacagcuuuuuuaauauggacaucuguuuccaacaguuacagucaacauaaaagcaaugauugaugcccuaacaggcaucuucagggccacugaauauuuugaggaaaacaaguauuuucuugauaauuucauuauugaaagcaugaaacauuuaaaagucuuucuuuaaaauagaauccugggaagaaaaaaacugauucuagaccaggaaaacaauacuugagacuuccugauagacguucagaaauuuggggugggguggaggaggggccuucaaagaccuacagguuuauaaaaauccuauuucgguaacauucugcaagggaagaaaaucuguuggaaccuggugucccuagccccagcacagugucugauucaauaaauagcuauggagaaaauaaaggaguuucagguaaccaaagacagauagccucaggagaaagucacgaaacucuuuuaacaaaaaaugugaagauuuacacuccaaaaguaugucuuaaauguuuuaugcccaauuaucuuuuuccacauaaaauuuaacgaccauuccuuauuuuccagcuuuuuccugaaauucuguuuaagcuauuagauaucugaacuggcacacaagaauccaaguugaaaguauacacguucaccuccugcaaaguucaacacaccaaccaaacacaccagcucuaucccaccucuugcuccucagaguucaaguauaaaaacgugcucauuuacgccaggcgcaguggcucaugccuauaaacccagcacuucgguaggcugaggugggaggauugcuugagucccggaguucgagaccagccuggacaacauggcaaaaaaaugucuaugaaaaaaauacaaaaauuagccaggugugguggcaggcgccuguaguccaagcuacucaguaggcugaggugggaggaucaccugagcccagggaggccaaggcuucagugagccaugauugggccacugcacuccagccuaggcaacacagugagacucugucacaaaaaaaaaaaaaaaaaaaguacucacuuaaaaaccaauucacuuuuuuuuuuuuuuuuuuuuuuuuugagacugagucucacucuguugcccaggcuggagugcaguaaugugaucuucgcucacugccuccaccucccggguucaagcuauucuccugccccagccuccugaguaggugagaucacaggcgcacaccaccaugcccaaauaauuuuuguauuuuuaguagagacauggucucaccauauugaccaggcuagucuugaacuccugaccucaaguguucugccugccucagccucccaaagcgcugggauuacaggggugagccaccaugucuggucuaauuuuuguauuuuuaguagagacgggguuucaccauguuggccagguuggucucaaacuccuggccucaagugguccacccgccucagccucccaaagugcugggauuacagguaugagcuauugugccaggccaaacaccaauucaacuaaacaaauaaauuuauaucccccaagagggucaucccuaucaucuuuuugccuccauuuagaaaugagcuggguaucaacuuucuucuuuuaaaaacaaaagcuuuaauuaaaaauuuauaaacuuaagggaaugaaauuucucccggggucuuugcgucagaaguaccuaaaauacacaagaaauuccugaguuaacaaaaaauaacuauuuugcuuuauaucccuaauacaaaugggaaaauguauucuaauccuucaggaugacccuaaacaaauuaaggaauugcaaauacuuucacuuuucuuacaagugacauaaagacucuauuagaaguauacaagaagcagaagaaagccauuaaaaaguauuuaguauggccaggugugguggcucacaccuauaaucccagcacuuugggaggucaaggucaggacugaggucagcaguucaagaugagccugaccaacauggugaaacccugucucuccagaaauacaaaaauuagcuaggcaugguggcgggugccuguagccccagcuacuugggaggcugaagcaggaaaacugcuugaaccugggaggcggagguugcggugagcugagauagcgccacugcacuccagccugggggacaaaaccagacucuguccccagcacccaaaaaaaguauuuaggauaaccauuacucaauguauuaauccacuuacaagaauuccuaauaucccgaaguaggucacuuuugcccaaacauugggucuaacaaucacaacgcccguucuccggacagacucaaaaaccacaugagauguuccagacaaucacgcugcauucaguggugucacagagccagaugucuuaggacaagggaggggacauuuacagguaacagcccaacaugaagagcaaacaacccuuccgcuuguaccaggucauauuuuaacuuuugaauuaacuugcccaucuaaaucaggucuuuccacugccacuguacaagggaggaagucuucuuuuacccagguaauaaauauauuuucaguucuuguaagcauuccucacaaugcaacuuacagcuuaguauuaauacuagccuggccgccucuccucuggcuacaauucagucagauggugccccaaacugagccccauccccagagaacugccuaucaccuucuuucucacucuggaauacuaugagagguauuucaauuaaacacaaugagaccauccuacauuuugcuggccacaacugggaauggcuucuaaaaaugauaauacugccugccugucaggcacuauucuaagagcuccacacaucuucucauuuaauucuuaugagauagguacuauuauuauuuaccgaugaaaaaacugaggcacugaggucaauuaccuguucaagaucacagagccaguaaggaguggaguggggauucaaagccaugcaguccgugcuuuuagugagguacuaugcugccuccauacaugggcacccuuccagaaacuucauaaacaucaacucauuuuacccuuacaacaauccuaugaugauaauccugagauuuuauaaaaucucuggaaauaauuuuugcaucaucaaaagaaucuaacuuagaagucuguauguggauucuuuaaaaaaaaaucuauaggucauagauacauaaggaaacuacugauuagucaaaaccuuagauuuuuuuuuuuuuaaauugagacaagagucucgcucugugagccagguuggagugcaguggugugaucacagcucacugcagccccaaccuucugggcucaagcaauccucccucgucagauucccgaguagcugaaacuacaggcauacaccaccaugcccagcuaauuuuuuaacuuuuuguagagacggggucucacuauguugcccagguuggucacgaacuacuguacucaagcaaucuuccugccucagcaucccaaagugcugggauuacagaugugacccacugcuccaggcccuuacauucuauuuugaauaaacugaaauucaaagcauugggggcugcaaucauuggacaaagugugacccugaccuaaaaaucuggaagaggccccuccccuaaucuuaaaaauauuagaacccuaauaagaauacaagacuaaaaauguccauuaaucauaguuaaucucaucuagaacuuuuuuuuuuccucaguuaucuacauucuggagcuaagucuacuggaaguuauauacuaugcugagaaaaauacccuuggguugaucauauucagguuaaagguugcuguauccaauaaaguuaaaaaaggauguuaaaauauuuuggcuaaauuguuuuuuauaccucaauuuuuucaacuauaaaauaaauccagguguuuuccaaacaccacagagguauuaucagaaaaaaggggggacagguuccgccacaccccccaaccacaguaugaguuuaguguauccuuuccacuuuccuuaaugcucaugcacauggacucaugcauuuuaauuuguagaagacagagucauacucuacacaauacuccacauauaguguucacauaacccaucaaggcaugcuccaggccaacacacccaagucuaauucauccucuccaacagccacacaugggaagcaucuccacucauucgaccagauccuuacugauggguucaagcuuuucccaguucuucauaugauaagugacgccacaaucaacaaucugauacauguauuccugcuuaaucugcuagacugcucgucaaaggauauuaguuuaaaucugauagaagccaaaaucuguuccccaaaaaguuguaauuuucacucccaaaacacuuuaugagaaagucuacuucgcuacacauucaccaauguuaccaacuguugcuaaucugaugggugaaaagguaaauaguuccucagcaacuuucuguugaugggccauuuguauuccuuaccucugaacugggaggauacauccuuugaccauuuuucuaguggguuuuauuuuuucccaucaauucugugagccuuucuuauacccuuaguaauguauauugcaauuauuuucucgguuugucuuuugccuuuauaguaucauuuguccugcagaaauuuuaaauuuuuacauagucaaauucacuuuuuuaugacuuuuuucuuguucaacccuguaguuuuacaaucuguuuuccucuaauaccuuaaccuuuauguucaaauauucuucuuuuuuuuuuuuaaucguagagacaggggucucacgaaguugugccaggcucuucucaaauuccuggccucaagccauccuccugccuuguucccccaaagcgcugggauuacaaguaugcgccaucgagcccagccuccaauuuuuuuaaaguauuuuuaagaugguguggccaucaaauauuuuauuuccuccucaacaacugaccaucaauuuuuaaaguacuaguguagcaaccaaauaaguaaaagaaccacccuauaaaagugaaaucaaguuacuggcgaagcaauuuuaaaccaugacaccuucaacugacauacauggauugucaauauaagcugccaaucuuaaagacaucaggucggcacuuuuauggguaugacauaggaaaguuccauuucugccugauaugaacaaacacuuuuuuuuagguaaaauauauacaucucuccuuuaaaaaacuugauucauucagcaauuaaaacuuuuaagggcuuggaugaaaacuacuaauuuagcaaaauaccugaaauauuuagugcauucuauguauuuuucuagauuauaaacauuuaagagguuuaggggugggaacauuagaugcaacguuuaaaacaaaaauaaaaagaucuaaacaaaauauuaauacauuugaugugauauaagcaguguaguauucucccuuuggacacucagugcuuucccauaauucauuuaagacugcguuuuuccacuuuuaaacaacuguuaauggcucagccaggcacaguggcuuaccacuguaaucccagcacucugggagggccaaggugggcagaacacuugagccccaggaguucgagagcagccugggcaacauggcaaagccuugucucuacaaaacauacaaaaauuagcuggcugugguggugcgcaccuguagucccagcuaccaaggaggcugagguggaagaaucaccugugcccacggaggucgagacugcagugagcuguguuuaugucacugcacuccagccugggcgacacaaugaggcugucucaaaaauaauaacccuggcuaacaucuauaaaacacuauacauucuaccccacacuaugugcagcaccauacauacuguacuaauuuguacaguaacaguggcaagugucaccccuuuuuacacauguaggaauagccacagaaggcacaguuaguaagcgaagagcuggauucuaaaccaaguagucugguuacacuuucugaacaacuuuucuugcgcucugggaaaauaacgaggucuuuuauuguucacugcauuagagauuugugguacccacauaucaugugugagggucaugaugcacaguuuagacucauuauuccauucacuuuagcaaucaauaugauuuauucaaaguauguuuuuuuuuuuuaaaucacaguauuuucacaaguaugugaaaccagauucuguucuuguacaaacgauuuuaaccugucaaaucucaucuuguugguuguagcuaacagccugcaaugauaacuauggaucccaauugucacucauuuuaguacuuaucccucucagcuuccaaucaucuacaaauucugagaucuucuucguuuuaaagcuauuuuuaaaaauacacucagccaagcaggaccuguugacaaugucagugcccuccuggcagauggggagcagcugaccaauccaaucucaggguggucagcaguuuaaacaccaugcacccccucugccacccuuucagcucagucaagguuggaaacugaguuuggaaaaaacggcaacaggauguaccuuucccacuguaucuggcaaaaggcugcuaaggugccaaccuaugagauucugaguugccagguuuuuugucagucaagggagccugcuccugagcagaaccuaauuaauugcagguaaaaagcaauggagauuuuaagacucauagguuuacacgcacacuggugaauccaaaugcugucccaaauauauucagauagaaauuauacuccauugacaagagaaaaaagacugcuacacaaauccaauuuuuacccacagcuaaaaccgugguuauuuugaaaaugaauggcugagucaaguucaaagacuccaggaccaguuacugagaugcucuguaccaucagaacggucagugggggcagggcacgguggcucacaccuguaaucccagcaauuugggaggccgaggcgggcggaucaccugaggucaggaguucaagaccacccuacccaacauggugaaaccccgucucuacuaaaaauauaaaaauuagccgggugugguggucggcgccuguaaucucagcuaguagggaggccuaggcaggagaauuguuugaacccggagguugcagugagcucagaucucaccauugcacuccagccugggcgacaagagugagacuccgucucaaaaaguaaaauaaaauaaaauguuuucucgcccagaauuacugcaaaucacaagccugaacauccuuggaagcucaauucaaacacugccuccuuccccagucucucggugcccgacaaucccuccucaagaguccucagcauuucccacagucauuaacuuuugccaguuuuaauuaccguaauuaguacccuucagaaagcagcucuuagaaagcgaaggcugggccuuacucaccuccgucuacccuacaacagcagcucccaaaccacuggucuccagcccccgcuggguuggccuggggauuuaguaacagauucggaaaccccacucucagggauucggauuuacuggggcugaggugggccuggaaaucugaacgucuuaaguuuuccagguuuucugcccccaaguuaaauuuuguaauaaggcccuaaacuacaacaucaagcuggaagucuugcauaugaaauauucacgcguuuugacagaugaaacccggagacuguaacccacaggacgcagggauuaacacaggcccuguuucaagcugcuaggaugcugagcucaaaccacagcccacagggacucccacuggcaggggccagcgcuuaggagaugagcggaccccuuaacuucaaggagagggggaacuucccguggaccagaaaaaaaaaaaaaaaacuacuguuaauuaucacaaaaucacaggaugacagaggaggcauccugucuuccaggcuucaaaaacacgaaggauuaagauggugauuaauucaaucuccagugcaaauaaaaacgccaagccccugaacuugcaccggcccggaacgcggccguuccacagcccgcgggugaagugcggcccggaagccgcgggcgggcgacgcgcaaggcagcccaggccgcggguggaaucggggcgcgggggcccgcggugccgccgggcguucagagccggucccucgggucggcccacgcggucgcgccggcgccuuucaccgccacgcagaggggccguggccacgacggcucggcccuuuccuuccugcguagcgaaaauggcggagcggccucuccgagcuccgcgagcgaccgggccuccgacagggccgccagugggccggacggggccuggccaggcaggagcaggccccgugcagcccgcgccgcccgccgccucccagcgcgggcgccgccucagccgccccgggccucaggccgcccccaucccgccugcucucccuucccuggccggcccggcggcaacgccgcuuaccggcagccgggcgcggcgagcgcucgggcuccggcagguccccgaagagguccauggcggaggcuggguggaggcggcagcagcgacagacacucagcccgcgagcagcggccgggcuccacaccccgggcgggcggcagcagcgggcgggcgacgggcaggggcggccggcgccgucagucaccugcagggagagucccggacgccaccaaucggcgcgcggcguggcccggccg

SEQ ID NO: 12809 - RNA, 4472 nt, Homo sapiens
caccaguucauuuuuuuuuaaaaaacacaaagucacaugaaacaaagcacacuuuuuuacauauaugaaaggaagcauucacaggauuuuccauacucaguaaugaauaaguaccccaagaacuguauuuacuucugugaaucuuuguugcgugauauuuuacugaaguccaagugagccugggugguccugcaaagaguauucacacagagauauauuguauuacuuaugcuauuaauaaauuggcuuuauuagccuuaucacugacuuaauuuuugaaagaaaaacucaaacuaaaucaauaaccugaguauuauuucccaaauugaugacauuuucauuuggguuuuaauucagcaaauuccccuccucaaaagaggggaaugcugucacuuccccagccaacauacaggugacauuggaaacgcugcuaaaugccacugugccuuagcuucuccuauguaugcaaggggucacugcccagguaaugacucugaggggcuggcaauacagcauaagaaagucacuccaaauucuguuaagcaagguuuuccgcaggcagccgucaguaucacagccuccaguacuauaaucauuguuaaagcauuuuaaaauagacaagacacgccaugaagaaagugcauccagacgguugaacugggcugcugguuaugauagcuccagggcgccccggggggucgcaggugaaauccuccagguccaucuccccaggcagaggugagccugcaauccagcuugcgcugcccuuccagggcguccccggggccucuggucuucagggcugggcugagcccugggcugcucaggaccaaagcugagcuguuuuucuuucaaacuaaacuaugaacucucucugcuggagaaagagacagaaaggacagagaaagagacacgccgacagagccagagugacacaggggcacgcagacagggagacgaggauggcgaagcaggcuaccaggcagguccucuccucaguaaaagcccuccgcaucugggaaagggaagaugucccuggaucuggguccuuggacccacacaggguugguaaaagggcagcaaaucgcuacugucacugcucugagcaaagaaaccagggaaaggccaguucgggaaaaacaggcccuuuccaucugacgugaagccccaggaagggcugcagcccagcaccggcaggacggcuggggaccuggcuucucucucucucucucucucguuccuuaaauuuuuauuugagaauuuuaaagaaagggaccuggaaagcuauuuuguugggcuagaggggccgugggccuucccagcgcggaggaaggagggcggucaggccggguggggcugggugcgguggcucugcagaaccuuuaggcaccgaacugaagccgcggguccggugcgcggacacugcgcagggcgcugcuaccgacucacaugcaugcgagggcccgcuccuaggcguucugccuuccuggacggauuguugguaaaacguccccuagaacggccggagccagggcccucggacaggggcgcgaagggcccgcucuuugccguccucggguuucccaacgcgguggucguggcccgcgggccccaccucgcggcccgccuggccggccggaggagcagcggaggccgagcacuccccggucucggguucaacuucaauaaaagggcccagcccgcccuugaucacgcggcuugccugacagcccggcucaggcccgggccuaauugagcccgggucaccugggaauagguucaaaggcaucaaagccguaaaaaccaccuccaggcccagagccagagcggccuggcgaacaaagagccccccaaccacuucaaacgcgcucgcgcucgccguccagauggcccggggccgggguccguggugucgcucaccgaggccgggccccacacuccagccacccugagccuccugcucggagcugcccgcgggcugccagcgcagcggaggcugggcccggggcagccucgugcagcucccggagcgcccuccguccucugcugacccgcgaagcgaaggcggagcgcagaggcuggggccguacaaggcgggccggcaggcgccccaacccgcgcccagcaacccggguagggccaggcaggcgggcgcggcggguaccgggcgcucccgcagaggcucgcuguggcguuguuuuaaagcuguuagaaggaagguucgggaagggcgucggggccggggcuccccagcaagccaggguaagaaaugguccccgacacgcacgcuggccgaaggguggcaucuccacggaucuuggcggcauguccuugggcacgggcgucuccagggggccccgacuguccuuacacuggcgguccggacaccgagaccccugcccgcgcagcuccccagaccccaggccuaagcuugcgggccgcggugcagacuagcugugcgcccgggggcggccaagacccacacaggucgaggaggcuccuggcugcguccucaucuucugggagcgcaucugggacuggacucgccucucuagccccucacgcccagagagagaaccccccaaagcccagugggggccgaucucuacguugaggcguagacaaagccaggcuuggccgggccuagggcucggggcggccugagagugcccugcguucggggugggggcgcgggcggcgggcgaggacccggcccccgggaugcccuccgcgccggggccgaagggggaggcaaaacugaaagugccgcgccggggggcgggggcggccggcgaaggccccagaacuuguccugcccccggccaccgcggccaaucagcgcgccgcccuagcuccugacaacuauuuagcaacccagcccagcuagaguuuccaaaaaaguuagaauaacuuccucucccggagaccucgguuuugcacaagccggccuugaaaucagagccuuuccagcaacuccgagagcgugugcucggcgaccgcgggcuuggccagcggcgcgcgcucggcgccccggcgcccccagccccacgcgcgccgggcgggcgccauggaggagggcuccagcucgcccgugucccccguggacagccugggcaccagcgaggaggagcucgagaggcagcccaagcgcuucggccggaagcggcgcuacagcaagaagucgagcgaagauggcagcccgaccccgggcaagcgcggcaagaagggcagccccagcgcgcaguccuucgaggagcugcagagccagcgcauccuggccaacgugcgcgagcgccagcgcacccagucgcucaacgaggccuucgcggcgcugcgcaagaucauccccacgcugcccucugacaagcugagcaagauccagacgcucaagcuggccgccagguacauagacuuccucuaccagguccugcagagcgacgagauggacaauaagaugaccagcugcagcuacguggcccacgagcgccucagcuacgccuucuccguguggcgcauggagggcgcgugguccauguccgccucccacuagcgccgcgccacccaccuccggaccggcgcgccaggguaggugcugcgcgcgcgacgggcgcccuccgcugcggggggcgggcggcaggggcgcaggggcauuggggccugcucgugucuccucggcgaggccccgcgggccgcgggggcuuggaugccgugcgcuuuuccucuuagcaaggaaggcgggcgggcgggacgcucacagucccagggacaccccugagugcagacuuccacgcgagggugucaguugggaaccggcggaccggugacucccccggcggguucugaagauacuuagacagauggucgcaguuuucauucucggugguguguggguguccgugguuggcgguggaaggagcgagcaucagaaaaaccuccuggggccggcuggggacugggauaugaggaccagcugcccuuugcguccgccgcagcgcaggccgcccgcgaagcugcccgagccggguguugccgggcgaauggcuucgcuuucuuccugggcaaggguagagcgcguccgucgggcggacacucagaucuacccagcugcucgcgccugggguccccggccgucggcgcccuggccugcccagugggcguagaggugcgggccugcggcuccaggguuugccuggggaggacgggaggaaacugcccugcgcuucggggccagagcagccacagggccgggugugcccgagaagggcccugggccgagagcgcagagccuggagcgcugaggcaggcggguccgacgcagccgcgcggagccccagggcgcccgcaggcagguggagcugaccuaggaacugggagcccugagucccaaccuugacccuggaguacccgggaggggccccgcccauccagccccgcagggaugggcgagggguccaggcugggaaacgggucug

SEQ ID NO: 12810 - RNA, 5519 nt, Homo sapiens
cggcucugaggccggaagugagccuagagcgccgcggccccgagaugaagccggcgguggacgagauguuccccgagggcgccgggcccuacguggaccuggacgagguggcacgggcccggcgggagucuccgagcguggggagcggggaagggggagcggaagggcggcguccuggugcgcgggucccggggaggggaggccgggcgggugggcgaugggcgcggcucccaggcucccugccccgcggagagcaaaucccgguuucuccgagcaccuggugaaaggcggcgaccgaccgcggcgggaagcgugugcccuagcccgggggaccaggaggcgcagccugaggguugagugccugcugggugcccccacggcccccgggaacacacccguggucagaggaguugcguuugcugcucuucgauggcugcagcaccccaugggggcccgcggugcgucuccauaaccucgugugggauuugagcucguguuaggggauuugggggaagaaagugggcuuuacugugccuuggaagcgaggauaauucuccgauugggccucuuaaucuuaacuagaaugagggaagacuggagcagccgucauuccugucggagcggaaaaggagacaucuggcauuuaugugcuuugcguaguggccucguucuucuuuuuaauuauacaggauuauacagucgucuugggguuuuguuggucucuauuguguucacagagugaccuugucugaugugagcguucugagaugguuuauggucagcaggagagcaccacagccuagcucagaguggcaggccagcuccuacaugucagggccuuaugugcucuuucucaaagcuuaggggcugcagagguggucagaggcagcccuugugcuuguggagguaauagcauggcagagcggcugauugcaaauaccaggugucauagaaagccgaaggcgcaccgacggauggacccucagggcuuugagggggcucagcaaagguacagcugaggagucgacucuguggccaaaugcugggggacacauugguguuugccagguagugggggaugaaggcccggcaggagcagagcccuggguugggggaugccgacuggcucaccaagggaagggaauguugugucguuuaacaugguugagcgugcagugccagagagaggggagacaguggguagggacucucucccuacccagaucgugaaaccaucuggaaccaugcuaaagaggguggcucugugcaccccgcucccgaagcacuuccauuaaacccaggcuucucaguccuguuuuacaguccuaggcuucacaguccuaggcgauguggagccaccggagggcuuuacaguggggagugagaggcuccgacuugcucuguaggguggcagcauuuacgggugagaggguagaaaaaugagagcagggagaacaggagaguugaagagggugugaaugaggcagauggagguagggacaagcuucaagugguagaaugcgcguggcuuacugugcugauggggacagggaggguggcugagaagccaggggaggagacugaguguccuggcuuuucugagagugucugaaagggaacaagggcaugcagcuauguggggaucagggcaggucugagcaagcggccuugugaaugcuggggccagggcagcagcaggaccuguggccagcuguccagggugcugcugucagaggaaucugcucccucugucaccgguugacucuaaacaggacccaaaauccugagggcuucagauugcccagcuuggguugugacaugguuuuuccacugccguggaguuguggcaguggacgguccaugauagcagcggggcaccagaaccucagaggcagagcaggucaguuuccucggggaagugguuucauucccagaagagagagggaagggauccugaguggaggcgaugggcucaauuucgcauguuuguggccucuggcgauguccggcgagggaucggaaagcucuccuugaggggcacagagaaguaguggugcuuaggucagugguagguuucuuuuuuaaaggcagacaggaaucaaggaacagaagcccuugagagaccuuaaaaaucauuccuuugaauuccucccccuccccccaauacacauuccugugucuggaacuaaaauguugacuccaacuugagccuguuuccccucacccaucuucuuuuuuuguggggguaguggcccugcaaugcacuuaucaccuguucuuucggaaaacgcaccugacauaaccuugccuuuccauuccccaggcgggaggcagcaccgggcucuugauggacuuggcagccaaugaaaaggccguucaugcagacuuuuuuaacgguaaggaugcuuggaaugggaugccagauuuaaucugaauauuucuucucuaggugaaggcagugaagcaacuuggugacaugaauaauuuggaucauaaggugguagagccccugcgcuccucucagaaugcagugcagccucuguggagcgaugacacgggcugcggccacuggcaggcagccuuauuuuucaggagaaaaguagcaugaaauuguucccagcuugcagcccaguaguugaguuugagcucuggcaugcguguuacaugugccugcggacaccucagacuguagccaggucugggcccucaccccacacacggccauaggaaccccaucugucucccugucuccgcccucuccggguagccgguuuccuuuccucucccagcccaccuguguuugccugccuggguucucaugcccucagcugccuuugcagagggacagccauacuccagcucuugcccagcucugaaaucaggacgcaggauguguuuuccucuugauuuaagggcuucagugcuaguuaccaaaaacauggguaaaccaaaugaacagugaaaagcaaauuuucuguaacaucuucagaccugcuagagggaauauuucucauucucuucugauuucuucaggccuuauuccuauagaugauauuaaccuuuacuaaggguucaaauaauaaguaaauaagauagguuucuuacuccagagagugagguggcauuuuucauccugguuuaauccauggugcuuuucucuacagaaagcucuuguuacuaguuaacagcuaggaccugagcuugccacaucgguuucuaauuuaccagagacccccugccauccugagucccugcugcuucaucaggcuuacugucaggcagccauugccugaggggagcagccaagcugcugaguuggggugcaggcuuucccagggugccuggccaugccccugaggcagcauucuuacugcuaccaacuggagucagaacugaggcagaugacauuugagaugagccuggagaacugaauagcauuuauuucaauucuuuaugccagagcgaggugggagaaggguguugccuucagagggaacaaauuguacaaagcugcagagcgcucuccaaagcugcuuugcaaaaacaccagcucaccagggcgacuuugaagcuuuucacgugggcaggauugggcaguugcuaaugcuggcaccacacgcuugcauuuugaugaucuccuucaaagucccauuuauccucugccagcccauugguuagaggcgauugcuguguucuaguguuugaguucacaugacuuccagagucagcccuugaauccugacgggaaagcaucucugagagggacccagguccuacccgucaggugagcgcccagcaaccugagcauugugggcgcgugucugccuuugagccacggccggucagggaggggacgcaggagagcucuguguccccugccugcccacccacuaaguucacaaagcacucacugucccaucagguugugacaaccccauguguucaagaagccauuuacuuugagagaccucugugggcuguggaugaggcuuuugcuaaguccuuuuuacucgucaaacagauggguuugcugggcuguuacacccugggcaccaggguucuagccacgaaagagacacucucucuucccucgccaugucuuacaaaauuguggguccagacaagucagcaggcaggggcuggacugugacaagagcccuggcaaagcguggacggcauuguuucugggagcacugcagagggagguuucuccagagggggcagcagagcagaggucggaagguguggagucagccaggcccaggacugcgcaaaagugcuccuagcggcgaaccacaaccagcagucgggaggcagugaggacgugggggugcaucaguguggcuggggagcgucgggacccucugcaguauccagagaugccucagggacgccacccuccccaggaaggcuggaugcuguggugccagcaggccccuuucucuucgcucugacccuccaggaguugaaccuccucuuucuaguucauaauucauacugcacauuuucagugcgcaguacaugugggugggcuuuuaguuguauuuucaccucccauugugaaagugaugauugccuguaguagggaauuugaaaaacacagaagacuaaacagaaggacaaaaucuuuccuggggggccugauuuugaucacccaaagcagggcacuacguguuugcugcguuucuuccagugagaaugggccuuagcagguguuucucaggcuugaguaucauucacgcucccuuacuggaggcuucaccuuucugcagccuagcccggcuuucucaugcucacagcggcagccggcugguuucccucugcucucaaggacccagcacgugccucccagcuucaucucuccccggccccggcagcgagggcagcaucuugggugcccgugcacucgugggugcagacacggcacuggcguguccugagugcugaguuguggcugugcggugguguccgugggacucagaacagcccugcaugcauuuucuuaggauugucuuuuaaaugaaagcuagaaagcacucuagccaacacucuccccuuggacuacauguacgagcccugguuggcugaaacugaaagucuguuacgggaaaagucuuuuauuucauuggaucauugacgauuaucucuguauuuuggacuacuauauaauucauucugaagugauuucuucagcccuuacccuuguagguguaacuacgugguuuugcuuauuucccuagauuuugaagaucuuuuugaugaugaugacauccagugagaugcccucuggcugcaggcggggccaagcccuugguacagagccgcagugugagccugcgcaggacaguuucaggugguuuuaaagaacacguggaaaucccuugaauuuaggaccugguuaaccagaaagauaagacuguucuuaacgaccuagaugauucuguucaucucugaacgggaucagguuuuguccucacuccaauuaaaagaaagcaaugucacauguggagugaucucuu

SEQ ID NO: 12811 - RNA, 32876 nt, Homo sapiens
uaggggccgggccggcggcgggggaggcgccgagccgggacugcgcuagcccgccgcgcucugggcugcccgagcgagcguucggaccucgcaccccgcgcgccccgcgccgccgccgccgccggcuuuuguugucuccgccuccucggccgccgccgccucuggaccgcgagccgcgcgcgccgggaccuuggcucugcccuucgcgggcgggaacugcgcaggacccggccaggauccgagagaggcgcgggcggguggccgggggcgccgccggccccgccauggagcuccgggcccgaggcugguggcugcuaugugcggccgcagcgcuggucgccugcgcccgcggggacccggccagcaagagccggagcugcggcgagguccgccagaucuacggagccaagggcuucagccugagcgacgugccccaggcggagaucucgggugagugagggcgcggcgccgggaacccgggccuggccgggcuuugggcuccggacccuggucuucccgacgcggcuacucgcccccggcgcgggauccugccgccugcgccccgccgcccgggccccgaauggcucccugcgcugcggcuccucugcaaccccacggcccucgccuccaagccccgcgccgcacucccucgccagggucuccuccgccccgcucggucguccuccgccccuccccgccccccgcacgccggcuucuucccugcggagcugaucucgccgggcugcgggcucggggcgcuccucccgggccacggcuggagcugggcgucuucugcccgccgcucggcccagcgcgccugcaggccgggagucccagccccggggccggcugucggggcgcuguggggcucggcguggccgggcuuucggggcgccgcugacgguggccgcggaccccuucugcucuguacagaccucucugggaggcgucuccgguccugcccggggauucucguagggucuccagcaaaggcagccuagguggguuuuauaagcugacccccucgggggguagugcggagggguggggagggagcugggcacuuauccgcgggcggaacgccgccgccucguagagauuccugucgaagaacuuguacgcgccggcccccgccuggcgcuugggcagccucgugccgcgaguccagcugcagguggucggcgcguuggaucccgcccaggggccgugucauuucuuuguaagaacagcggcccucuuggcgcccccuaagcccugcagccgccugcggcucugccucuucccucccuguggucccggaggagcuuuggggacagaaguguacggguggguggaacggugggcuccgugugcuaaggaacucuuggaacccaagcuucaccuuuccacgugugggaaccaaccucggucuguaccgcgugccagggacccagugggcaagaacaaaacagacuagguuccugcucuggggggcuccucugaaaccaggggagugggagugcggguggagggcuacucagauggggacucagcgcagaaaugcccaugguccuggggauucugagcaagaaggauccgugcaucugggugaggggggucuguggccaugccuugccgcggggggcggaguggugggaggaggcagucgggcucuggaccccugccccuccaggaggaacagaacccacagacagccccuugcccuugguggaucucccgaugcccccagccugagguucuuguaagggcccccugaccgccccccacagaaggaacagaacccgcagacagucccuuggcggaucucccgaugcccuccccaccagccugagguucuugcaaggaccccuccaaaguccccaggacaggccuuccugugccucugcagaggcaacccugucauuuccaggcugccccccucaccccacugggcucugucugucccagguagggggcacaccuggaugccaggcagcacaaggcccucggcacaguuggguucguucucugccccucuacucacacauaaagaggcaucccuggccuuccuggugaaucccuccccaggcaccaggguagcagaguggcugaguggcugccccucccagcccagagucuugaacccugcuccuuuggaaaccauuagcccccagcccuucuuagcaccuccauguccucugggcaguugcauccuuaggagccaaccuaaccuuccuugcauccacaggccacuguugccaguuagagagacagaguggcagaguuuggccaucucccaagggugagaagagagggcaggacaagauggagaaguugauguggggcugggccagagagugugggucgugcugcucuuggguuggggaaugcaguggguuagggacccaggacaggcagauuguguugauuucucugugucugauggggcaggggaugcuguccaccccgcguggggaguacgaacgcccugcagcugucuaaccacggugccagccaugggccagugccugcugccagggcucggggugccacccuccuccagacuugcaaggccaggacugcacugggcaggauuacugccucuccagucggugccccuccgacaggaaccucucucccugcacccccuauggcugcagaaguggggaguaaccuucgggacccaggguacagaagacagugugggagccacgugggcugagggaaacagggugacucccucgggucgcagcaguccuggggcagccaagcccaguguccccuccugcuuugucggcugggccugggcuccguggaacgggcgcccucugguggccccugggcggcagauccucccaggagcccuggacccucuguggccuaguaggcaccauucucaguccccucucuccugcauccagacuucuccagggggaccuccucagagggaaugcgaacccccugggguugggcaccucgcuggcccggagcaggugggguagagaucugauacuuccucgugggaaggagagcaguuggcccuggguguguggcgggccuucccagccucugccccagggaccagaaaaggcagugggugacaggagacuuagcucaugaaagagggcagugucgggacauauugggcucccuuuugagacuuccuuuguccucuggacagccaggccaggcugcagugacagcaguggucaucccauuuuaugggcaaggaagcaggccugggugccaccagcuggacgguggcacugcagcagggcacccggccacccucccuuuaugccagggcacggcacagaaggcaagggcggagccgaguggcaccccgggugccccugcgcugccaggagcccucaugcugaaucacugcccgcgugccagcaggccuccugcuuuugcuugcaagguugugucugggcauagguguucccagagcaccugucuggccuccugaugucugaugugaugugaugugugucuguuugcuccuuugcuggggucucagcgccccaccuuggcaccugagcucccuggucgcugggaccaccucuaacuguuucccuguuguagccacagaacccggcuggcucccggcccaggauagcuucucggaggacacccccaggccuuccuggcuuuauaccuggcugugcuggguggggagcgggacauggaggguagaggagggucuccuuggagcagacaccccuguucucagggucucccagccugaggcagaggaggggcccuaaggucuaguuuugggggcagaagucagaguggggcaugggacugucgguggcacagaaacugcccagccgcuccugugcccagaguggcagcccgccuaccagcuggagcgggcaccagcgugcccuggagccuguaccaagcacccacucguugggccccuccgaaggaaucuuuucuucucugugccacuuuugaccgccugggugguuggcacacagacucuggggaaccauccucagagggccuggaccucuccuucccacaucccugaaaggguguuuccggcugggcccgggagagcccaccagcaucugcuucucaguccugcucagcgggccucucggaggcugccuggcacacagccccucaccagaccagacaguucccugugcccuguccuguccagguggcucagcgugguucccaggugguccucagccuuugcugugucgcugcucuucccuccaugagaggagcucaucauccccagcgugaggaccgagcggagcccaggggagcccugauccgacagggccaccugcgugaugcaauggccugggucccugcuggaccgccaagccucccaugccaggcaggccacagcacuccucaggcacagaugcccccacccccaucccauccccgguguccccgggccuuuucacaggagagaaagggaauaaucgugaccuccugugaagguggccaggagggagaaggugcuggggcugugcaccucgugggcagccucgggcuguguccccccucuccccggacacccucugcaaaggcccacacacaccccucucaguuaauggcauccgguacccuaagagcacucaugaacccgggugcucuuagaacacggggaaacccggcuuguggagcguuucccaugacugucugguuaacacaucagacggaaggggucuuuguagaccuguuuuacaaaugaguaaaccgaagccuggugaagcgcuccucuuagggccagaucuggcuacagcauugaccacugcccaguaaagccaggccaggcugcuugucccaggcucugcacuucuuggaaggcucgugcuuuucccagcccgcucuccuguccugggccugggcuccaucucuuaggcucauuuagaacguuuaaccgggacuccuccuggccucccugccuccgguccugcccagcuccuccuggccucccugccuccgguccugcccagcuccuccuggccucccugccuccgguccugcccagcuccuccuggccucccugccuccgguccugcccagcuccuccuggccucccugccuccgguccugcccagcuccuccuggccucccugccuccgguccugcccagcuccuccuggccucccugccuccgguccugcccagcuccuccuggccucccugccuccggucuugcccagcuccuccuggccgugccgcccagagagucguacuuccacacagcugggccucacccuccggccuggcuccacugccuguggggggcaggacugcuaggagggcuguucccagcgugugccacgaagcccugcauguccccaacagggcagaccagccacccacacugggccaagugccccaggauuaguggacagguacccuauucaggugcccacaggugccaagccagggagauaaggcaguccagucuguuggggcuuguaccuucacaccagcaaucucuagggacagugugagccugugguuaacgcgccuucccagguaccgaggacgccucccuacagcaggacggggggcauaccuaccugguggccgaaccgcagggcugcacaucagaccucggaggagagcuuagugggugucugagcaugcccaugucuguucuauggcauccaugugcauggcacaggugucagccaugggcuggcacuagacaggagacgagccaggggaggggcucacccgaagccacacuggucaggucuggccuggggccccacaucugccgugcccgggccagugagaggcuggacgccuuuucuuaagccagaccguccucacagggccuggcucaguuauuucagaucaagacuggacccgugguggaggcuggggugggcacuccuacaugcggggccucugcccagcccuggcccuguccagugucgacgugcccagagcccugagccggccuggaucuugccagucgccagcacagcccuguggggcccgggaucuugcccacuuuacgugggggcuccagacaggagccgccugcccggagccugggcuccucgcugccgugccugugguggcuuuucuuugucugggaacaggccugggcaggugcccugagccgcuugaagucuccugacgggguggggggugcaguguaggguguugaggcuugggccagggaagcgggcgguucucccuccaccuccaggccccacacccaggcgggagcacgcagcagccagguguugggugagggcuaugcugaggagcagggcccagagcugcagccuccuuggcugcccuuggcccgccguggguggcggggaaguacaggugugaggggcauaccccacugccccaggcucgguagcagucuggaauccggguggguuuaggagccccugagagggccaggccagccucacaccauccccucuccugccuguggccucagcuccaucucccgccagcuccugcugacccaccuuucuggcacaccuguccccucccuccacgguguccucccugugcccacccacagcacccgccuccuccggccuuuccccacagcuugacuucccgggcaucggccaacacguacccucccuguugccggggcccccgccugggcaggccugagcuccacacaggguggggaaggccccgagucccucccgguaccggguggggcugggugccgggguugggagcacaaguguuuccagggcugucggaacagugccacaggcugagcagcugcagcugcagacaugggucguccgugguucuagagccuggaagccugagaucaagugugcguccaccaggcuggccccuucugaggcgugaggaagucugcuccacacugccagcuuccagguguuccuuggcugguaaaucccaccuuggccuccacaggccgcucuccccgugugcgcuucugucuccgaauucccccucuucacaaggacacaacucuaauugggucagggcccaccgguaccaucucuucuuaacgagaggugucacacagacuccacacccaaagucacauccugaggaaucgggguuaggccucagccauguggguuuuggggguacaguuuagccuguaguggggagcuagcccagcccggcacaccuacaucuucccaucagguggcaaagaccccgaggcucuggguguuuugugauuguggccuccugagcacugggccguguuucuguaaugggcuuagagcucagcacagaugugcccgagacccuggugacagugugagggagugaccacgccccagccugccacucacccccguccaccugaggcgcucucugggcacagccugguccccacaagccugggaggccucagcgucaggcccugcacagcuacuggguccuuggccagccccuccugccgugggccuccgcuuuucccucagguccggguggcagggccgggccacucaggugauguuccaggucuagugguacagcaguggcugaggaugccgccgccugugccgucacagaacugggguggggggcaguggccaggcuggccugaaaaccuucuccagguugcguugcgggagcccaggcugggagagucgugguucaguggugugagugugccuuggacaggccccagucucccacuugucagggggcagagcccuucagguggacuuugggcggggaggcagugggacugcagggcgaggguuuggagauguagagaugagggaggccugggggccaggaggcugcaccacugcugucuccugaggcgguggcuggccgaggaggcccgcugcucucuugugcugagugccccuuggguccugcaggcuuggcagggugacagggcagccacccaggggcuccaccuguccugcuccuucaggaggaggagaccucccagggcugugguggggaggagggccagccacagagccacugcaaaucaucccugaggccaggcgacucggaagcagaaacccugagcccagcacggggcagugggaggugaggcccagcggcaucugugaacuaggccuccuggugggcucucaaggucuuugauggggcgcagccgguggacagggagagaagggucccucuuuccccaggcccucccuccccugguccucucccaccuuugaggugccccaggaguucccagagucggcagcaccaggggcugucuaccgggugggcugaauaccacuuaguuugcagaugggaaagcugagucccagagagggguucccagggcucagagcugagaggccucgccgccuggggccaagccccacacuugcuugccgagugacucacuccugcucugggccuggcuagcaggggugaggcugggucagaggauggggagcugggccaaggccacagacuaccccgcaggugcaggcacccagaggccugaggggcaccgggagcgcacaggaggggaggcugugaacacggcccggcuucuuugcagcuccgugucggggccaugugaggacacacaccgcaggagggcccggccagccucagcccagcccagccgccacgcccggugggucuccugaggucagagccagccccacagugggcaccacaugcccgccugcuguccuggcuccuccugagggacaagggugagcugggcgggccaggaaguacaacgcugcuaggcuucugcucucgccccacagaaguucagguucuacugagaaacuuggcuggggcuuccggggacucccaaauccagccgcccaggacccugcggcacuguccauccugagccccguccucacccgcugguccauccuggggugauggaucuggcugcagugaccccgaugcucugaggcccagaacagcacgucucccuccugggaacagccaagccuuaggcccaugcagcagcgaccggaucccuagccuccccggcaggggugcuuccugggugcgccaucagcagugggaccuguagggaagucuguggccugugcgcaccuucagacgauuuccccaaacaccgacgacagcuguccagugcgucacagagcuguggccuaugggugaucgucucagccugucccugcaucuggugcagccucagugcccacuguggaccccgcagcccacccgugucuggcgcauccuuggugacuggggcucccuguggcugucugaucccaucccugugguaacccaugugugacguccaagugucuccucaagaaccggggccaggaggcccauccuuggcucuggagacugcagggagagcaucccacccaccugugaccaucuaccaggcccuggggacaaagcugaugccaccugccaccaggguuggcucaggcguuuacaugcaucuccaguugucauggagcuugggacacacuggacccaaggagguauuuuaaaaggacaagucucucacguaauccagccccacuguuccugaacgcgaugcccccuccccgagccuggcggggggcuguacacagaacacugcucagcaucuucagucucccuccuguggccucacacccaggaugguagguguuagaacaggugccucccuguucuaugugcguggccucauccugugggcaauuuggggugagggguggcugcaggucagacagauaccugggaagguccccugggauaggguggcucccaagcgggagcaguugcccugggcacuugugacaucccagugauugaggagugggggugcucugguguuuaguggguggggccagggagcccaguaauccugcaagauggaggugcccuuccacaaacgccaguagcacccccaagagaaauacuugaacugaagcuauaggcagaaccacgccaggggaagagggagcucaggggagggggcaccacucagcgccaggugcugggaugggaggaagggcagacugugguggccaaacaccagcaugcaggaggguuguucuagaugcauccauccuucugugggugcacggaugagguucuggauguaauucaugggcuucaugaacuuggcugagaaagagauuacaucuccaucguugcuaaccucuaaccagaauuuagcauuuuuucuuacucggaacgaugguguuccgggaccuggggcuuggucaccaguagacgucgccgcuguuuaugccccuccacguucguagcagacagcuuggaaaacggcguccucucacugugacuuugaauuguagucaguauuaggcccguugcggcuccugugaaacggcuucccggggaagcacgugcguugccaccucacaauucguuguaucacauucugguaacugcugugugaugagugcuuccuccaugguccucuguguaguuguaugcuucagaaacaagcaucguccugagaaagcgucugcggcuucaccaaugggcaacggggcccacggcacagagaaaguccggcugaccugagcagcaagucgcccucgcagcagagaaggagaggcuuggggcccagugugucugcgcccaggagggcccacgguggccuaggguccgaaacgggggaacgucguggggaguccccaggcaccuugggcggagcaaggagcagggccaucugccugccgugcgagugagagggacacaucccagguccucugcaucauuggaggcuccgugagcuccuacugggugcuguucugggugcugaaacgcagcugcagacagagcccuugcucucuggacgcaguuagcgcagagacagggcacguaugagaggauccacacaagcugugccugugcuuggccaccaugaguguguagcuugugugaguuacaaguaaaggggugugacaugcaggaaucuaggcaucugcaugugagguuugcaaccacucacccauuugagucaugugaacccugagggccgaacccuaaagaccacucccuggcuggggacuggcccagggcucccaagugcaguuuggccccucucuugccauggccaucucuuguccuguccucggccucccaugcugccuuacaggacccucaacuggggcuggccaccuggggcuccuccccaacccaaggagccuggagcaucuggguccuggagcacugggggccagcucauugagaggaccagagaggagacuuggggagcagauaggaagggcuggguucuuccagcccacaucauucggcccgcagaggacggagaggggaccagggugggcagccccugggcaguguggagagaccugccugaggggagcaguggagcugcacggcuggcaucagaauccgggguggacuggugccccgagcccgagcaucucauccauggggggauaagggguguccauccacagccguguugggagcccagccuggcauggccgaaccccuggcgucuggcacccagggaugcccagaaggggugggcuucaccccguuucugaguagcaaaggcagugagugggccaggcagagacggggcugggggcuugguaggcagggucugagggcauuaaggcuggaccccagagccaggaggggcgugaccagaggucugagucgaaauugaggugucguagaugacccccauguucguuccucccucaagcagagaucccucgagcuaugccccgacacagaggcuguucuggguaccgggacacagcaaagucccuguacucccuccggggccucugugugguuggggcgacauugacagucauuucggaaggucaggaaggcucagcgccgugaggaggguguggcagggcugcucugaggccggcguggagccggcggauggagggggagggcacguaggugugcacacacugccugcgccccuguccccauggaccucggguucccagggaggcggccugccgggccucuggggaaagccacacccuuggccgagggcuggcucucuugaagaucauggccguuccugguggccgucgucuuagcaaaggggcggguccugagagaagccaaagccaaccugcugggggucaaagggggucaagggccggcuccacaccggcugugugccccuggcccugcccacagucgcuguguacccuggcagaaggcuggcccgcccucugcccagcgugugucaugucagggaggccuauucuuucucuaagucccaucuuccagaaggugggcuguggaugagggcacuccauggggagggaggaaggccaggcuggggagccacaucugccuggacaggaggccccgucauugucaccggcgcagcugcuuccugguugucacccugagcgcucacagcacgcagugucggcgcucccauucgcuggcucugggugugagaugguggaaauggcaagaagaguugcugccaggccauucuggguggaacacaguguccccagggcacagugacaguggaacggccggaggcgcucucgagcccgccuugaggguggcagcugguuuucaggaagagagucaaggguggagaguucaggaggcaccgcaggcccuguggagaggcaggaagggcaggagaugcuggccccgggucuggacagcugcccucauaggggccucucccuuccccuacgggauggggcugguucguucccccaggcugucugccuccuggaucucaugugcccgccccaggcaguguccccaaccucugcccagagccaucucaugggauccuggcaucccucugucugccaggcaguccggguguagauagucccugccaggcaguccagguguagacagucccugccaggcaguccggguguagauagucccugccaggaagucuggguguagacgggguggagucaggacuccaggugccuggggguggaacucugagccuccggcucuccuccggcagguggcuucgggaaaugggugggagucacggaggcagggggcccccauucccaccugcuccaggacccgcagggcccacaggaggucgaggucggagcucaccuuuggggaggcgaucaggcaggcacaugacaggaccaccugcucagagucucccugggcugggagcccugggcguucucgguggugggcugugugaccagcagcgugaccggcaguuaucccuccccggacguggccuugcagacaccagcccagcugccugaggcccaacuagguuucagcagcaccuggccagcaaugggauagucaggccagcgaggguggccaggccugacccuaguuuugcaagaguggccuaaucuccauaccugggcucggggugcccagguaucaagccugggcuucucauuuccuccccuucagugaggacagggggacacucaggccaguggaaggagaucugccuuagggagaagucugagaccugggggggaagccaccuaaccuccgugagccucagucuucccaucuguaagcugggggugguccugucugccuguuaauugagauagugcugauuucaggagagacccacugcucuccaaggaggcuggggacaguucagaguugaaagcggccuuaaaccuccugcugacagccuggacggggucugagaccugagugggggagccagggauacgugggugcgcaagcaugcaugggugcccaaagguggugggcugcugcggguggggagaccugugugauuccggcaggcgcccccccccacccccacgcugcaaagggccgccggacuuagcggaugcaaagacaggacacgagguacaugggaauuucagguagacccugaaucauuuuguagugcagugugucccaaauacuuucauuucaaauaaggaaauaaauguugagaguaaauaugcccuacauauuuaguguaaguacaccccagauauuuuuggggagaagaguuguuugcuuuuuguggcaaaauaugcauaacaaaauuugccaguuuaaccauuuucaagaguucaguuuucaguggcguucaguccauucaugcuguugugcggccgucacccccauccagcuccaggacccuuuucaucuuguaaaacugaaacucuguccccauuaaacaguaacuccccauuuccccucuccaccgccccuggugcccgccauccuuucagucucuaugaauccgacuccucuagggaccucacauaagucgagucuugccguaucuguccuuucgugucuggcuucuuucacucagcgucguccucaagguuccuccacgccggagcaugugucagaauuucuuccuuuucacggauuaauccuauuccauuguaugcaccuacagacaguuuguggaaacaaucuauucgacuguggagagacaucguuucuaccuuccggcucuggugaauaaugcugugagcauggguguaugaggagcuguuccuuuuccugcuuccaguucuuuggggccaaauacuuucauacuguacuaaaauaacaauucauuguuuaucugaaauucagauguaacuggcccccgugcuuuaucugcacucguccccuaauuguggcuguggggcagggcugggcagaagcuccagcccacacaccugccaugcugggcaggcaggcagaggugccugggcggccaccaacucaucaaagcccuagggagacgcccuccugggaccgcccagaccucucugggcucagcagggcuugucagcuccugcuucagccuuugccugcagcucaggaauuccccugggauuggagucagggcaggcugcaggguuggggaggcgggggaugcuaaggcuguuccucgugcugggccccgugcugcuacuccuagccugugaccuugcacaggucacuuuagcucucuaugugucagcuaugucagcgggaccuacagcugcugugaagaugaaaugacucggcuuaacccccugcgaggcccauagugagcucugcaucuuagcagggagacagcuagaccucugggaacaagggagcccucaccaugugugaccucccauucaggggcgugccccgucgagccccgugcuuccucuggggaggaggugcuggcuuggggggguguggcucgugggccaugcuggcagugggucguguucgcuccagugccaacacugggcagauuccccccgacaucauuuagacgugugccuuuauucaguaccaggguaccagggccggccugggugccagguagggaggcaggagcaagaaaguggaggcuccccuggcagagguucccucuggaaggagcauggcuuguugggacuggaggccagaggcuggggaggcuuccugagggaggugaggggaaagcaugugagauggagggaaguggcaggucacagcuggguggggugacuggguggagugacuggguggugggggugggcgcagggagagccaggccugggaccaccaugaccacagagauggcuucucgggaagugguugggucggaggugagcggccgaguuccuuugcucccuccccuucuguuccuuccccaguguuuaugagccaucccucuuggcgggcucccuccagaggcacccaaggguuugcucugggauccggcccagccucagcuguaugugugucucugccugguuggcauucacggggcagauggacgggccugcgcggcgucuuuguggacuggaauguggcugcugcguccccuucugcguuucuagcgugcccccuguggguguagcagacagggagggccaguccaucuuccaggccuccuugggugccuguggccccugcaguggguguacgggaagcuagaugggagagcugggcagagccccaggaggacaaccccacccucccacagccugccugaauuuccacccugcuggcaggguugggcauagagaugugagugcccucuucagcuccaccaagccaaggaggagaaaggcugagccaggccugggggcacggccucuggggagcaccucauccuggguucgaagagugggcucugccuuacagccaagacaccggguccuggguguggcaggagguucgugacacaaauucugaauccccuuucauccccagucugaggccacagcaugagccucagacaguggagcaggcuggcauggggggaggccugcacagggcacgcggcuucuuggcccgagcugugacuaggcucccaucugauggaccccugccgucgugccaugccagggccggcaccgcccagaccuggcgucugccggcaggauggccugcucagggguuccccaagcaggaucugggcagcuuagagagcagucuuaugaguugccuggugaaagccccgucuuugggggucuccgguguuguggccugccuugguggucuguccagcagcucucagugugcccauugcagaccggccgagaggccggagugcggccagaggggaacuggugugagugggugguuuugucuggcugggucagcaggccuggggaagguggggagcugggccgggacagugggagccacgcaggaccugggcugcagggaggggaggguguuggcgggaggcugucccucugguguccaaggaggggccagaggcgcacagcauagaccucccaggcugggggcaccugggugggagacuugguggaaggauguggccuguuggguuugguaugucagagggaaagcaggucaggauauaggggcaggggggucuggagucaaggcccgggugccauuggacugggggcuggagggggcagguagaggauguggaaugaccauggcagcuuugcgugaggacagcgguggucagcugccaccuucagcacagagagaaacccgacaccccgcccccauuacccuccggggaggggccccggcucccccgagcgccggcccugcugagacccaggagccccugcaccaaggccugggcccgcuuagcugcaguggggagccuaggaggcccggacugcccgcggagaacaggagcagcacccgcaggcgggagggaggggcccggccucggcggcgggcaggaaggcgggcgcagggcggcggggaccuggccggaggggccggggcggccgccugcgguuuccagggagacgggggcggugccgagcgcggcggggcgggggcugcgggaggacgcucguccccgcgccgggagccaccgcccucggccgugcgcgccagugcggcugcggcgcugcccgggguggcugcggccagagucucccgcgcgcccggcggaccgcagcccgcccucgucccccgcuggcuuuucgccuccugcgagcccuuccgcccggccccgcuccgccgccuuuccccggcccgagcaccugcacccagagcccgcgcgccgcccggagccgcuggagccgccgcugcgaagggggucccgcguccgccgccgcgcuggaagccaggcccgaggaccucucccgcagcgccaccguacccgcauccgcaggcgcgccacccccaucuccacccgcuccucguccccaccgccucugucccauccuccgcuccguccugccccgcuuggccgccgcagccccauccccuuuccgccccuccugucgggaguccguggcccguccccagucccaccccacccgucgccccagcugcaccuaccccuaccccucccgggccgcaucccggcguccccgccccgcucccaccgcccgccccgcucccaccgcccgccccgcucccaccgcccgccccgcucccuccgcccgccccgcucccuccgcccgccccgcucccuccgcccgccccgcucccuccgcccgccccgcucccuccgcccgccccgcucccgcaucgccugccgccgccccggggccccccuuccucuuccgccaggcccaucccccuccccgggccgucgcagcccuucgagcccccucccccacccccgugccugccgcacccgcugcgacaagccccuuccccgccaaucgcggcgccccccuccccucgccugcccgccgcagcccccucuccccgcccgcccccuucccuccccgccgcgcccacugcaccagugcccccuccucgccgggccgccggcgcugcugcguguccagaccccugcgcacccgcuccggcugcgcgguuugccgucuucgucccuggccgcggcggcuggcgacuggcaucggggcgcccgggacccccagggcggcgacgcugccgccggugccgccgagccuuuguuccgccgccggggccgguuucacgccugucgcccucgcaagcagccgcgggugacaggagccuuagccggccuggggcgcggacccucccacccggggcagaggugucccuacgacgccccucgguuucgggucgcagugcgcggcggagguucugcggcggcggaggggcuccuuggcgacgcugucauuugggugaaaugguggcgggggggcuucgggcagacggcagggguguggggaggggagggaagcacgauggggugagucugggggccguggaugccguugacgaggagcugagaugccguggccgguccaccucgcagguggggccaaggcugccucuggcucagacgucaggagcccaggcggacagggacuggccaggggcgcaggcuucuuagaggauggggcaaaagugaggaaaagauccucugcagccugggcagugggugguccccaggaaacccccugggucguuuguccagugcacccucaccccaggaggcugcuggacgugccggaggaugccacagccaccggagcugguugggguccgagagcagaugggccaggggcuggggcaggcuucgagaagaggguucgggcuuggggaaagccuucgcagccaucggccagccaggaaggccccguugccgggugcagagcugaguagagggcaggagcggggaggccuaggcucuucccuugcguguuggggggcugcggugccuggagcucugcacacagcccuacuccagcaccgugggaggcaaugcaggcugacuguccacgccaaauuccgguaccuuaggcauucgagucuguugacacugagugucuaggacgaggcuguaaagguggauaaagccggcuuuacagucugcaccuccugugugagccguggaagcuucuggagggaugggcguggcguggcgccaucaucucucugcauucuccuugggagggcuccagagccacuggucacgggcagcugccaggcugggucuggacaaaugaggucuggguccaucauuggggaugggggccacugucaggaugggagucucgccuaaagcuuuggggugaaggugcugaugaccaagaggaaacugcgggguggggacaugucagcaggggacgagaaugcaugaccuaaaagguauccaaaguuaaggcuggugggggcuuagugaggagcagcagaguggggugguccagaaccgucaggaucgggagggggaagauggaacgagacagcagcugccuacgagccagggagcaagagcucugugcuuuaaccugaggagcaggagccugggaacuggagacucuggguuugaggugggggaugaaucugccauuaaacaaauaauccccuucccccccaaaaaaauccucagagcacuggggaagggaagugucccagugacugagggaggggagcgcuguggaaggaugggucggcuacagcaacuucagcccagggaucagggaagagaggguccagucccuggcccagcggggagcaggcccggugaccuugaccugagcagccccagggccagagggaggggugggccggaagggcccagaugccucccugcacggggggaaggggaugggcugccgggacucacccccuagguuggaaaaugccucccucuggguuggaggaggagaaaggccaggaaggagagggagagggacauggggaggguucccuccuggccugaggccucucuauccccagguguugagcugagagaagugguggggaggccccuggggguggggaggccccuggguggggagauuuaagaugacagcuggucuugggcacauugcucuccauucagaaaggccccagccccuggcauucuuccaggagggggcuugcuuugccgcccugcagggggacucugcagagccggccucugccaucucauguccaggaccacaaccuguggccccggccugcgccgggccggagcuccgcagaaggaagccagcgggaggccuccugccuuugacugccgugcguccagccugcagcgggccucagggggccgccucgauccagccugcccgaggcucccaggccuucgcccgccuugcguccagccugccgggggcucccaggccggcgcccgagcucuggcuccgugucuucacucccgugcuuguccgaggagggagggagggacgggggcugugcuggggcagcuggaacaacgcaggucgccgggccggcugggcgaguuggccgggcggggcugaggggucggcgggggaggcugaggcgcgggggccggugcgcggccgugagggggugugagagguggcugacggcgccgaggagccccucagaaccugcagguggggggagcucccauaucuuacggguguuucgggccucaccucuccaugccucucgucagccucucccgucugcguggugggggcuggggaguggguccgccgggaccucgcgagggaggggcacaggaggagccggcgggggacgccacccacccuccucccuaggagugcuugagcccuaguccugagucuuggaccagcucacucgguuccuguggcccagccagccuggccugggugccccgucacagcugagcccaucucagcugagcccagggugugucaccgggaagcucagcuggcaccugccacccccucccccaggcacguuucccucccacugcccagcccauuaccaucauguguccggcugaccugugcucuccuggucugggcagccuggaugggugcacagggccccaucacagcccacacccucggagagacgccuccugagucugcucagccuggcacaggccccaggaaaggacccggaggggcgguuccugcucuaaauccugcccccacgggggugggacuggggcagaaucccaucagugaauaaaggcugcagagugaaggauggucccuggcgaguguaccugugucccagucuucuugccugagggcgccuucccacccaugugaggaguggggaaggagcaccccuucucuacuaggccccagggcucucagagccgggcucuguccucaccccagcuggcucccacaaggcccuccuggccccagacucuguuggacccccaacucccccuccagcaggcaucuggagguaaggaggggcggggggcgcaggugcacuugccauucccgcucugucugcagcaugggcacauguaaguccaggcccuggggaaucccuggaccugcagccccugcggaggacucccucccccucuagcucaagccagagcccccugcaucaguacauuccagaacucagacaggaaaagagggcaaggagggagcgcuccaggauaagaaccccuaccucggcccucccucgcucucccaggccccucugacaaccugucuccuugcugucaugucagcaggcacagaggcuacaggggccaagcggcagccgcccaagcccggauucggguucucuguucccuucucuugucucgggcuccucccugaguguguguacuuagagggugcggaagaucagcaaacucagucugacccaggcauucaaccucuggguaguuaccuaguccuggguccccaccccagauggccucuaguggguaagggcuuccuggaccccaggccugaggggugacuucucuugcaguaagcggguagggcacugccugcgcugcuccaggcccugccugcaguggggcuacagaucccugcucccaccuccaggcagggcuggagcugcugccagcucccccaggacagccucgagccaggugccucugcccgggcugaccccgcccucggucccgguccuggcucccucuccugccucuccucccuggccuggccuucacuuccugcugacccucaggagggcguaaaagaaugcaggaccugcugcauuccagccacccuggcccagggucccagaacaggaugagacaggccccugaggcggcaguccugaggaaaguugcuggaauuccugcugacaacgcccccccuugaccccaccccucugaccaagccaggcuccugcuuccaccucuccacugugccugaccuaggccagcaccaggagggccuuagaggcgggggacgaggcccagaaggaacaguguggccccgucaguguggaguccugagcuuaggcagccggaaccacuugcccccucacuguauagcugggacgagaccucaucccuguaagccccgguuuucugguuaauaaaaugaggauugcggcagccuucaucacagugcgaugcacacccuuuaaaaaaugcaguuuuuccugaugccacacacccauuccaggugggcccugaggugugcacagcagggcugagagcugacucaaagccuguccuguccccacuccccacaaggaggugaagcugucucugauggcagugccgcugucacugccucggacgcuggagcagaguagcucauggcaggcugcagaggaggggacuccacaaggacaccaggaggcacagggugcacccugcagggcuuggggcaugguccaaugacccuuucauggggccugccagcugcaccagagcacaccugcccccauaccagacucgugccugggguccugcagggccacugccucugaccagcccacuguuggugggaucugccguccuugcagugggagcuuggugccccccagggcuggugugggaagagagggggauuggauuccuuccuccuuccccauccucagacaugggcccaggcaaggggugccuuucgggccugggagccuucuccacacuugcacacaggaaccugaggccaguucuuugcuugcagcugcugggacagcaggcuggggggcaggacuugcccaaggggccuccugcccuguagaggcagccgugcucuugugucacgugugggaagcuacgggaccgaagccaggccuuuuccucccuccacaccccgaccacuucugccuucacccagggcaccccccaggcuggcccaccccugagcugugcuccacccugggucugccauccugcccaggagagccugagggugcccuccuggcucccagugcugucccagccccucucccucacacuggccuuuccccacaggugagcaccugcggaucuguccccagggcuacaccugcugcaccagcgagauggaggagaaccuggccaaccgcagccaugccgagcuggagaccgcgcuccgggacagcagccgcguccugcaggccaugcuugccacccagcugcgcagcuucgauggugagugccucccacgggcgcucggggcccgcagggugccggugcaucgggggaggggcacacugggccuugccuggugugucaaugccaagggugggggauuggcaggaggaggugggggaguuagugcuuuggggcuagggcgcuggguugaagccccagcugggauuugggggcugcccucaggcagggaucugcaggguuugacaccccccugggagugugcacagcccauucccagugcacauuuggggacagagggccuaucccaucagccccucagaggcuccugucaccagcagauucuccugagcaccugcagggagacaggccuuggccaaauccugccugcagcucgucaagugccccaggccacugccccuggggaccagguggccuggagccagggagcucagugcaagggcugagacuggggcuggggacagggcugcagagugcagggccugccugggguggccgccacucagcccuuuauaucggggcaggagucugggggccgcggggagugaccccugcaggccuugaggccccgccagcugcugcauuagagccacguacuccucggcccaggcugggccucgccuugugucugggcagagaguggcagccacccccagggggacaguguggggucaggagguccuccaugaagugaccucugaucagaaacacgaggacuugguggagggaggcggcccgggcugagguacugccccuguguccgggcggagccagggcgccgggacagugagccugggcagacaggagggagggagcgcugaggcugcagggcuccauuguggcugugagggacggcagcugcugcuggggcccugggguuugucucagcguuccugcuucuccggcuccuggacaccugcuguggccucccaggcucccgggagagucugccuguccccaggagcccccaaggccauuuccacagggcugugggaccucagcuguuggcguacaccuggguagcagugggucagaagcucccucucugugacuuggacaucgaugcucagagcucagcccuccccgcugguguggggcccgugggaugcgcguggccccucugggacucuccuuccuccugcccagcuggacccggggagcgagccccugcacccugagucaggagccuuccugagccacuugguucugucccauguguagggacccggcucaccuccuccacucuauccugggccucaguuucuccccagcgccgcugagcccuggcucccgccccagcgugccacccagcccugccccuuccccucuccugcuaauacccuugcccaucacaccauccuccuggccuggggacauccugcccgccugcuuccuccuggcucuuaggggguuggugucgcugcccugcucuggggccugucccgugucagugcccugccgccgcccucccucugcugcccucuggaagccuccagccuuccuguucaacucuccuaucuuugaccugaaaacacagacacccuuuggggacauuuguauuaaaaaugacccacuaugugaugugcccaaggcccaccugugccccuaccccagggagucuuguccaacccccaccuccuauguccuccccucccaccccugcccauggcagcugcuguccccucccagccuccggggcagcugagggccccugggucuuugucugcagugcuggugggaaccagugggaggcgguaggaggggagccuggcuggaccucugguugcuguguucagggauuuggagcccuguguccgcccccccaccagccuucaggagcagcugaauggguucuggcaggagguagagcuggggacugcaccuggauuuggcccauggcccucuaggugugucugggcuaaugcaugaaccacaagccgccccuuuccgggacaggccagggcguuccaggcgccaggacccaagguggacacuggacagcuguguggcccguccacccuccccacagcggccugggagcucucuguagcccugccagcccugaagccccaggccuugccaggggucagcgugggggcugauccagagaucucaggcuugacggcccccgugccucaaaggagagccucugcccugcuacccuggagcaccuuguggugggccaucgagcccccgguaccuguggggcaaagccggccacagcccuagggacgcucugagcaguuacagaccuggaagucccacuuccaaaugggauggggaaguccagggucccaucuaggcccgggguacgggggcuuuucccuaaagccccugcagcacauguggaggucugagggugagccugugccuccacacccccugcccagcaggggagaugucugggguucuaggcugcaggaggccccccagagcccucagacaggcccggggugcucacagcugaagcuucuaaaucgcagaagcugagagaagacaagaagccuaggagagcagccgagacaggguggcgggaggggcagcagcccuggagacucgcagggcaggcggcuggggccacggggagcacaaguggggaccaguggagagaaggagcggcuggcaggggggcacagaccggcccugccccucuuaccccagugaguccccaucuccaccagcagccccucccuggguguucucagggggucacugagucacagagcaucuguucugcccagggcucagcucagaaacugccacuggagccccagucagaggcccugagacccgagaggacccccugccaccugggccccugcuccccaggccagggggugaggucucggggcgccccauggaugcccacagggcccacagccgcugcaguguggcguccgacuccgagguccucagaguguauccucagagcugagucucccgggcugaguccccugcucugguccagcugccacggcgggggaaacauggucccgaucacgcccccucccugugcgcagaccacuuccagcaccugcugaacgacucggagcggacgcugcaggccaccuuccccggcgccuucggagagcuguacacgcagaacgcgagggccuuccgggaccuguacucagagcugcgccuguacuaccgcggugccaaccugcaccuggaggagacgcuggccgaguucugggcccgccugcucgagcgccucuucaagcagcugcacccccagcugcugcugccugaugacuaccuggacugccugggcaagcaggccgaggcgcugcggcccuucggggaggccccgagagagcugcgccugcgggccacccgugccuucguggcugcucgcuccuuugugcagggccugggcguggccagcgacgugguccggaaaguggcucaggugcgcacagccacccagggcucucagaaaccccuccagacccccaugcucugcccaagggacuuccucuucccccuacuuuaacccugugccccugggccucugggccagccucugaccucagccccacagccucagucccuccugcauuggcugcugcccauggccugcuaacagcguacccacagaugugagccuugcucugggcaggcggcucugggcuggcccaucccugcccagaaccaucaugggccaggaugggaagggccaggggcuggggcuggacgcugagccaggcuguggagugaaagugcagaggagacagaagagaacaacaugcgugggggccgggcaggguggggccccagagccucgcaggccagggggaugccuuggucccuugcggggcacgugucagacccagcuaagcugggacauagggagggcgucagccucagacccacaugcccugggugggaacugcccccaccuccaggcuccugggcaagucaugccuugguuuccucagcggcaugcgggugaggauauucuugccucccugugacccucgagaucauuaaaaugagggccgucugggcuggcaggcccugcgagucaggcagcgaccaccacgagcuggggcagagcagaggccuccccugacuucccuccagagcccccuacccuggggcuucguuaggggcuggccggggccaggcacccccagggccucggggccuggcuuagggucccuugcuccccaggucccccugggcccggagugcucgagagcugucaugaagcuggucuacugugcucacugccugggaguccccggcgccaggcccugcccugacuauugccgaaaugugcucaagggcugccuugccaaccaggccgaccuggacgccgaguggaggaaccuccugggugagcccccacccgcgagagcggccuggaacugucuuggggagugcacgacuggggguccuggggggcggguggucccuagcuuagagcuuggacccagggaccugaucagggaugcccugacccgggccagaucuggguggugcugcaggguugaggggccagggugccuuuugaauguccugagugaugugugacuuggggcagcugccagggagggagcccuguggggucauaguuucuuguccuuccccacuuagcaagcaccucggugugcauacaugccaacacgugugacucaucgaggaccggcacuuguuuaagcuaacacauacaugcaccgucacaugacaggcugacacaugcgaacuggcgugcucacuugcugacacacagugggccagugcccaccaguacagcgugugcuccugggcgcaugugaugacaugagcugggcugacccgcaucaaugccaacacgugugugguaauauguacaugcuuauccagauccacuaacauguacacaugcuuacaugaggggggacagcaugcaucugugccaacacgugcuagcaugugcugacacggggccaacaggugugugcuaacgugaugggagcugacaaaaugcaugagcuuuacuuguacaugugcucaccgugcacgcaacacacacaugaacuaagguguacauggggggggcaugagguaagccagcaugcauacacaccagcucacacgggcucaugugcacacaagcuggaccaaggugagccagcguauguacaugucaacaccugcaugagccagcguggacauacgagacacggcaggccagcaagcaugcagaauggccucuguguaugugcguguucaccugugcccguggcacaggugcacacgugggugugggccaagcugagugcacguggccugcacaugucacacgggccaaccugagugcacacgugggaucucccaugcugacccgugcugucaagacugcauuaacaugcacacguggugacgccugcgugugcgugucaacgccugugugcgcgcguuaacgccuguguguccgcguguuaacgccuguccuagacuccauggugcucaucaccgacaaguucugggguacaucggguguggagagugucaucggcagcgugcacacguggcuggcggaggccaucaacgcccuccaggacaacagggacacgcucacggccaaggugcgggcaggaggacgugacgagcacagcgggguggggguccuggauguggccccauugggcuugaggggccccacuaccccccaaggacccugcagugucucuccaggucauccagggcugcgggaaccccaaggucaacccccagggccccgggccugaggagaagcggcgccggggcaagcuggccccgcgggagaggccaccuucaggcacgcuggagaagcuggugaguggccccugcguguccacuggaccaggcaugagggaggcagacaggcagaggcgggcgggcccuggcagcccaguggccugacugcugccccacaggucuccgaagccaaggcccagcuccgcgacguccaggacuucuggaucagccucccagggacacugugcagugagaagauggcccugagcacugccagugaugaccgcugcuggaacgggauggccagaggccgguaggugcccaccuggcuggcacagcccucccucccaugccgccuccauugggcugugccugggccaggugcugucugcacggggccacgucccuugcuggagggcuugagccccacuucucugcggccugugugggcucugcucggucccuggaagcugcugggcaucucaggcucagagcgugggagaguguccugcucaggugauggcccuuugcaggggcuggagcagugaccugggcucugccugccuuucccccagguaccuccccgaggucaugggugacggccuggccaaccagaucaacaaccccgagguggagguggacaucaccaagccggacaugaccauccggcagcagaucaugcagcugaagaucaugaccaaccggcugcgcagcgccuacaacggcaacgacguggacuuccaggacgccagugagggcagggccuggccgggcggccaaggggccaggguuggugggggugccacaggggugugacugcccuccggguucccccacccgaggggcccucugcuccggcaucaccacagugagucugaggacgcugugcugcccaggcacgaucaccgagcccugcaccucugcggcgcccuggaggccuggccgggaugucuguuggcuuuggcuccagggaccaagggaggcagccccagggagugagagucucccagccucaggggucagcggggaucaggugcugcugguccugggauuccacaccgaaaggauguuggggucaccuggcacgggcccuuacaggguggugcugcacuggggucuccuguggggaccugccugccggagccuccucuccuucccaggugacgacggcagcggcucgggcagcggugauggcugucuggaugaccucugcagccggaaggucagcaggaagagcuccagcucccggacgcccuugacccaugcccucccaggccugucagagcaggaaggacagaagaccucggcugccagcugcccccagcccccgaccuuccuccugccccuccuccucuuccuggcccuuacaguagccaggccccgguggcgguaacugccccaaggccccagggacagaggccaaggacugacuuugccaaaaauacaacacagacgauauuuaauucaccucagccuggagaggccuggggugggacagggagggccggcggcucugagcaggggcaggcgcagaggucccagccccaggccuggccucgccugccuuucugccuuuuaauuuuguaugagguccucaggucagcugggagccagugugcccaaaagccauguauuucagggaccucaggggcaccuccggcugccuagcccuccccccagcucccugcaccgccgcagaagcagccccucgaggccuacagaggaggccucaaagcaacccgcuggagcccacagcgagccugugccuuccuccccgccuccucccacugggacucccagcagagcccaccagccagcccuggcccaccccccagccuccagagaagccccgcacgggcugucuggguguccgccauccagggucuggcagagccucugagaugaugcaugaugcccuccccucagcgcaggcugcagagcccggccccaccucccugcgcccuugaggggccccagcgucugcagggugacgccugagacagcaccacugcugaggagucugaggacuguccucccacagaccugcagugaggggcccuccaugcgcagaugaggggccacugacccaccugcgcuucugcuggaggaggggaagcugggcccaaaggcccagggaggcagcgugggcucugccaaugugggcugccccucgcacacagggcucacagggcaggccuugcugggguccagggcuguuggaggaccccgagggcugaggagcagccaggacccgccugcucccauccucacccagaucaggaaccagggccucccuguucacggugacacaggucagggcucagagugacccucagcugucaccugcucacagggaugcugguggcuggugagaccccgcacugcagacgggaaugccuaggucccuucccgacccagccagcugcagggcacggggaccuggauaguuaagggcuuuuccaaacaugcauccauuuacugacacuuccuguccuuguucauggagagcuguucgcuccucccagauggcuucggagggccgcagggcccaccuuggacccuggugaccuccugucacucacugaggccaucagggcccugccccaggccuggacgggcccuccuucccuccugugccccagcugccaggcggcccuggggagggguggugugguguugggaagggguccugcagggggaggaggacuuggagggucugggggcagcuguccugaaccgacugacccugaggaggccgcuuagugcugcuuugcuuuucaucaccgucccgcacaguggacggagguccccgguugcuggucagguccccauggcuuguucucuggaaccugacuuuagauguuuugggaucaggagcccccaacacaggcaaguccaccccauaauaacccugccagugccagggugggcuggggacucuggcacagugaugccgggcgccaggacagcagcacucccgcugcacacagacggccuagggguggcgcucagaccccacccuacgcucaucucuggaaggggcagcccugaguggucacuggucagggcaguggccaagccugcuguguccuuccuccacaagguccccccaccgcucagugucagcgggugacguguguucuuuugaguccuuguaugaauaaaaggcuggaaaccuacagcagggcgaggccucggggggagagagaaugugugcguaugugugugugugucugucugucuggggcuugggcauggaccacacuuccguguuuggggugaacgugcagccccugccagcugcgcccuucagccugucugcagcuccaccuugcccuggacagacuccggucuguccgccccucuccuuggugcaggggagaaggaaaaggccagggcacggagacccagauggccuccagcaggccccaccucccaucuaccucuuccugccuccugccccugcucugggcacacacagcacagagauccucuaccccuggaagguucugguuccugccagguggccucagagaugcccaaggggcuagagagaaggaaccagcauugucccaaggaugcccuggugguccaguuuguccccagccaccuu

SEQ ID NO: 12812 - RNA, 12837 nt, Homo sapiens
uuguuucauaagugccucuucauauguuaugguuuauuucaaaagucgucuuuaggucugagauuuugauuauauguguucuaaaguccuuuucugauuuuucuguugccucugucucagguguaaguuuggguugaguggccuguuuuccuucacacuguguugcugcccugggcaggugauucucaguugugccuuaccuuuacaucuggaguuuccuaauguucugugcaaagcaucuggccuuaggagagaaacaccaccaauaagucccaguuagaguagggauggcagagaaacacucugggagacaagucuggacugaaccugucauggccugagggacuuagaaaaccuuauuuggaccuccagggccuagaaauuugcaugggucuccuucacuguuuuuucaggcuucagcuuucuaaucuaucucuguagaaaccagucuuucaucacgcuucuuuucccuuuuugaacaucaucuccuaccugccugacuaggcccuaauccccaaaaugcagaucucucucacauucuggccucagcuccgucguugucauuagugcuguuugccaucugcccccgcuuuugugcauauggugggguugcagccccugugguuguaggccccuuagaacuuccacugccagugugagccccucaacagcucucuuaucccuggcaaggugccuggaaacauuugagaucucuguucaucgguacggguccgagaguggucacauugaagagaauccccccuuccccugccagccugaggugggccugcagcaugagaaagcuuuguugugugagacgucugcgcuucauaguuguguggcuggagcauaacguggccuaauagagaagcuggccgcuaggagaggggugcugugcuaauaaaacgugcgaccugccaggauuuggaaugugggcaggcuguuagguggggcaaaacauuugguaaagcucaacugggaugacucaugaggcagaccgugagcuaagugugcguaucuaguggagagguugggaaacaacacuggccugaguaucggccggaggcugcauuggacaagggacugcagggaagcgacgagcuaaaaaaaaauucugcacuugcaagcuggguggaagaggaacaaaggucaggaacacaaggacuuagggcugaaagagcccuccuguguaccccacgggcgggcacagagccaagacagauuguggugagggugccauccuggauccagaugcccuccugcccccagggucaugacgcugggcacugcugcugaguuucccaaagccaggugucaggcacaggugcgcagcucagcagcguccggagguggcgcugugggcguggcuguaggcacguggaguggagucacccgcagaccacagagucauuucgagagcugaauugcaaaagaaagaagagcccaggaugaaagucugugacugcugggacuugaaaacaaccuuggcggggaagaggcugagaaagcaguucugccacugagcagggcuccuuugaggacaccaucaagcaugguuaagaaacaggaaagggguccucccaaggcuggagccccaggccacagagaacaugacuugggggagugggguguccacucccaggcaggggcccuagcugugccugccuggcaagacuuuagauggccaugcagcaggggcugccaggugcccuccauacccgcuuucacagggguuacugcagucauccuaucccugggugugaggggcaguggcagucuucuaguuccuaggucucuggaugggguggcgccucccccagaccugaugugaagaagguacaugaagcaacacauguagagacggccccagacccuagaccagaguugccaccgccacuggaggggacucauauguccuugggaggggaggggaggggcggggcauccagaacaggaaggagggugagugggacauuuggugacuggggacuggacagugaugguaucaggguuauuugcccagcaccuccugcccuccccacuuccuggcugccauguguggaguggggcugugacugggccuggccagcggguugggagaagagacgugcugcuucugggccacggcauguuggccaggugugcguggcacugagaugguggcgccacauccuuggggacugugaagggcagcgacaccuaucgccugggaaaauggaaaucucaguucuccaaaacaaaacaugccugucaccuuguacccaucuugggaaaggaucaccacugaggccgggauuuggcuuaagccacaggugaaggcccagagugaaggugacacauggcuuuccugugacauccagaggcuacucaggcccaggggguccagccaaggggcugggcaggauucggggagccugcucucgggcuuauguaucagaggagggggccacacccagcuccugaccagcuccaggccccaagucccggcaggccagcccacccuacacagccaggaagaugcagaggacaagagucgcgagaaagagcgcaggagaucagguuugcagaguggaaguuuaaugggaccaucaccgugauaccccaucacagcagucccaggcuggaggccccaggcucuggccgccucucccagcauggugggccuggagagagcaccagcaccaccucccacuuucccugggguauugcuuugccccugugccucccaccccaggaagcuacaagagacaggcuguccuguccccacacucucccuggguccugggacucccuguucugaggggcuaagguugccuggggccagagggcccuccccagggacaaccauccucucccuguguccccugccccccacacugagggaaugucuguguccuuguuccucugccaggggccaacugaggcugccaaccccaggggcggggugcagggcugugcggggaggguggcucagaucccugcaaggaggcgugcugcagggacagcacagccugggcccccggcagacauuaaggcacaguguggcggucaccauagggcugcuggggcccuugccccggggcggcaccuggcaggugcuggcauccggggcuaggcacagcugucaguguugagacaggaggcauggugugugcgggcuggccccagggccugcagugcaagagagcugggaguggggaggccagguccacaggucucugccagacacaaggaggucccucuccccauucucccugccugggagagcccaggggaggggcuugugggccugggcagagcucauggccagagccgagacgcagucauggcaggccuggcccacagaaggcacaauuguggugucugggaggucgagggucagcccgccaacagggcuaggcagacacauugacgucccugagagagauggcacugcugggggccucguccccaagcagcagggccugugcguccgagucugugucugcuucagccuugcccagcuccgugcugggcucugaggcgggcucugugcuggagcccaggcccugggacaggaucugcuggauggcucugcgcagguuggggugcagccggcccugcgucugguagaagaccuccagcgcgaaggacuugagggcaccggugcagagguccucguacagcgggaugguguacaugcgugacaucugcaggaggggcacucggucacacuggugggcuccccaggccccucgagccagcccacccugccagcccggccaggcggcccuccugccccuggcuucccagcuucaucauuagggcuguggccuggacuccgguggccaggaggccuaccauuagccucccaccuccacccugcccuuccaggccaaccauggaggccccaucuccagggaaccugggcuggagggagcacauacagggagcagggcagccagggcccacgggccugagggcucuggccucccucugaggagcugggacguccccucugcccagaccaggacgcugaaggcccagggcccagcaggcugugguggccuggacccuaaacuccugcucccagcuggucccuuccacaguuucuccaagaacugguggaguccaggcugcccucugguaccugcacccggugcaugcccccacucccaacagaccccuacgucuuccccgccccauucuccagaaugugccuggccugccccaagggcucagacuagggagucgggugggacucccaguccgcacggcuaggccguuccaggcuggcccccugggcaggugaccgcaccuggcucuccaggaagcgccgcacccuguggaggucaggauaguagucguugcggaccacaaucugcagccagcggaugcggaucucagcguucaucgaguccagcagggaggaguagcacuuggacaggcucaucaccaccucugcagcgcagggggcaggucagggcugggccgcuguugcaccccagccccugggccgcccccaucagcugcagggacucacccugcggcagcggggacccauccaggagccgguccaggaagagugcugucuggaagguccuccacuuggagaugucaauggcgcuggccgaggcagcugccugguccagagguucugcgguccacagcuggaaaagggccuccacgggccgggucaggcuggaucccugagacagguccggcucagccagcggcgggccuguggcauugagccagcgcucgaauuccagcccuagaggggagaagugacccuggggucccugcccaggcuaggaaggggcugccugagcaaucugcccaggagaccccagacccugaguguguuccaggcagguggccuguuccagggacgugggcuguucaggaaggcggagucagcuccagccagcacugccacuugaagccacugaaggggcuucugugaagggguacagggaagcagagacuuggguuggugaccaagggacucgcacccacuccacgccucuccuggguggaagacaaugaaguagucuaaacccaaccucagugcugguggaggccaccugcgccaugaaccagcaggggcgggaugggggcaacaggcucuuaagaugauauuccugcucuuaaagggcagugcccauucccuacccacaaaaagcucuugaugcacuugcuguaccuuccaaaacuuggugucaccaugcacagcccucccaguggcaccucaccacccuccagcaauucuggccucucccucaaugucugaacccugcagugccuuccugggccccaagcccucagacccucagggacaccuuuacaagugacacauaaacagggcuggcugcuguucuccagcuccaggacacccccgucacccgcccuuccugcaccaggcccuuugcacaccugguuuccauggcccgcuuccugggagugccugacucggccugcuuagccugugccaccggccccagggaggcccccaaccccagcccuguucucauagcauaccagccuggggcccacaugguccagcaaggguuggcugaaggacagacagugaacugacagggcuuuccuccagguggaguggccccucaggcagcagaggccccgccugccaucauacccacggcucccuggcugcaggguugggggucagccucaccugcccggcaguccacgcucugcuccuucagcuccgggaagaagcucaggaaggaguccagcagguccugggccaccacgcuggugaacuuguacuucuccacauaggccuguguggcagagguggggccucagcaggccuggaaggguggggcacaggcagccccaccagaggccugcagggcacugcagggcgugcgccaagguacgugcugggcacaggggcagcuagugggcacugcggagccagcacuuggcacgcaggcccugccaagggagcaaacaggguggcagaaggggagguggcaacccaggcacuccccacaaagaaaggcagacuaggucccagccaggcucacaggccccugccaguuccaccccaacugccgcaagagcaggcagcccugugagccggggaggggcugggggcagauggcagcagggccgucccgggcagggggcugcucacucggagaaagucaucaaagcgcugugggucuccgcagagcugggacagguaguacacgaagcaguagcccuucucguaggugaacagguucaucagguggcugggauucacuccugcaaggugaacacccaccugggcuggcguccgaaaccaccagugucccguggaauagggaggggcaguggucaggcuccgaggagcagcaagggccaagcgccacugucccucacauguccagauguguacugaugcccugggcgugcagcggcagggccucggggaagacugaggacucacacaccacugugacugcugcucagagccagggaagcggcgguggcugugggagccuggggaggccuugcccuggccaggggcucccagcuuggccuuggcagggguccaggcacagugcaggacagagaagccacagccagaacacacgaagggcaggcaaggaggccuugaggggugacauccccaguugugggagcggguccugaggagcagguaccuggcuccagcuugaccugcaguuugcugaccgggcuguccucucccagaagcuucaucugccggugcagggcguccaggcggaaggcagucuccaggcaggugaaggcagcaccuggaugggguccggagacagaggagaggugaggggguguaggggucgucgggggaagcaggaggugugggcaccugcagcauggcaggggggccaggcuaggcucucugccccuggaccagugcccagggccccccguggcugcccuccccggcccuggccgcaccguaggucucgguggugauacggcgcugggcauagguggccaggcccucgcucagccacaucucuucccacguggcguuggugacagcguugccgaaccaacugugggccaccucguggaugacaucgaugaccaggaacucaucgcucuccaggauggaggagaugaugaaggugaggcagggguucuccauggccacgauggggaaggaggguggcaggaagacaaugucguaccugcaccgggagggcggugaggguggcagaccucggggcucagacucccacccugcacacccgcaccccaccuuccacccagcagggaucagcccagccccugcggugagcuccgcuuccuccccaggagauggggacaggacaccccaggggucagacgaggggcucccccucugacuccuccuuccagccagccagguccacagguccccggggccuaccugccccacauguagggcccauacagccgcucagcugcacucagccacugcuccacugcgcccgacagcuugcugguggccgugggcaggaggcauggcucggcccacacgcggcuccuggugcaugcagagagggugagcugaggccgagcagccccagccccgcucaccccaccaggcucucccacugcccuggggcuccaguaacacccacaccucacccagccuggcugaccaccccagccuacagcccgcccugccucacuggaugggcagccacccuggcccuucccacagcagggcagagcugcauuccaggggccacguagcucauuuuaucucugggcugaagggaccaacgaagguaugagggugccaggcugugcgggggccuuggcaggaaggaccaguuugcagggcaggcacugggugggccaggcugccgggucugagggcacauggguggcagggcccuggcgguggcaccaaggcaggggcagggcuggcccagagcacccagaggccaguggggguccucagcagggcagccguggacacaggccacagacccccgguggggcucuccccgaggccugcgcagccccagaaggccccagcaggaggcccuaccugggcccgaugucugccggcuugaggucuccggccaccagggccacgagguaggcgggcacggggugcuccauguggaaguggaagacgccuucuuccuccauguaugcacuccggguggcacucaucagcaccugcacccccgauggcgccuguaaggaggccggacugagaccggguggccccaccgucagcacacccauagccccggccggggagccugucaggcagccccauauucguagcaggaaacccuacauccccaucagggaacguuucugucagagaacuucucuccgaagaacugccacccuccauucggaaccccuagcucccagccugcaaaccucgucccagcacagagggugcugccaaguucgggcccggugacccacagaccccacuggggaucagcagcucugucgggagaccccuugucuggggacccugcagugccacuggggacucaccccggguccaggaccccgaccccucaggcccguuggaggcagcccggcuucccccguucccugcaaagcggcuccucccauagaguagggagggugggcuccugcuagcacuguggccugcuggcagcuggggccacagcccaggcagguaggagcaagggggaggcggcguggccaggccacugggcuguccugggagcaaggugacggcagcuggcggccccugaccuugacgacggcagaguaggugcacuucacggcaggugugucgaagcacgggaagaaggagcgguugcacacggaguggcccugggugaagacgaagggcuuggcgcagccauaggucagcucuggguccagccaccagaucugugggcaggauggcccaucagcagacggccacccagcuagggugcugggcccuagccacugggcagcagccugagagaaggcaggaggcucugggaggggacaauggccagauuaucuugcuggguucgagggccaauagccaccccuuagccuucacuugccugccugggcagggagacauccagggcaggugacccaggguguggccugcacugugucaucagggccagaccccaacccaggcaggaggcccugugucagguagccgauaggggcaucucccagcuaacgccaaggcgaaaaaagggaauagcccaucauugcauuaucuuagcuuccauagggaaacugaggcacaguagggacacacucaguccaaauucccagcaguugauuuggucauggucaggaaaaggaggcugggauguggaaccugggaagccagagccuccugauggcuacgcacuagcaggcagcacgcccgggcccagagccacccugagcccaggcagccucgccuggagggacccugcaagagacaggcuccaagccaggggacagcaagcagggaguggaggccaggccagaggacccugcuggcaggggacaggagcggccaagggaaggauggcuggggccgcugccuggaggccgggggcugcggugagugcuguggaaugggugcgcucacagcagcugcuacccaccuaaggucacccccccggcaaaccucucaucugcaccaaagcuguugaggcuuuccucaccccuagaugccgaggccaggccccagccccacugagaagccugcacacccggggcccuccugccacuauccugcugcacccgucucaucuuccuuccaggaauucugaccucuccagugagggcagcucagagucugggagggggacccucuuccaaccacagccacaucaccuucgucccaagucagcccugcacgucguauccacccuccccucugccggaaugagauagucaaggcaaacugaauugcucuucgugcagaggcccucccaugaccaugaguagaaggugcccccaacaugcuucuaagacuggacaaguggaauccacagcugaggccuggaggaucccagaccaggagggcugccucccccgcagucccggccagaccccugccagcauucucagaucucuuccaaacuuccuguuggugcccuggcccugcugggcagcaagguagcacaggcgucucccauuccugcugagcccugggcugccaggguguucagggcccaccuggggagccauucacaaacgcagccucccccuuggggggggcugggaccugggaaucuguaugaaggaaccucccugcaggagucuccccaacccuucagccugcacggcccccucacaacuacuccucuccuguggccuugccucacccuccugaggcccuucucaggcucugcccacucacaccucucccuacugccccauguccaccccacagccucaguagccugggugucuucccagauaccagcagggcccacagcuccccacuugcccugaagugaggggcuggggcagacccccagacaggacaggcccugccccacagauggggcaccaauccccgucagggcacccgggcacaggugcugaugggcugguggaaaaggaacaaggcugaagggcuccagacgcugcagggcaggaagaacgcuguucuugcugggguggggugggggugcgggaaugggcccaagcaucugcagcaccuccaaaaagccucugggggccuggggcccacuggcagggccucccagggagcuuccgcugcauccucccuggcacagggacaggcuuagggauuugggccugagucccuggaacaugcaggaagagaaggggacucuacguguggccccagccccauggcgcucacauacaaaggugcaugccugagguuagagucgaauacucugccuucugcaaguagggcggcucacaggccaggugacgcuaggcccccuguccacagccugccaacccugacaccacgcagacuugggggacuaugccacucucccugcccagaguacccaagggccacccaguaggccauaggaagccaagagacaauggccacccuugcucacugggccccguucacagcagccugcugagggcccugguccggccacucugcaggccaguguugggcggaccagacacgugggcuccaaacacggaucaaggccaaggagaagcccaucccucaguucucaccugucauacugggaggcauacuugccaccggucagagcccuggaauaccacagcaggggcggggccggcuagccagcggccugcacacccacagggguucugggaaaaaggugagguggcagguccugcuuagggcuccugggaaauguacaggaagcccauaggggugcacuggucuggguucuuccugcccagaugucaccuuggcucuuuguggccugaagccucucgaccaccucuccaccacccuguccauuuaugugccgugaccagugacagcuggacuucccagcgccuccacagcugugugugucuugcauaugucgggugucacaugugugccguccauaccaccuagggaugcaguaugaacccccaugcuguaggcaggaaaggcccugcuccauccuguacacauccccacugguggagguggagggggugcugcagccacagcgccagccucagccaccuggccuuucuugcagagucucuggagugguggguacccagugugcaagcccugcagagccuaugugugucuauguuggggucgcggggcccacuggucucaacacuccaccagugcuggccaaggaagccccaaaccgagcaucacaaucuccauggcccuuuccucugccucuggcuuggacucaucugcacgcacuggucacauggaggcccuuccgcagcugacacuccagcccaacccuuggugccaggauccugcagauguacaccucggugggugacagaagcugcucauguccccaggcagggaccagacaccugaacgggaggcuucccggagugacaugcugucccguguccccgcaggacuccggcuucuauccgaggguccuaagggcucacaggcaacagcugggaaucaccgggguggggggaggggggcaccuguagggcgcagauucgcgucccucagccuggccgugcggcgagaggccgcuagcagcgcccugcggaccggcccgcagccccggcgcccgccccggacucacggcgggggcgucggucgagguguaccgcaggaugaccuggaagggcuggugcgccugcagcucgggcggcagcgugacggugagcgaggagccguagucggugaacggguccacccugaaggccagcggacagcaggcgggcucggagccgggcgccucggggaaggcgggcagcgggggcggcggcgcgggccccggcccgggggcggagaaggcgaaggcgcagggcgucucggcggcggcggcgggggcgcgacggaaggcggcugagugcaggcgcagagccgggugcgcgucgagcacgagcgcgcggggcgcgggccgcagcgcgcacagcucgagcaccaggcagccggccaacucgcgcgccucgggccgcagcuccaggcccagcugcagguggcggaggcggaagagcugcgcgcuggaggccgaggccacguccagggcgggcggcggcucgggcggcgggcggacgggcgcggccucggcgccgggcgccuggcggcagcagcacugcgcggccauggccgccggcacuaggugaaauccaugggcggcggccgcgccgggccgcgggcgaggggcgccgggcggcggcggcggcggggcgcgggcacaacaggaagucgcgccgggagccgcccggcccggccccgcgccg

SEQ ID NO: 12813 - RNA, 10373 nt, Homo sapiens
cggaagcccauccaccaauccucaccucucaccucuguguccgcccugcugggaaauauuccaggcuuuggccaaggccagugcagccccagguucccgagcggcagguugggugcggaccauggccucucacaagcugcuggugaccccccccaaggcccugcucaagccccucuccauccccaaccagcuccugcuggggccugguccuuccaaccugccuccucgcaucauggcagccggggggcugcagaugaucggguccaugagcaaggauauguaccagguaggagugggggucacucggggggccugggucucacccauguucccacccacagaucguggacgagggaagggggucacugccuccucacuuggggaggcggggagccugggucucacccuauaccacccgcaugcagaucauggacgagaucaaggaaggcauccaguacguguuccagaccaggaacccacucacacuggucaucucuggcucgggacacugugcccuggaggccgcccuggucaaugugcuggagccuggggacuccuuccugguuggggccaauggcauuugggggcagcgagccguggacaucggggagcgcauagguaagggagaggcccagguggggauggcccuggauccauccuucaaggccucccuggccucccucuguuugaagcuggcagcccccguuccugggugagcgcuuacccaccuuguggcccugugcgcacgaaccuccugccagcccacugccuccuccaggcggugucgggcacucaugaggccugacucugauagggcugggagcagcacaggugccccgauccccccagucuccuugagcuguuucuggagcaugugcaggacggaacuacagggaagccucuggucccagcacacacuccugagagccccggccgcuguccagggccccaggcaccagcucugcuuugugacagggugggguuucagaagcugaagccuccccucaaaucucagcagccuuccuucuggaaucuugaugugauacacaaaauauggagguaugggcagaguauucgccuccggaguacacuuuucugggagagacacaggagcaggagugugcccuggguuuaaugauugauuguggcauugagggacaucagcuuggugagcuccacaauggccaugcugguuaauacgcgaccgcaacagccaagagggucccaaccccaaguccacaaacuuuucaaggggacccagggucggcagaggccaggaccccaaguggacaucagggcacgcaggcucagaugccugugguauauggcuucccuuuuccccauucuguccccuuggccgcagguucuuccccucccacaaccuggcccugaacagcacacaggauagggcagagacagggagggggugagggccugauuccuggaguccccagcuccaacagaggucaaggcugcugccucacucaccccucauccuucagucugucauccaucacaccuguggugugccagcccuggaccagguacacucuuugugccagcccugggccaggugcagcccugacucccgggagcucacucucugcuuggggaggcacuggucaguguggccugagaaagggcauuugagcugagcucugucaagagugccccaggagcguuggcuccaacagcaggggggucaagauggcccuggcucuacacacagagaggcucucauugggcagaguccacccuccucuucaggcaggcagccagggugccacggugggugggguccagcccucacagggcccugcucagcagggccacgggugcccaacacuggcuucuacagugugugcgggacacucacggcccacucuguccugcacccaggagcccgagugcacccgaugaccaaggacccuggaggccacuacacacugcaggagguggaggagguaggggacccggggugggggucagggccgggaggaggugggagugggcaugcuggcucaggggcugccuggaauuggccagccagcagggugggaucauggccgggaggcugguggcugacccucagcccauccuagcaucuggugagcggccacaggggaggguuccauuaccugggaauggugggaagacugguaaggaggcuucugucuggcagggaaacugagucaggagccugguccuguaggcagggccagagaggcuggaggcaggaggccgaguuggagucuaggcugcagaacaugucccugacacucaggauaccccacccugugggcugaagucaaccucagccuacccggaguguggggacucaguccaucuagcaacagcccucacaggccaggcaacaggcugggggcacccuccuccaucucugcaccaaaguccuguucuuggaaaagcccuugucccggagcggagaugccccagccuccuccucccaugcacaccaucagggaggaguagaggcaggcccagccccugcuaccuggagcugugccacccaugggggguuuguggggguguucuggccccugccccucugagcuccacccacagccgucccugcuuccucagggccuggcccagcacaagccagugcugcuguucuuaacccacggggagucguccaccggcgugcugcagccccuugauggcuucggggaacucugccacaggugagccuggccccagggcgguggacuggagcacagcucagagccaggcuauggggaggggugggcacuggucccucugguccuucugccccugguccccaccccagccucugucacaugguauggggugcaggcaccucccagguccucuuugcucugggcugagucuaaagacaaccccaggucccagggcaggcucaggugcucccuggccgagcgcccccauagugcccacugaccucuguccccagggcugaagagggcuuggugcagacuuccauaucuugccagggccuguccccaccucaccccgagauugccaggacacuaaagcugccugaugcccuccacuucccuccuccagccucccucauccccgcaugggggugcacagggcaaggccuugaauggagucagaugggauuccugagaaaugcggacagagccccuugggacccagcagucccgucugcaggucugagcacaggacagaggagagaaacuccacggccagggaggguccuucugacagggcccccagcccagacagcuugcugcauggaccguggccaugaauaaagcucacaaacauaaccuggccagcuucagcaacacccaggccauccccaccugcggccagcacgagauacuuucugugucucuuuuuucuuuauaagaaaaccuggagguggaggagggugagaguuugugaacauggaggcggaggagggugagaguucgugaacaugcaggcggaggagggugagaguucgugaacauguagguggaggaggauaagaguucgugaacaugcaggaggagggugagaguucgugaacaugcaggaggaggagggugagaguucgugaacauggaggaggaggagggugagaguucgugaacaugcaggcggaggagggugagaguucgugaacaugcagguggaggagggugagaguucgugaacaugcaggaggagggugagaguucgugaacaugcaggaggaggagggcgagaguucgugaacauggaggcggaggagggugagaguuuguggcgcugcugcuugggcuguucugggacucuguccccucuggccuagauucuggccaguggcugggccgagcagcuguuggcagagguaggcccagccuggugccacccuggucccugggguccacacaggcccucaggcacccgcugucccugggaaccacagacugcccggcugacccucuucagcaccacugccgggcccugcagcugggucucaccagggccgugaugcucccucacucccccagcucccucugcuccaauguucagggcugagaaaggaagagccacagguccugauggauccugacaggcaggagaaggcaacuggccaacuccugggguggaggugggaggugcccugccuuccuugccagccugaggcucagaaaccccauccagccuggggccaggcccuccaguggcccccugccucaccugcugcccuccauucugucccccaccucuccagguacaagugccugcuccugguggauucgguggcaucccugggcgggaccccccuuuacauggaccggcaagguaagggugggcucugagagcccuacccagcccaagcagccuuggggcuccgcgugcaggaagcccugcuggaagcgugcguccagcagccgaugcugcggauucggccccaucuccaccaggcccagggaaacacucacuccuuacugcggcaagagcggcuccaugaacuacccagcaccccaguguuuccacugagcuuucagauccaggcguggggacuggcaggagggacagcuucuggugggggacauuugagaugccccagagcuguagcagaagcagugggaagaggaagggccagggcuccagucaaucaggcguugggcaccccucugcccaaccccccagaggcucaguuucacaucugcccugcgcccugccaggcugcccauagcagugagcaccacugucagggucaccucgcagggaaccucaaccaggccggccgaggggccaaggagccuccugugcccauccgcuuacgggagagagccugcacauugcauccacugcggugccugcccacccacuccaugggagccugucuguuucugcagagccccuccugauuugggaguucucaggcaggaagggagggauuucugggcugauccucaaacuacuacugaaagcagggaccuggggagggccccagggacacggugccugggguggcagggcugucccuggggaccagcacagcagagggagaagcugcgcuaaaacgcucaggccugaggucauggcugccacgcagcagugcccagauuugaacccaggacucccuuccacaucuccccugcuaucguguacggauucgugguagggucguagccuaccagcccauuagcuaggcaggcaucccgcuggacuggccugcccugaggugggacucacccgucccgagcaaaccacccaucuacaggcaucgacauccuguacucgggcucccagaaggcccugaacgccccuccagggaccucgcucaucuccuucagugacaaggccaagugagugacccacagacccucaccucugugcagggcugggcuugcagggagcucagguggcccgaggcgggaggggcgggagccaggcaggaagggcuccccaugcuccuccagcaccuggcgcucucccgcccacccucugggaggccaaaggcacugcguucacagggaguggggaggccgggcgaggggagggcugcaggcgugugcagggugcagaguccacugcucuggaaguucccagcuucacagcaaggagugaccaggaaaggacugagggccugaggcccagugcccugaccggccucugcccuggcucagcuuccaggggcugccccaagggacaacgugggccacacacagugcccccugcagucccaaucucaccucccgcuccugguguccagauucugagccaggccgggcaggggguaggggaagggggccagaccucacaggcgguucccauccagcugcagccuggcaacuggaggugccguuccccagaacagagaggacuucggggagaagucaggaauucgguguuggacgugggaggucugagaugccagcuggaccacacgggagggugaaggaagcggcugggugugagucaggagccuggggagaggccggggcuggccccuccaucuggaguuguagagacggacacauuuaaaguuucaagccuggccaguguccccuggggcccgaaagcagucaccuuugggugaugugagaaaugaaggcugacccuguaggaggggcugggggagagaaaggggcacacagaguggagggagcuggccuuggugcccccauggcagggucacacagcugggcccaagggccagcgggacuggacagcugagggacccacgacccacccggucccacucuggccccugagcacaaaugcagcuggggcgggcccuccugggggccccaccccgucucacucccgugaaacaggacagccagcgagacugcccuggccuucagcccaaacugagaggcuggugcucagccugcuucuuucuccccagaaagaagauguacucccgcaagacgaagcccuucuccuucuaccuggacaucaaguggcuggccaacuucuggggcugugacgaccagcccaggaugugaggccuggcagggaugggaagguggagggcgcugggcauggcugagagguggggcgcuggccucucacugcacucagggauucuccaagccccccaccuucaugccucaagaaccccaacuagagccccagaauccgccugcaucaggcagucaaaugccccacccuggguucccccauuccucgacuggcccgaggcucugggcagggucauggcccccacugccgcuuccacaaacacuguccccccagaggucccagcacacccucgggcacuuuggaccuggcccugccacaucuccccacuccugggccucagcuuaccccuucugaaaagacgaccuuggccauaaacccaaggccccuuauguuacacacaggaacaaggcgccaggaauggugcccuagcccagugggcacagagggccagugccggcuucgcaggcacgcugggacugaggggcuccgcagggaggugguggcacgugucucugcuccugcagccacccacugccuccuggcugggcccuacacaagccaugcucucccuggcagacgaagcugccuucccgguccaaaguucugaacccggacaggacuccucugcggaggauaccggccuguggucagagagccugugcuguuggggcuggggcagacagagcuaaugccccaucugcccccaacccugcccauggugcuggaccaagcccccucgugucuuccagguaccaucacacaauccccgucaucagccuguacagccugagagagagccuggcccucauugcggaacaggugcaugggcugcacuccacaggaggagacagggccacuggcuggauugucgagggcgcggccugcagagaaggaaccaucccuggugcacagagaaaagggagccugccagagagaggcccucagugggggugggggagagaggacagggccccggguacacuggcugcgggcagggccagggggauacagccccagggacagaugcagcaauggggcagguguggaugcucccaacccuuccauugcugugugaagcaguaagugaggcccagugagugggugggcugggagaaggggaggccgaaggggccagagaugugcccacagauaggugggcguggauguaaagugaggguuggcaguuccugcaggcuuguccagcuccuauggcagggcaagagcugagcaugagcacuugggugugaccagggguugauuuggccacugcaacauccacacucucaggacacugcaacauccacacucucaggacacaggcggcugagaguggccucaggcccagcagcucugcaggccacgagacaggaagucccaccuacuuucaucuggguccugugucccacagggcccauugccagccaccaguccagaguccaggaaggauccccgggcugcagccagcuucccaugagguugcaaggccgugccugccacguuuguccuccuggguccacucauaaagccacugccuagggcuggguuagugccagggugccccuguaagcuaaaugccacccgcacccgcgggggaaggcgaggggucaggcgcucacacagggaaaggcucuagggucguaaagguggguggggggugugagcugggcagagaaggaagagaacaggaccagacagcagggcacagucaagggcagaggcacagggaccuggcagagugcagauugcaggggcacaugcgcagagaagacgggccagggccagaguagagagcagcugcugcuccggggacccaccugggguggccaugagagcugguggcuggaggccgggaggacccgugaccagagguaauggcacugaggggcccagggcuggagagaccaccccucaccuguccagagcugaggcaggagcagugcugcggaggaugccaggucgggggagcuggcccugagaggagagggggccugggagccagcacccugagcccuggcccugauccacuccagcccuguguagcccaacagcccuuccccuccuugcccaguccccucccccugcaaggcacucuccacucuucucccccaggggccacaggcagaccuccccucugucucucugaacccuccucugucucucccagacccagauguuuccuucugcccugggguagucccaggcccugccccaggcaaagucaaacugggggcuccaggggcuccccugcaccaaggccugcagagucagguucuuccucccgcaccacagagggcggggcuuccugcccaccccacccaugucacugcccaccagcgccaucucccacacagggccuggagaacagcuggcgccagcaccgcgaggccgcggcguaucugcaugggcgccugcaggcacuggggcugcagcucuucgugaaggacccgguaaggaggccccuggcauugggcagcccugcacccauggggaaggaugaggggcucuugcccagcccccucaagagggacacuggcuccugagaaggagggggcggcugcccggugguguggccucggugccagggauuagucucggcaggagccacgaagucacagcucccggccucugaugcgggaucucaggacggccugugaucucccagugggaaggugcccauccaccgccuccuaagggguggggucccugcucucucccggcccuuucucccccggcuccucuggaaccugaagcuggggcagauggugcaggccaagagcugucacaaaggcccguacagggccucucacccacgcacugagccaggccccuccugcaggcgcuccggcuucccacagucaccacuguggcuguacccgcuggcuaugacuggagagacaucgucagcuacgucauagaccacuucgacauugagaucauggguggccuugggcccuccacggggaaggugagagggagcgccucgagggccuuuugcagaaaccaaacccgccaccccuccuugagcaggacugugcaccaggugcaggggaggccggggucauccgaaagcccagauugcaggagcguccagaagggcccacucuccaagggguauccaguaaagcguauccugucgccccugcucccaccccagcccacugaggucaccaggugcagccuuuaugauuccacucggaacauccuuccuucccucugaccagacccuggaaccaggccggaagccccacgccugggccuggcugugucucugaguggcaguggggagggaccuucacugcaccacccuguccucccguguggcugcgggugcagagggaggagagccugcccuggccugggugcucaagggcccccucugugaccugcacagggcugucaacuccccucauggacgcugggugggugguccucacucaggugagcccauccuggcucuggccagcugucggucagggucaggcaggucccaggcgggaggcugacgucagcccgcccugugccccccaggugcugcggaucggccugcugggcugcaaugccacccgcgagaauguggaccgcgugacggaggcccugagggcggcccugcagcacugccccaagaagaagcugugaccugcccacuggcacacagcuggcacuggcacacaccugucccaugcccacccugagggaucaggagcaaacagacccugcaagguccuccaggccuggggacaggaaagccacugacccagcccgggaggcagaaccaggcagccucccuggccccaggcagcccuuuucccuccaguggcaccuccuggaaacaguccacuugggcgcaaaacccagugccuuccaaaugagcugcaguccccaggccaugagccucccgggaauguuuaauaaagggccuggccaacucuccu

SEQ ID NO: 12814 - RNA, 9239 nt, Homo sapiens
agaaagaaggaacaggcaauucgcgaaguuucaccuguacucccgagcuguuccccaggcuccagacccacuugagagcagaagguggagcucaaugaagggucucgagcucagcgaagggucacugggugaacugagagaaaccacguucacaaacgcguacugcggacuuccugccgcccugggaccugucacuguuuguccauguaagcuacagcauuacuagcagaugcuaagaucgagugauaucacuggaaaaguaggugaauccuacuaggaaacuuucuacucccuacuaggaccucaagccccucagccacacagcaaaugcuaauaugcuccaguguuagcuuagaagccuugugucaacaagaacuggcuccugagucccaagcuuggugccacacagcaaaugcuaauaugcuccaguguuagcuuagaagccuugugucaacaagaacuggcuccugagucccaagcuuggugccacacagcaaaugcuaauaugcuccaguguuagcuuagaagccuugugucaacaagaacuggcuccugagucccaagugcugucacaggacuugcccauugggauguuuuccacauuaaauaucaaguaaaaagacuuccuggugcucaggaauuacaguucguucuugaaacauuccaaagaggccaccacagcuuuucccauguggcuucuuuuaaaaacucaaauggcuuccuugaaaauacucaaaguccacccaaggaaauuaguaauaauagaaucagaaaacugucaggagcauaaagauuucuguaucaaaaugaaagaagcaauccugaguugcugaauuacccaucugcuaaugaaaccgggauggacugaucaucuaaccaagugcagacugaggauucuacuuaguccuccgacuggguacaacaacagccuagguucuagggaggguggcagugaccgggaugccacaauggaagagaaaaugaaaacacuggcacagugaaaugucucauuuccaaacaguuuugccuauggccaagcaaggcaauaaagacaaacucucccuuuuccccauugcgugugggcugccagguacaaguaagggaaucuuugcugugcccacuguccuccaguagagaacccaacaggcaagggccccacucagguaucagcucaccuccugcaccuccccuuagcaggaacuccuuccacuggcaaaggacugccacugccaucugacucaacuguggcgauguggacggagucaccgagcugcuuuucuuuugcaaaacaaaagucuuuuucuuugcagucacgcuguaagacgaggcugcuggagaaaacaaaagcaccuagauuucagugcugaauccccacaauugcaugcagcucacaccuaccagggguauuccagugcauaggggaaaggaacccggcugaaaaaccagcuccuuauuuuucuuuuaaauaaaauaauacgauccuaaguccauuuaccaucugaaguugucacgagugaacagucacauuacuguuguggaccaggccuuagaugaguuucucaggcucagcacugacauucugggccggaucauccucucuugugggaccauccugugcacugcaggauguuucacagcaccccuggccucuacccacuagaauccuacaaucuaccagauccuaggaucuaguugauccuagaaugcuaccaaggagacuugaauuuuggucccaucaucaaaaaugccuucugcaucaauccuaugccaguuuccccuaaaagagggcuaacuggaauguucuaggauguaccaauccuccaggacccucuuagagcucaugccaucagagacaggccucuaucucagggaucaccccggcugacaucaaauuccucuucucuuuucccaacauuucaaauuguucuucggacucauugaguucccuaaggugacacgcccccccccccccccacacccaccuuggggggucacggauugcucccuguggcccuggcuucagcccaccugcuccaugacccuaugcucuucuccucugguucucgaagcugucuguaaccagggcaggggagauaacuguaugggaccauucccuggccuccaccugccccagcacucuccaggccagcacagucuggcacuacagacuacagggccggagacaccaggcuuggaagugaccacuggccaagagcugacauaaaagccaacuuccccaaacaggaagggccuguucuucacaaagauaaagaaaacugccagcauuuugcuggccuuaagaagccaugcaaaauuaaccaguacaucaugaauuaacuucuuuuacucugcugugcacugaauaccauuaugaagcaauauacuuuuggauuaaaaauaagcauuuuuguggaaaaucugcuacauguuuucauaaaauaaagugcuaugauguacuaaaaccucacauugccuucucguaauuuuauuuuuaucacaagaaggaaauacauagugauuccugaaccggaagaaugaaccccaucuuccaacugucacggaauuaucaccaacauauucaaaagagaaaaaaauaaaaccaauuguugauauauugaguccccuugaugugaauagcucaacauaaguaucuuauucaggaugggacagggcccuccccacagacacgugacaacagaucaaacaugcauuuccuguuuccuguuugguuugaucugucugccucucaggugacuuauaauuuuuuucaucaagagaccaguuuuagaauaaaaaauaacuugagaagauucaaguaaaggacccaaaagcuuuaagagaaugaaaagcuuccuugauaucucugggcccuuucgcucuaguccuuccaucacagcuauuccuccucgucgucguccucauccucaucauuguccuccgccucgucgucguccucaucaucgucauccucaucauugucauccucaucauuguccuccucaucaucgucauccucauccucauccagacuugcccuuuugucaucagaugugcugcucucagacuccuccuccucccgagccaggagcuucuuaaaaacuugaaacuccucaacagaaguacaggcuguccuggccaaaaacucagcuucugaaacucugagaauguccuugagcaauggguuagggaucugugucugccccuucuuaucagggguuugguaccgucccaggcgcuccagguaaaugugucucugcuuaaucuugguuagugaauacugcaaguacucacucuuuacaaugucuggaugcuuaauucccauccugaaguaugcauacuggaagacacaaacacacuuaggagucccagauacagaguauugaaaccuaucauucuauaaaccauaaaaacuuaaguuguacaaaaggauucaaaaagaauugccuaauugacaacagcgaauacccagucuaggauacugacauuugugugacagccagcaguuucaaaacacuuucaaauucauccugagaaacauggagcaggaaauaaaggggugggagggaaaaggggcaggagggagaaggggcagaaggaagaggugguauuuuucuuuaaauggggaaggaaaaggaugaauauggaaagaauaggcaaaacauucagaaaacaucuagaaauucgaccuaaguugucauaauuauuaccaaaaaaucggacaacuguuaaaauuacauuuucaaaaucaacaugcaaaauagauucuaaggacaggaagguuucagcuauuuuaaaauuagcuauuucagaguccccacuuagacucuaagaauaggacuggaucauucauuauuaauggcagaaaaguugaagaauagguuugaucuguaguaaagaaauuaaagauuucucuuuggcugauguaugcagagaaucuagucuuucacuuccuccacucaaauaugagguguccgaggcuucuuauccauauaacugaccuucacuacauuugaaaaaccugagaaacuugcuguuacuacacuaaucacgguaccagucauucucaccugaaacuacgcuaaucccauuaccagucauucucaccugaaacuacgcuaaucacgcuaucagucauucucaccugaaacuuguauuccaguugacccagguccucucgaagaacagaggggcaacugugcaaaaucuuggugacuugcuguaccgugaaaaggcacuucuccuugagaagccugacagugucguuaauguccugcuggcgcauggugaaaauuucagggcaacaguaaagcacccucuuuaauuucccugcagaacauucaaaaaaggcaagcauauaauuucaggauacuccagaaacucaaggagcuagcugcacccaauuuaaguccacauuuaaaaacaaacaaggauccucuccuuccacagagcaaguggcaauuucagaucuaucuucccagaagcaccauggaaaugauacaucuccccacugacuuccugacacuccucagacucaccauccuucccucccuauauuccugcuuuauucuggccucccaccugaaaggugccaacuuuguauuuugggucuccucuugcccuccucacuuggaaaagaauuucccaggcauuuacuggaaagaucagagaguaauaugggagaguaguuuccuccauauugcugguuuggguugauguuuccuucuauaauaaaauagucauugaagcauucacaacuaacauucucaagcugaacucaaugaaaaggaguuccaucaccaucgucaucauaacaguaauaacaauaauaguaaucaugaggacacacaacaccaaugcugacguccugguuaccagggucaccauauaucuucuccaagccagggcaccuugagugaaagaggcccuauuaaaaccgcacuaacugguguaaacugggacuauuccaggccuuccuagggauagcugagcaaaauucaguaaugggaaacuuaaagucaacuauuuaaacuguuaauuaaaauuuuccuaacauuugaguuagugauuaucuuaauaugugaggaauuucaguuuagguuuaucuucauuucuuaaggcugugcugaguuugcuaauuaaucaccaccacacauaauauauuuagacuuuuagauuacacuguaagaaucuguuaagaaaaauauacaaggcuaccuuuuucuuaucuucuagagaaggaggccuguagagaugcugugaaaugguggauccuaaaccuucuaccacugccucaaaaaacaucuuaccaggaagagucaauaaugcaaagaaauaauaguggaacuccucuggucaaaguggguaaggguccuuggagacccccaacuccuccagaaggcccuuaaagagauucaaggaacuuugagcauccuugagaugugaauauuguugggggcaggagugggggauaaauagaagggaaggccacuccacgaguaucccaggaaccuggccagaucucucauguuccagaguaaaucuaaacacucgacuagaaucuaagucuuuacaagagauguugguuugacaucacaucacagagacagagcacuaagaccauuucauguugauuuaaacaucaaaugcuauauguacacauauuuaucaacaucacauuaucagcaucaacccacugaacacauaccauaugcccaccacugcacuaggugcugaagaucccacggugaacaaggcagacaagagucucugcccuggcacucaauuuuuucuucuagucuuaacuccuccuccuucccucucaaaauguauucugcacagaaagccacuccuauuccucaccuccaagccaaauuauacaguccucuccaggaacacugacauacucagaaaccuccccuaauccaucucaccuuaggcugcucuuuccccaccucuggcuccugucacacuauauaaaaucuuuuuuuuuuuuuuugagacagccuugcugucacccaggcuggagugcaguggcgccaucucagcucacugcaaccuccgccuccuggguucaagcgauuuucaugccucagccucccaaguagcuggaauuacaggugcgugccaccaagcccagcuaauuuuucuauuuuuaguugagucaggguuucaccauguuggccaggcugaucuugaaccccugaccucaagugaucugccugccucggccucccaaagaucugggauuacaggcaugagccaccgcacccagccaaaaucugcaacuucuuguaccuucuccaagcccaagcuuuugcagguaacuggagcgcuuccucauuugcauaauaggcaguuucaauaacuggggacuuuucuucaagaccacacacacaggcucuggauucagacccaagagaauaaauucugaaaugauguccagcaacuguugaagacuggcaccucgccguacacugagcaauucauuaauaugggcauugcugaaacccauguccaggagggaacucaugacccucucuagcuccaaggacccuuguaccacaggaguccccugcuucucaaggaggcacugaacaagauuccuccugcacucugguuccugcacauaguuauuggaucuaacacaagauaacuccucaaugaccccuccauuggaggcuguagucaguuugcgcaacaaagaagcugucguccuucucuguucuccaagaugaggagucugccuagccauacaggcccaggugagggggaucaggcggugccaaucaaggaccuguaagacacaggaccaaaagacaauuaauuccucacuauuccaguguaauggacaccauaagacuucugagccagaguacuuacugccuugguuccacacaaacauacaauuuuuauaagcaaucugcaaaauccuaucugaacuuaagccuacagagaaggaagcucacaaagaacaggguauuucaaggccacagagaugggagucaagcagguacaauauuguuagcuuuugcagcuuuaaggaugggagcagggacauggaggaagagggaaaaacuauuucuaggccaccuggucaugugugccagaaaagucuggaccucagacuacuuuccagauucauguucuuaaauucauuccacgagaagaaucuugugggauacagaguuggcccuugaacaacaaggguuugaacugcuuggauccacuuauauguggauuuucuuccgccucugccacccuugagacaccaagaccaaacucuccuucaccuccucuucagccuaaagaccuuaugaggaucuacuuccucuuaaugaauaguaaauacauuuucucuuaggauuuucuuuuuguuuuuugagacgggggucucacucuguugcccaggcuggagugcaguggugcaaucauggcucacugcagccuugacuuccccaggcugagguaauccucccaccucagccuucugaguagcugggacuacaggugcacacuacacccugcuaauuuuuguauuuuuuguagagacgggguuuugcccuuaugauuuucugaauaacguuuucuuuucucuagcuuacuuuaagaauacagaaugcaauauauauauauacaagauauguguuaacuguuuauguugucgguaaggcuuccagucaugaguaggcuauuaguaguugaguuuuggaggagucaaacguuauacacugauuuucaacuggugugggggcggucuggugccccuaaccccuguguuguucaagggucacaguaauuagucaacuugcauacacaauuccaguugaccucaaaagucuucagugguucaggcuggugcuuaacaaacuaugcacaaaucauccaggcacucuaagccagcagucuucaacguuuuuggcaccagggacuggcuucauggaagacaauuuuuccacagacuggugagggguuucaggaugauucaagcauauuacauuuguugugcacuuuauuucuguuauuuucacguuguaauauaagaugaaauaauuauacaacucaccauaauguagaaucacugggagcccugagcuuguuuuccuacaaccaggaggugccaucugggguugaugggaaacagugacagaucaucgggcaucagauucucauaaggagcgcaaccuggaccccucaaaggcgcaguucacaauaggguucgcgcuccagugagaaucuaaggcggcuggucugacaggaggcggagcucaggcgguaaugccagcgaagggagcggcuguaaauacagucuggcuggcucacuugccgcucaccuccugcugugcagccugguuccuaauaggcaagggacgguaccggggguuggggaaccccugcucuaaaaccuucacaucggucccaaccccuucuccagcgucaucgauugucgcccuggggccacccugccaagcccaagcucuggcugcucuccagccuccccuguccagaugcucccuccgccaggaacaccuggcagucgcuggggucagcgggcgcggcccguggaacugggcucaagccuaaagaccucuaugcugauuccgcuuccucuuaaugaaaaguacauguuaucuuccuugugaaguucaaacucuuguucaacagucaacucaggccgggcgcgguggcucacgccuguaaucccagcacuuugggaguucgaggcggguggaucaccugaggccagaaguuacagaccagacuggccaacacggugaaaccccgucucuacuaaaaauacaaaaauuagccaggcaugguggcgggcgccuguaaucccagcuacuugggaggcugaagcaguagaauugcuugaacccgggaggcggagguugcagugagccgagaucgcgccauugcacuccagccuggagacagagcgagacuuugucucaaaaaaaaaaaaugucaacucuauaucccacaauaauugagcagagccacggguccaggaugccaaaaccaggucagcgugcacggaccuccgggagggcuccacgaccuggccgugaaacacucggcggccgcgguuccucugcgucgcugcccgcccgccugcgacccggagaagcccgcgcgcccagcucgagcuuaccugacggccgaacgcagccauagcgcggagaagauggcagcaguuacggcgccggaagcagcgguccucccccguccuucacuuccgg

SEQ ID NO: 12815 - RNA, 9239 nt, Homo sapiens
ccggaagugaaggacgggggaggaccgcugcuuccggcgccguaacugcugccaucuucuccgcgcuauggcugcguucggccgucagguaagcucgagcugggcgcgcgggcuucuccgggucgcaggcgggcgggcagcgacgcagaggaaccgcggccgccgaguguuucacggccaggucguggagcccucccggagguccgugcacgcugaccugguuuuggcauccuggacccguggcucugcucaauuauugugggauauagaguugacauuuuuuuuuuuugagacaaagucucgcucugucuccaggcuggagugcaauggcgcgaucucggcucacugcaaccuccgccucccggguucaagcaauucuacugcuucagccucccaaguagcugggauuacaggcgcccgccaccaugccuggcuaauuuuuguauuuuuaguagagacgggguuucaccguguuggccagucuggucuguaacuucuggccucaggugauccacccgccucgaacucccaaagugcugggauuacaggcgugagccaccgcgcccggccugaguugacuguugaacaagaguuugaacuucacaaggaagauaacauguacuuuucauuaagaggaagcggaaucagcauagaggucuuuaggcuugagcccaguuccacgggccgcgcccgcugaccccagcgacugccagguguuccuggcggagggagcaucuggacaggggaggcuggagagcagccagagcuugggcuuggcaggguggccccagggcgacaaucgaugacgcuggagaagggguugggaccgaugugaagguuuuagagcagggguuccccaacccccgguaccgucccuugccuauuaggaaccaggcugcacagcaggaggugagcggcaagugagccagccagacuguauuuacagccgcucccuucgcuggcauuaccgccugagcuccgccuccugucagaccagccgccuuagauucucacuggagcgcgaacccuauugugaacugcgccuuugagggguccagguugcgcuccuuaugagaaucugaugcccgaugaucugucacuguuucccaucaaccccagauggcaccuccugguuguaggaaaacaagcucagggcucccagugauucuacauuauggugaguuguauaauuauuucaucuuauauuacaacgugaaaauaacagaaauaaagugcacaacaaauguaauaugcuugaaucauccugaaaccccucaccagucuguggaaaaauugucuuccaugaagccagucccuggugccaaaaacguugaagacugcuggcuuagagugccuggaugauuugugcauaguuuguuaagcaccagccugaaccacugaagacuuuugaggucaacuggaauuguguaugcaaguugacuaauuacugugacccuugaacaacacagggguuaggggcaccagaccgcccccacaccaguugaaaaucaguguauaacguuugacuccuccaaaacucaacuacuaauagccuacucaugacuggaagccuuaccgacaacauaaacaguuaacacauaucuuguauauauauauauugcauucuguauucuuaaaguaagcuagagaaaagaaaacguuauucagaaaaucauaagggcaaaaccccgucucuacaaaaaauacaaaaauuagcaggguguagugugcaccuguagucccagcuacucagaaggcugaggugggaggauuaccucagccuggggaagucaaggcugcagugagccaugauugcaccacugcacuccagccugggcaacagagugagacccccgucucaaaaaacaaaaagaaaauccuaagagaaaauguauuuacuauucauuaagaggaaguagauccucauaaggucuuuaggcugaagaggaggugaaggagaguuuggucuuggugucucaaggguggcagaggcggaagaaaauccacauauaaguggauccaagcaguucaaacccuuguuguucaagggccaacucuguaucccacaagauucuucucguggaaugaauuuaagaacaugaaucuggaaaguagucugagguccagacuuuucuggcacacaugaccagguggccuagaaauaguuuuucccucuuccuccaugucccugcucccauccuuaaagcugcaaaagcuaacaauauuguaccugcuugacucccaucucuguggccuugaaauacccuguucuuugugagcuuccuucucuguaggcuuaaguucagauaggauuuugcagauugcuuauaaaaauuguauguuuguguggaaccaaggcaguaaguacucuggcucagaagucuuaugguguccauuacacuggaauagugaggaauuaauugucuuuugguccugugucuuacagguccuugauuggcaccgccugaucccccucaccugggccuguauggcuaggcagacuccucaucuuggagaacagagaaggacgacagcuucuuuguugcgcaaacugacuacagccuccaauggaggggucauugaggaguuaucuuguguuagauccaauaacuaugugcaggaaccagagugcaggaggaaucuuguucagugccuccuugagaagcaggggacuccugugguacaaggguccuuggagcuagagagggucaugaguucccuccuggacauggguuucagcaaugcccauauuaaugaauugcucaguguacggcgaggugccagucuucaacaguugcuggacaucauuucagaauuuauucucuugggucugaauccagagccuguguguguggucuugaagaaaaguccccaguuauugaaacugccuauuaugcaaaugaggaagcgcuccaguuaccugcaaaagcuugggcuuggagaagguacaagaaguugcagauuuuggcugggugcgguggcucaugccuguaaucccagaucuuugggaggccgaggcaggcagaucacuugaggucagggguucaagaucagccuggccaacauggugaaacccugacucaacuaaaaauagaaaaauuagcugggcuugguggcacgcaccuguaauuccagcuacuugggaggcugaggcaugaaaaucgcuugaacccaggaggcggagguugcagugagcugagauggcgccacugcacuccagccugggugacagcaaggcugucucaaaaaaaaaaaaaaagauuuuauauagugugacaggagccagagguggggaaagagcagccuaaggugagauggauuaggggagguuucugaguaugucaguguuccuggagaggacuguauaauuuggcuuggaggugaggaauaggaguggcuuucugugcagaauacauuuugagagggaaggaggaggaguuaagacuagaagaaaaaauugagugccagggcagagacucuugucugccuuguucaccgugggaucuucagcaccuagugcaguggugggcauaugguauguguucaguggguugaugcugauaaugugauguugauaaauauguguacauauagcauuugauguuuaaaucaacaugaaauggucuuagugcucugucucugugaugugaugucaaaccaacaucucuuguaaagacuuagauucuagucgaguguuuagauuuacucuggaacaugagagaucuggccagguuccugggauacucguggaguggccuucccuucuauuuaucccccacuccugcccccaacaauauucacaucucaaggaugcucaaaguuccuugaaucucuuuaagggccuucuggaggaguugggggucuccaaggacccuuacccacuuugaccagaggaguuccacuauuauuucuuugcauuauugacucuuccugguaagauguuuuuugaggcagugguagaagguuuaggauccaccauuucacagcaucucuacaggccuccuucucuagaagauaagaaaaagguagccuuguauauuuuucuuaacagauucuuacaguguaaucuaaaagucuaaauauauuaugugugguggugauuaauuagcaaacucagcacagccuuaagaaaugaagauaaaccuaaacugaaauuccucacauauuaagauaaucacuaacucaaauguuaggaaaauuuuaauuaacaguuuaaauaguugacuuuaaguuucccauuacugaauuuugcucagcuaucccuaggaaggccuggaauagucccaguuuacaccaguuagugcgguuuuaauagggccucuuucacucaaggugcccuggcuuggagaagauauauggugacccugguaaccaggacgucagcauugguguuguguguccucaugauuacuauuauuguuauuacuguuaugaugacgauggugauggaacuccuuuucauugaguucagcuugagaauguuaguugugaaugcuucaaugacuauuuuauuauagaaggaaacaucaacccaaaccagcaauauggaggaaacuacucucccauauuacucucugaucuuuccaguaaaugccugggaaauucuuuuccaagugaggagggcaagaggagacccaaaauacaaaguuggcaccuuucaggugggaggccagaauaaagcaggaauauagggagggaaggauggugagucugaggagugucaggaagucaguggggagauguaucauuuccauggugcuucugggaagauagaucugaaauugccacuugcucuguggaaggagaggauccuuguuuguuuuuaaauguggacuuaaauugggugcagcuagcuccuugaguuucuggaguauccugaaauuauaugcuugccuuuuuugaauguucugcagggaaauuaaagagggugcuuuacuguugcccugaaauuuucaccaugcgccagcaggacauuaacgacacugucaggcuucucaaggagaagugccuuuucacgguacagcaagucaccaagauuuugcacaguugccccucuguucuucgagaggaccugggucaacuggaauacaaguuucaggugagaaugacugauagcgugauuagcguaguuucaggugagaaugacugguaaugggauuagcguaguuucaggugagaaugacugguaccgugauuaguguaguaacagcaaguuucucagguuuuucaaauguagugaaggucaguuauauggauaagaagccucggacaccucauauuugaguggaggaagugaaagacuagauucucugcauacaucagccaaagagaaaucuuuaauuucuuuacuacagaucaaaccuauucuucaacuuuucugccauuaauaaugaaugauccaguccuauucuuagagucuaaguggggacucugaaauagcuaauuuuaaaauagcugaaaccuuccuguccuuagaaucuauuuugcauguugauuuugaaaauguaauuuuaacaguuguccgauuuuuugguaauaauuaugacaacuuaggucgaauuucuagauguuuucugaauguuuugccuauucuuuccauauucauccuuuuccuuccccauuuaaagaaaaauaccaccucuuccuucugccccuucucccuccugccccuuuucccucccaccccuuuauuuccugcuccauguuucucaggaugaauuugaaaguguuuugaaacugcuggcugucacacaaaugucaguauccuagacuggguauucgcuguugucaauuaggcaauucuuuuugaauccuuuuguacaacuuaaguuuuuaugguuuauagaaugauagguuucaauacucuguaucugggacuccuaaguguguuugugucuuccaguaugcauacuucaggaugggaauuaagcauccagacauuguaaagagugaguacuugcaguauucacuaaccaagauuaagcagagacacauuuaccuggagcgccugggacgguaccaaaccccugauaagaaggggcagacacagaucccuaacccauugcucaaggacauucucagaguuucagaagcugaguuuuuggccaggacagccuguacuucuguugaggaguuucaaguuuuuaagaagcuccuggcucgggaggaggaggagucugagagcagcacaucugaugacaaaagggcaagucuggaugaggaugaggaugacgaugaugaggaggacaaugaugaggaugacaaugaugaggaugacgaugaugaggacgacgacgaggcggaggacaaugaugaggaugaggacgacgacgaggaggaauagcugugauggaaggacuagagcgaaagggcccagagauaucaaggaagcuuuucauucucuuaaagcuuuuggguccuuuacuugaaucuucucaaguuauuuuuuauucuaaaacuggucucuugaugaaaaaaauuauaagucaccugagaggcagacagaucaaaccaaacaggaaacaggaaaugcauguuugaucuguugucacgugucuguggggagggcccugucccauccugaauaagauacuuauguugagcuauucacaucaaggggacucaauauaucaacaauugguuuuauuuuuuucucuuuugaauauguuggugauaauuccgugacaguuggaagaugggguucauucuuccgguucaggaaucacuauguauuuccuucuugugauaaaaauaaaauuacgagaaggcaaugugagguuuuaguacaucauagcacuuuauuuuaugaaaacauguagcagauuuuccacaaaaaugcuuauuuuuaauccaaaaguauauugcuucauaaugguauucagugcacagcagaguaaaagaaguuaauucaugauguacugguuaauuuugcauggcuucuuaaggccagcaaaaugcuggcaguuuucuuuaucuuugugaagaacaggcccuuccuguuuggggaaguuggcuuuuaugucagcucuuggccaguggucacuuccaagccuggugucuccggcccuguagucuguagugccagacugugcuggccuggagagugcuggggcagguggaggccagggaauggucccauacaguuaucuccccugcccugguuacagacagcuucgagaaccagaggagaagagcauagggucauggagcaggugggcugaagccagggccacagggagcaauccgugaccccccaaggugggugugggggggggggggggcgugucaccuuagggaacucaaugaguccgaagaacaauuugaaauguugggaaaagagaagaggaauuugaugucagccggggugaucccugagauagaggccugucucugauggcaugagcucuaagaggguccuggaggauugguacauccuagaacauuccaguuagcccucuuuuaggggaaacuggcauaggauugaugcagaaggcauuuuugaugaugggaccaaaauucaagucuccuugguagcauucuaggaucaacuagauccuaggaucugguagauuguaggauucuaguggguagaggccaggggugcugugaaacauccugcagugcacaggauggucccacaagagaggaugauccggcccagaaugucagugcugagccugagaaacucaucuaaggccugguccacaacaguaaugugacuguucacucgugacaacuucagaugguaaauggacuuaggaucguauuauuuuauuuaaaagaaaaauaaggagcugguuuuucagccggguuccuuuccccuaugcacuggaauaccccugguaggugugagcugcaugcaauuguggggauucagcacugaaaucuaggugcuuuuguuuucuccagcagccucgucuuacagcgugacugcaaagaaaaagacuuuuguuuugcaaaagaaaagcagcucggugacuccguccacaucgccacaguugagucagauggcaguggcaguccuuugccaguggaaggaguuccugcuaaggggaggugcaggaggugagcugauaccugaguggggcccuugccuguuggguucucuacuggaggacagugggcacagcaaagauucccuuacuuguaccuggcagcccacacgcaauggggaaaagggagaguuugucuuuauugccuugcuuggccauaggcaaaacuguuuggaaaugagacauuucacugugccaguguuuucauuuucucuuccauuguggcaucccggucacugccacccucccuagaaccuaggcuguuguuguacccagucggaggacuaaguagaauccucagucugcacuugguuagaugaucaguccaucccgguuucauuagcagauggguaauucagcaacucaggauugcuucuuucauuuugauacagaaaucuuuaugcuccugacaguuuucugauucuauuauuacuaauuuccuuggguggacuuugaguauuuucaaggaagccauuugaguuuuuaaaagaagccacaugggaaaagcugugguggccucuuuggaauguuucaagaacgaacuguaauuccugagcaccaggaagucuuuuuacuugauauuuaauguggaaaacaucccaaugggcaaguccugugacagcacuugggacucaggagccaguucuuguugacacaaggcuucuaagcuaacacuggagcauauuagcauuugcuguguggcaccaagcuugggacucaggagccaguucuuguugacacaaggcuucuaagcuaacacuggagcauauuagcauuugcuguguggcaccaagcuugggacucaggagccaguucuuguugacacaaggcuucuaagcuaacacuggagcauauuagcauuugcuguguggcugaggggcuugagguccuaguagggaguagaaaguuuccuaguaggauucaccuacuuuuccagugauaucacucgaucuuagcaucugcuaguaaugcuguagcuuacauggacaaacagugacaggucccagggcggcaggaaguccgcaguacgcguuugugaacgugguuucucucaguucacccagugacccuucgcugagcucgagacccuucauugagcuccaccuucugcucucaagugggucuggagccuggggaacagcucgggaguacaggugaaacuucgcgaauugccuguuccuucuuucu

SEQ ID NO: 12816 - RNA, 621 nt, Homo sapiens
gccugagguaaucugugaaaaugguucgcuacucacuugacccggagaaccccacgaaaucaugcaaaucaagagguuccaaucuucguguucacuuuaagaacacucgugaaacugcucaggccaucaaggguaugcauauacaaaaagccacgaaguaucugaaagaugucacuuuacagaaacaguguguaccauuccgacguuacaaugguggaguuggcaggugugcgcaggccaagcaguggggcuggacacaaggucgguggcccaaaaagagugcugaauuuuugcugcacaugcuuaaaaacacagagaguaaugcugaacuuaaggguuuagauguagauucucuggucauugagcauauccaagugaacaaagcaccuaagaugcgccgccggaccuacagagcucauggucggauuaacccauacaugagcucucccugccacauugagaugauccuuacggaaaaggaacagauuguuccuaaaccagaagaggagguugcccagaagaaaaagauaucccagaagaaacugaagaaacaaaaacuuauggcacgggaguaaauucagcauuaaaauaaauguaauuaaaaggaaaaauaaaaaauaa

SEQ ID NO: 12817 - RNA, 2694 nt, Homo sapiens
uccuucuuuuugagcuuugggcuuuuagccucucuaccauuugugcugaucuguggguauccuuuuuagccugguaugagguuuauucuuuccugaggcggggugggggggaauugcuuucuguuuuguuaauaucucaguuugggcuagggguuccuggacaaaugggcuugguuguagaguacuaguccauugucccuacagcucaagagaugcuucugucugccagcucaggauagucagagaaggcauccuguaguccccucuacacuagugggcuuuucuucuucuuuuuuugaucuaccuaucuucugguaaguguagcccuuuuggggaucaugacuuuauggaauaggaggguaucucuucucaccuccuaccuugagcagacccaaacuucucccccgucccuuugagggcugaaaacucaaaugucacagacagacguucacacuucauuuggucugaauauugcuagccauggaauuucuaaaauuugcuucuacgaacuauuuauuaguuucagugugcuaagccugcugggaggaaaugcugguugugagcaucagcacagaagcauucuggacgguuauuagcacaaaguuagcauaugauuuuguaaucucuucugcuaacaguguuuuuuaaacuaacucuuuacgguguccuguguacuagguacugugccugugcugacuuccuagcuuuauuggaaguuccuugacagcggaccgaaucccuacccguuacucuuucuccaucucccucugcagugcugagcccucaaaaacaaaacagcaacaaaaaacacacuugcacuaguugcugauugguuaauccccacggaaagguuaccaacaaaccacagcagugacacagaagggaaugccuauuuccacaucuagggaggcccaccugcccaguuccgugcugcugacuuagagcacggcuuugcugaugauauccuuggcuccuucucugcgucaagccgcagguguucucugccuucugugauucugcuccccucccuagguggugucaugaagugcaugguauuucugcuggcuccuaggcuuuuccccugaccuugcacauacaguugccugcuccacuuccccaccugcccagucagggcaucacacccccuuauccauccagucuuccuugaauuuuacccaccucagugagggcagcucuucccagucacucaggccaagaaccugugucuuucuuaacuucuuuuacaccccucuucuggucaauaaggaacuucuuggugcuucuuucugaauauauaccaaaucuggccauuuauuuccuccauuaugcccaccauaaugcaagccauugucaucuuuagacugaacuauaguaggccuccccugcccuccccuccccugccacuuagugucaguguuccacgaaaaaaaaaaaaacacgucugauccugccuucugcugcuugcagcccccacccagcucccaccauccucaacagcacccguggccuggcugcaggcugugcggaccugaccccauucccuggguaaggcugggugugccccuaccucuuccccugugugggacggucuuguccccagauaccuguaguugauccugugcccuaugcaggauucuguugaccugcgacuuugccagagguucagacugacaucucuacagauugcucgacucccuuuauacccuuaaaagaaacaguggcaguuaucacuuaguaaacacaauggaugcagaagugacaaguccuucccggaggguggagaccccgagaguagggauuccguuccgcccaguccugcguauccaccgugggcucagaggccacacaccgguucuuuugcguguauacaucuauguagagauggagccauaaguaauacacgcuuuaaaggaaggggauuuuacauuuugggggggagauuaaguugauugccaaggaaucggguggggauaguuuauaaaagugagggacauaaggaauaggcacgcaggaaugagggaaugaaagcccuggagccgccugggagccucacugcgcuguaggaccucgugccaguguggccauccguuuacgauguggugggcauccuuugagguuuuucuucugauuuuggggaggugggcgguacuggugacaucugcuuccagagcagccguccuuccugcucccuuucuggucuucgguuguuuccacucggguucuugcggggcgcgcucccucugcuuucuggaggugauuaauuucccaacuccucggcaccgccuuccccacccgaaaaaaggaugcagaaccacgccugcaguugggugggccucccgggugcugggcggcccggggcggcggggaccccagcggcggggcgggcgggcgcugacguguccaggcgggauugggccgccgcccuauauagcagccggggcccgggcgccgcgccucggagcgucccggcuucucccgcgcggggggcgaguaagccagcggcaggaccagcgggcgggggcccacgagugagcgcgcaacacggggcugggaggccugggcgggcgggcggacggggcgggcgggcugccgggcgggggggugggggguggcugcugacguggaggccgcggagggggaggggcccgggugccgcggcccccacccgggccccaggcugcggcccccgcccgc

SEQ ID NO: 12818 - RNA, 1992 nt, Homo sapiens
ucauugugaaaaagucuuuauuuuaagaaaaaaauuuaguuaacaaaaaauuuaacaaguuucacuuagcaaaauacacccaaaaggaaaucacaguacaaagaaaguuuuaagucaaggccucaccaauuccuacaguauuaguauugugucucaauucucaaaacuaacuuuuaaaaagcuuaaacuuaaccuaaaggauuuuaaaugaaaauauaaacuagaaugaacaaacaugagaaauauuucuuugaaucagggagcuagcaccuuugaguuuuccaaaaaagcacgucuccccaguguguucacugugaugugguguaaaagauccacauuuaacauacuuaaacuacuuaaacuuagauaacaucacucugaaguauacuaccaaaauguuaauugagaaaagcugaaaauaguuuuaguuuacucauuaucacaugcuagaagaaaauuuugcaugagaaaacacugaagagguaauuuuuuaauccagauuuuucacaaacucauggugcaaaaugggucccccagcuuccucuauuauaacugcucuuaauugcuuguuggcugccugugaaaaugauugaaguaacucaaauguuccuaacaaaacuagucauagccacccaugcuguucugcccacuguagccggccccguaacagccacucacugacuggcucuccaggccacuguaaguggccugggcagcagacacccccaugccuugcaucaccuggcugcuauacgccccauugcuggccccuguuguugaauucaagaagaguucuauauaucugugcugcauauuggcccugucuuuggacauagcugccacagcuucuucaugaguagcaaacucaacaucugcuucacccgucacucuuccaucugggccaaucucaauauggacucucacaggguugagaggagagaagaaguuguaaaugucguucucggucgcuuuguacggcaggccccucauguggacacaguggccuguggugcucugcacugugaacucacugucgccguaucuguggucauacauuccggagagacaguagcugaggucucucccgaacaggucgguggugaagccguagccaucacugaggccacuguacuccucguagcccccguagccugugcuguaggcaccaggccucauccuuuccaggccugccugcuucacgaugccaauguaccuccuggcagucccgggccggucauagggcccuggccgcugcacggacaugaacuucagagggggaucugaguaugaccuaacuuccuccuggcugcucuuaaacaccucaauguaccugugcccuauccucuccuuguguuucccuagagccuucucagcuaacuccugcgaggcaaacugcacgaacgcuuccccuguaaucuugccuucgggguccacaggcaaugugaucccguuuggcacaauuuccaacccugagaagaacugaacaauuucuuccuuugugcauccaaaugggaguccucgaagccgcacgaagccaucguuggcgcugucggcacuguugggaccacugugcuucaacacccaauccaucucgguucugugggacuugaacaccucaauguaccggugucccaugcuuucccugucuuuuuucagggccauuuuuacaucaucuucugauccaaguucaacaaaagccucaccacucugccugcccucucuaguguagaugaaauggacaccugcggccccaucaugaaucgugcagucagagaggaaguucugcacguccucaacagagcaggaccagggcaggccacggagcuugaccacaaagccuucaccucccucagggcccagcaucauggacacuugucagggugggugucaggugaucuuggguguggcuuuuuuguggcuggaaaaaaaaaaaagaaaaauuuauuuaguaugcaacagaaauuuuccccauuuuacagacgagagagguag

SEQ ID NO: 12819 - RNA, 1545 nt, Homo sapiens
aggggaaagaaagcagcaaguggaaauacuugggggcuguuuuuauuuuuuuaaucuaaaaguaauuuuuagaagccagcagcucaauuuuucucucuuuaaggggccagcuacaaauaaagguacuuauaaauauuaaaaugcuagaaccuucauauaaaauguccgauaguugugaccauuuugauugugguuuuguauauuuauuuagagauaggaucucgcuguguugccuuggcuggccuugaacuccugggcucaagagauccucccaccucagccucccaaauagcugggacuauuggcacaugucaccgugccuagcuuagauuuugugcuuuuaaagauaaagucucauccacucuggcuccaccacuuuuuuuuuuuuuuuuuuugcaagauacggcuaaucaacauaagccuuaauuuuauuuguucauaaaaugggaaaaauaauuucuacuucccaguucuuaugagaauuagguauacguaauauaaaauaucugugacguaauaguugccaaauaaagagcaaccauuuguaguaauaaaaacagaaucugaaacccuuaauuugccauguuuuuauucucauaacugcuuuuaaaaaauucuagauaguaaaauaaaagcacuauauuuaaauuuaagcauuuuaaagauaaaaugaaauguguauacguguaugaugugugaauauauguugucccucauaccuaauuaaugaacuaaaauuguguuuucugaguguguguugacaugccaggggguguagagaugauccaauuggguauggaaagaaaauauuagaugugcuuauaaaauuguuuuauccuuuuaaaauuuuuauuuuauguguacauuauguaguuagcuaguauaguaguaaauacauaaaauacauaaauaacauauauuggagauauuaacucaauguuuuaaacuaaaaaaaaaaucucauaagagcuucacaaccacuggucuaaauggccauuuauaacauaaacauaacacuuaugacaaaucauuuuaaguuauauuuuauuuuuaaauuagagacagggucuugcucugucacccaggcuggagugcaauggugcaaucauagcucacuguaaccucaaacuccuagacucaagagaucuccugccuuggcaauaauccauuauaacaugaaaguccuucucguugaguccaauuuaccuucuuggaauuuuaucuuauuuaauguuugaacauagguuugagauuuagcaagauuuuaaaagugaccauuuuuagauauuuauggacaguuuuauuuuuauucuuauucuacauaucuuugcuaguaauuuucuaucaugugcagugguucuuuaauuguuuggauuugcuuuugguuccaaaucugaggacuugguauguugggaaauaaaagauacuagaacagaacccaccugucucaauaggugucugagguuugcaucugugaaccuuuucuucggcacucauuguauuucuuguuggggacuucuugaaccaugcagugaaacauuuacu

SEQ ID NO: 12820 - RNA, 83413 nt, Homo sapiens
cgcuugcgcaaaaucuccccacagacucaauuaaacccuuccuuaggccggucgaggcgaaugguuuugaaauuacugucggguuacgccucacuuuaaaaaacaguagguaugacacagcacaccagaacgaccacucaccgaggugguccuaaauucaaacgacagauuuaagcuuccucucgugauuuaucucgcgcugccggaagcggaacuacccggguccuuuagagggcaguccuuuggggaaccuuggaaccacggucagaaagguuaggacugaucauuuggcucuugccggaaaucguuccgcccggugagguuucggcgugagacccgaggagggcggggaagaggcgugacggagauuccugagguguaguagccugagguucccuuauguggcccuauagcuguuacugaaggaaguagccuacguccacgccuacaacugaagucucuugacaaacaccucaccccugccuccgggaugaaaggggguaaccuagaccugaaugggcuugaccaucucacaacugcucgcgugacgaccgcauucguggcaggugagggcccaaaaccggaggagaaccggagaugcggaaccugaucaugccaggguugaggcggcugcugggcuucugcuuugucuccugugcucugcagacccuaaacacaugcuccaccgaggggcuugugcuggagagaaugacagccugggcguggagugacaguacagcuuugaggguccuuucgcgccuugauuucuccuccugcucccccauggcuucccuuuuucauuucuuggguucgagacgccagaaauugaagaucagcuaaaagggaaccgcugagcuucuaccccacgcugugccuggcuccacugaagugauuagccucgaguuaugggacugcuguggguagagguggcuuuuuaaaaaauuuucugccuuagucuuuaucccucucucugucaaccccacacccacuuuaaaauaacaaaagccucauguguugcagcuuuucauaguagggaccgaggcugcagggcacugccgcaccuagucauuuggaggucguugcagccuucugcgccuugaagaagaaggggccagggugaugaucccuggaucucauucacgagguucuugaccacuuccugggagauugcgacucuugguguccuuuggcuaguaguugucuugcuggaaggcuuaacuguggaagugggaagcauagcugaccuuagcacguaaaauccucgcucuacacugggacaggauuuuguuuugcuauugagaauucuuaaaugaaauagauaauuuuuuugucucagauagauaaaauaauaacgauaguugccauuaacugagucuuaugugugccgagugcuuuacauaguuugucauuuauuccucucaacaauuccaggagguauguuagauuauuaucaccauuuuacagaguuagaaauggaggcuuugaacagucaagcaacuugcucuauuaaacauuuguuauaaguaaacguuugaaucuguguuaaaaaccagaucugucugccuucaaaaucuguauucuauuguccuguccuguucuuccucgauuucaauuucuucacuaacauuuucagugucugaaaguauccauucauuuaaaaaauuuugguguaccuacuuauaugucugacaaaaguuagacaugaucucugucuuuauggagcauugugaugcagaauuaaguagugcagaacccagaauacuguacuuacugcagcacagguuuauuuaaagcaaaugacuaaacugauuugcagaaaauuuuaaaaucaaagguugcuguuuuaaauguuaaauucauaugacuuucagaguaguuguugugaggguauuaaacugaacaauugguagaacaucuguugauuacccaaauaagugcuaugaaccaaguuaaguagugggaauauauagauuagguccucauucuuuaaaagcucccaugcaaccacaauauagacaauguuauggacuauuaauuuucucacguggaaaaggaauugugguuauguaggaagguguucuuauuuuuagcagauacauacuaacguacuuagaguugaaguguguugauaucuaguacuuucaaaugguacagcaaguguauguguguguaugugucuguguguauaaauagcaaauauggcaaaauguuggcaauugugaguauaauggugggcauauagaugauuaacaaacuguucuuucaacuuuuccgaauauuugaaauuuuucauaauaaaaaguuggggaggaaaaaacccaacccugauggaaacagauaagugaaaagauagauccaaaaugcugcggaacauagaagaugggagaggguuuuuauguguauuuggggccuaacagaagugugauaguucucaggaaaaccuucacugaagaccuuucaguugguuuuugaauggcggauaggaacuuucaaggagagcagugaauuccaggcagaaggaaaugcagguucagcaaaaagauauuaaaugaacguuugaagaaggaaaaagaaaucaacaagaagguuguguggaacuuggaauaggcuuuuuuuguguaaucuuauaaaugagccagguugccuuugccagccugcagaagccuauuuauucccuauuaccuggauguacuauugguggaaaggagacaccauuuauaacaguguuuccauuggaaaaugcuuuuggaauuucaggaaaacugguuauguguuugcguuuaggcuaagcagcaggagcaggagcucccauuuccucugauuuugagagcagagauuuacuaguuuauaguugggcuccugagggaacccaugaaaagggcuacagugauggcuuggaaauauuaaguucagguaagggggaucugaauacuaggugggacugauggaugauccaggguguuauuuugaggaucagguagcucuggccgugaccaguaaagguauggaagagaugauuaucccaggcaguaguguucaugauagucucaagcagugugguaagacuagaaaagguguaaagaggucuccaacaacagcaguggcaaacgggaguuucuguggcuucauuagacaagagguaaguagauacauucuaaauugaguuauuuauauuuguuccuugccaauuaaauuugcuagaaaacugucauaacaacauuuaacaaaauauuaaacaucuaacauuuacugagugcuuaauaugugcuauuugcuguggcaucuguauugcaauugucaaaacaauauaugagauucauaaucccauuuuacagaugaugacuagagagguucaauaacuugacuaaggacacagagcugagcaacuugcagaaaaaguuuucaaacccaguuuugagucuagagcaauuguucucauagugugauuccaggacgacgagcaacaucagcaucaccuuggaacuuuuggaaaggcaaaauauugggccccacccccagaguuuugagauuaguauuaacaagcccuacaggugauucuguugcaugcuaauguuugagaacuacugcauugaguguggacauuuuuaguagcauaacacucauuucagauuuagaaaucagguuuaagggauauuugucuuuuguacaguuagauucccaaaccuggcugcucauccauuuguaaaaauacaguuuuucuaguuaagaauuacuguuuaggaauuccuaaucugugauaagcccaguaacuuguguuuuuacaagucuaccagauaauucugauguaaccaguccauuuugggaccacugcuauagaaggaauucuaaaaauaaaguaagguucaacacugauauuugaauaauguauguaucuuuaugcccagacaguuagcauauguugaaauuaaugacugaacauugaucaaaaugcuaaauaauauggaagugcuauauguauaaacuguacuucguucaaguaucagcgcuuuaagugaaauaauacaaaccauuuugaauguccugcaucucuuaugaugcucauaaaaucucaucuuggccgggcgcgguggcucacaccuguaaucccagcacuuugggaggccgaggcgggaggaucacgaggucaggagauugaaaccauccuggcuaacacugugaaacuccgucucuacuaaaaauacaaaaaauuagcugagugugguggugggugccuguagucccagcuacuugggaggcugaggcaggagaauggugugaacccgggaggaggagcuuguagugagccgagaucgugccacugcacuccaaccuggggacagagcgagacuccaucucaaaaaaaaaaaaaaaaucuccucuuguacuacgacauauauccuacuuaggugacagaaauguauuugaauuuauuuuauauuuuuaguuuucugagaauuuauauuugccaugcugucauaaggacuguggaguccucauuuuugcucuuuaguauaauggccuuugguuuaaacagaccuggguuugacuuccauuugcaacccuuauuggcucugugaugaugaucaaauuaccugaacuuucugaaccucaagucuuaauuuauaaugacaaaauggacacauaucuacauacauaaaacauuuauaaaaugaagaauauauuucuaauuccaggauggcugugagauuguuaaaucacaaaguaguaaguaauuucuucccaacuuuuuucauauuaaggcauaccuagaaaaugguaguauuuguacaguauccuggggaaacugaagagagugcuacuggaagcaacuggccaggguauaacagcugccuuaaaggcugaggcaauuaauuucuuggcauacuuacaauucauuuauggugagacaacauguugggaggcucugaauuuacaaguaagguacuuacuagguaacagugccuaauaaauguuccuucccuugagauuuauguuguggagggauauacauaacccaagcuguuaaauaacaagguuauaugugaccaaaggucaaaacgaaugauucggagaaggucuuguaaauuguuaaggcaaguuuuguagaggaguaucuauuggauacuugagaugugccaaccaccagaagacaaaaauucugcuucaucgguuuuaucuccuuuuuauuauaggaaauuuccuauaguacuuguuuucaaaaacugguucucaaacuuggcuacacauuggaauuaccugggaagacuuaaaauuacccgaacucuacucucaaucauuuugauuuaagugauguggaguauagccuagacguugggauacaagcacucuuaguauauuaucuuacauauaacaucauuaaaaugaccuaugagcuauguacaauuuacagaugaggaaauugaggccauaagaaguuaacucacuugcucaagaucagcuaauuggagucagucagguuuuaaacccagguauuuuaaccccugaauccaugcucuuaaccacuagccuguucaguuuuuuuuuuuuuauaugacaucucuaaguaucucucauauacuaaaguggaauaacagaaaaaaaaagaaaggcuuccuucacuuuauguccuuuagagguccaauuccucuguccaucuuuuauaaacucuucaaaauaacugucuguauaacuugucuguauuucaucuccuucuauuuucuuguuuguuugagacagagucucacucuguugcccaggcuggagugcaguggugcaaucccggcuuacugcaaccuccaccuccaggguucaagugauucuccugccccagccuccugaguagcugggauuacaggcgcaugccaccaugccgggcuaauuuuuauauuuuagcagagacgggguuucaccauguuggccagacuggucuugaacuccuggccucaagugauccgccugccucagcuucccuaaaugcagugcaaucacauuuaacaaauugaaaauucuuacuauggcuucucaguccuuugugugcaucuuagcuacuuaucugacaugauuuuuuaccauuuuuccuuugcuugccugcucugcuccaccuuacucuuucaugaacaugggaaauaugccaagcauacuucugcuuuagaggcuuuauacuugauguuucuuaccuggaauguucacaccauauaaccccaugguugguuucucauuuaaauuaaauuuauauuuaaaugucaccuuauuaaagaggucuuucuaacauguauuuauuuguugauuuaccuagucccucaccaaaugaaugaaugagacauguuucagaccuaaggucauaaucaaaugagggacauauaucuauauacuucauacagcauuacagacuuaaacagaacuugaauaaguuaacaaaaggggacagaccagucauuaauucauacccuugggaaaaaaaaaucuauuggauacauacuuuuuuuuccccgaaaguugauuucuacuuacacacauauuuuguaaaguauuucaaaaaugugggagaauuauauugaaaagacuauguauuagucaggguucucuagagggacagaacuaauaggauagauauagcuacaaaugggaguuuauuaaguaguauuaagucacacgaucgaucacaaggucccacaauaggccaugugcaagcugaggagcauggaagccaauccgagucccaaagcugaagaacugggagucugauguuuaagagcaggaagcaaccagcacaggagaaagaugcaggcugggaggcuaagcuagucuaucuagccuuuucacguuuuuuuuuuuuuuuucugucugccuuauauucuagcugcacuggcagcugauaagauggugcccacccagauuaagggugggucugccuuucccggaacacugacucaaauguuuaucuccuuuggcagcacccucacagauacacccaugaucaauacuuugcauccuucaauccaaucaaguugacacucaguauuaaccaucacagaauaguaggaaacacagcccaauaggucugcacagcuacaaccauuaguucugccauugugucauggacuuauuaacugauucuuuaaauuuuauuuguauguauuccagacuuuuuccaaugaauacucuaaaaggcuaaaaaaaauuaauuuucagcuuuaccucuaaaacaguauuguucucacuuuguuagaacacuuuaacuagaaggaaguacaauacaguuuuaaaauaaugucauaaaauguguguauacacacucauauucauguauguauacauauaaguacauaccuauauauugcauugacauacuggaccuggcauuuccuaucauugccauucugaaguagauagacauuuauuacauuauuacauguuucuauuaucuuuuuuauuggugguuuaucacacuaaaacagaaaaugucaauuuauuuggcuaucuuccuacuagacuaaaagcuccuuaaggaaaagagccauguuuacuuugacuuuauauaaccagcacuuaauacuaugccuucuauaauaaguaaauaguguuuguuggauaacuauauucauuucaacaaauaaugaacaauucauucuuuuagauuuacauguuagagucaguagggaguuugguuuacaggaguguucauggaaacuaugguuuauugaguguuuaauauacgccaagcacuuaugcuaucucacuuagucuuuacaggguuacaggguguuacuauacucccuuuuuuauagacuaauagcaacuagcacaagucacuaguuaagcacugacagauuaaaacagauguaccugacuccagaacauuccccuuccauuaucgaaauauuugagcuguuuuuagauggaaagaguaaaaaaauugaaagaaaccaagagauauuugccauuugauaggaaacagaacugagaucaacuuauccaccaacaugaaguuuuacagccacuggaaacuuucuguuguuguuguuuuuuuuuucaguaaacauuuuuacauguuaaacaguacagaggaauagaacaaaaggcauugauuuauaaaguaaauuauuucugcuuuuauuuuuaaauuacaaauuauuuuaaauguaacgcuguauuuuaaagaugguuaaagugaaggcugacugggcaaauugauuuuaaugucuacuggggagucaccaaguuauacuggaauuagaucuuuaggaauagaacuuuuggaguuaugcuuuuaauucuaccuagcauauuguuugacuuuuaagaauauuugaucaaguaauuuauuguacuaccaguaaucaaaugaagcauuuguuauguaguuucaucuugguauauaauuaauuuuaauaugaccaggaagcaaguacauguaaacaacuaugguaaggaauauuuugagaugcuacugcucuuauaguucuuauuuauuuauuuauuuauuuauuuauuuauuuauuugagacagagucuuucucuguuauucaagcuggaguguagaggcacagucauagcucccugcagccucaaacuauuuggcucaagccauccucccaccuuagccucccaaguagcugggauuacaggugugagccaaugaguccagcuaugauaguucuuuaacugauacucauggacgccugguuauguggaagaguuugaaugucagugaaucacauaaaauucuugcagaauuuagugcacauguacuuuuuuuuucuggggaggagauccauagauuuuauuagauuuguuaaagaguuuuugacuucuacauguuuaagagcugcuguuaaaugaaaucuuguucugacucuaaucuuuuuuuguucauuuauguaugagaccagaauauagaauuguuauguucccuaaaaaaacuguuuacagacaacuuuuacaaauugacuuaauguaauuucagauuaauauuugucaguggcuuuuaaagcugcauuccauuugucuguucuuuuccauuccauucagauauuucauaacuaugugcuaagagauuuagcuuuaauauaauuuuguuauaauuugaguaauuuucucuuaauuaguuuagcuauuuugggaugaggaauuuaauguguagucuuuuuguuaauucauauguuugucaaauugcuaagauguauauuacugaagaucaguuuuaguuucuuaauuuuuuugcuuuuauuauaaguaauuuucuuaugggagaaaauguauuuucauuuugacaauauacaucaaguuauugggcugauuuuacaagugucauuaaaaauuauuuuuuacaugaauguuuuuggagugcacucuccaaaauuaguuuuuucauugcauuuuagguaagaagauugcuguaucaacucaagaaagcaguaacuucacugucuuuguauuuugaauugcaacaacaacuuugauaucaacaaugaagcaaugauaucuaagaacaaaagaguauuugccaacagucaucauaauaucaagugauuguauaagcagaaacaagcugucacagaccugugcgucagcuaauauauggagaaugcuuucuucugauacuauuuacuuagaggcaguuuuaauauaaaucauuucaauuauaucuacaucaaauaaaauaaaaaugagugaagcccccagauucuucguuggaccagaagauacagaaauaaauccuggaaauuaucgacauuucuuccaccaugcagaugaagacgaugaggaggaagaugauucuguaaguuguuuguuuuuccuuuggcgagagaagaccaauacaguauaggcuuuuuacuaaucacuguuagucuuuuuuuguuggaaaauuuuugaacugaaaaaguauauuuuguuucaugacugauguuguugaaucuaugaugaaucaauaaauacaguuaugggucaaaccuuuauguuguuuaaugaugccuauuuuaguuucuuucagugauacgcauaguguaacucaguguuagguaacaaaaguggcaaagagaaacaguaaucugggccauaaauccaaaagcuuucuuguauguagaaauacauaacaaauaauugaagauagguggaaggaaauaauuuuaaaguuacaaaagaagaaggauuacuuaaauagauucauuaagcuucuguuaccaaugugaguucugguugaaccgaagauacucauauuuauuaacuucagaagucugaaaacugaguggcuagaaggguaggcuaccuaaaaaguaucuauguguuugugugugugucuaaaacuuguucucuuucugauaucauguucuauccauacuggaucuuaggaaugauauauauuuauuaugcucauuuugcuauaguuacauuagaccaauauuuuucuuacucaucauuuaauuuuuuaaguagagauugcuuuacugugaauacugauuuaaaauacagaccuacaguauguguuuguuuuucauauauuucuaauuggaaagagaauuuaguuuuaagagaaaaaccuguucuauuuuguaaaaauaguaaaaacaaaccaaaaauauugauuagaugacucuuuaagccccuuuuuauauuaacaauaucuuucacaguggaguuacacauaucugaaaugcaaacucuacuguuaacucauuuaaaaccuucaacgcagagcaccuuugcuaccuccugccccugaaaaacuagauuuucaggcaggcuucucuuaccagcucaaacuuuucuucaucugaaguuuuaucuagaaguccuauaaguaaaacaugaaagcagagcgucucuggcucacuuaaacuagaaagcacuauugacucagccucuacuaccuuuguccccuuuuucuagaguuuuucugaacaugguaugaacaccacuagcagaucaaagccaggcuucuuacauguaaaggcuuuuaugucucaucuauaucuacauccauaccucucucccauucuuucuacccucuauguuuuaguaacaucaaaauuuuuauuuccacauauuuauugucauaccaugcgucuuugcuauuguauguacucuuuuaccucucugaaaugaccuuauuuugggauaccuugugaauuauuuuucauucuuccaaacccuccccagauuucacaucauugacucuuuccauucucuuugcucuuuuucccaucacagauuggaauacuucuuccucauuacugugucuuuacguugcuguauauacaguuguccuucaauauccaugggggauugguucuaggacucccuguggauaccaaaaucugcagaugcugaaguucuuuuuauaaaauuaugugauauuuacauguaagcugcaucuacccauguuuuaaaucaucccuaaauuacuuauaucuaauacaauauaaaugcuguguaaauaguuguuauacuguaucauuuagggaauaauaauaagaaauauagucuguauauguucaguacagaugcuuuuuuuccccccaaauaucuucaauacaugauuaauugaauccauggauguaaaacccauggauauggagggccaacuguacuucuauuccauguaucacaauuuauuuuauuauuacuguguucccuguuaaggacagguaauucuguauaucuaaucuucagugcauaguaugaugcacuauuaucacuuuacagaagcuugauuuaguucauuugauguauagcuuuauauuuauaaaauuauuuauuccagaucauucuccuguuuuuaagauuucucuccuguuuuuaagacuucaaagaugugacuauaguuuuuuuagacauucaaccuaacaaaauaccucagaucuguuuaaaaaauuaucuucaugauuuuaagguuuuaccuaacagagaaacucugcgauugugccuuaagaauguaaguuuauuuauacauuuuaaacuugaaugguucccauucaucuuagccagugagcagauauucauuaaauagauuuauaauaaauaagacaauauauuagcauuuaaaaaaauuguaaagcaaugugaaauguuagguuagaguacauuuguugucuggggaaaucuacuuuaggaacauuauaaugaacuguaccaaaacuuuugaucaggaaagcauugaauaagggcauauaaaaguggauguucagagggauaaauacagaagauuccaggagaguuagcauuuauaaucuauuugauuuaccaaucaacucuaguacaauuugaacucuacauuucaugaguuugaggagacaauacagaaauacuguucuaggcauaaaaaaagaacaauuuaggcugggcgugguagcucacgccuguaaucccagcacuuugggaggccgaagcagacagaucaugaggucaggagaucgagaccauccuggcuaacacgaugaaaccccaucucuacuaaaaauacgaaaaaaaaaauuagcugggugugguggugcaugccuguagucccagcuacuugggaggcugaggcaggagaauugcuugaacccgggaggcggagguugcagugagcugagauugcgccacugcacuccagccugggcgacagagcgagacuuugucucaaaaaaaaaaauuaauuaauuaauucugauguuauccaauuuuauuuuuaguuauauuaagaaaaagcccagaaaagcacuuucaagccuagauuauaauguuguaugaaauauauaaaguaucaugcaagaaagaaaaauugaaaugagaaccucaacacagcuuuuguauauuugauaaaacucucaagcacuuaaaugcaaagaucaccaaaugaaucuugaguaauuuuauaaaucuaggagcuacucauaaaucaguuucuauauccugcuuuuuaaguuuuaggcugaauuguggccuuugagcuguuacgaggaugccagagaucaguaacaccaaugaguaggaguuuugacuaugaagacaggaggggcaaagagacuugacaccucuguuagcaguguggcuuucuuuaaaauuuucuuccaaguugucaucagugaccaacuaauauucaagugcaaacuacaauaauaguuuaauacuuauagcuuuguagucaggacuaugucuuacuuuaggcaagagaauucuuuaucuuucuacauagaguggauggguuuugacuguuauuauacuuuacuggugugaggaggauaaauaaaugcuagagguaguuaaagaggggguacuuucuuaguuugaaauuucauugaaaauagcaaccauauuuauucugaaaguguuuuuguuuuuaaauuuguuuccagacuuuuguagaaaacuguuuuuuaaauguuuauuauaacaaugauauaauuuuuaaaaauuccuuuguuuguuaaugugucacuuuuauuuauuaaucacaugccuuaucuacuuuuggaaaacaaaugaagauagcuguacuuuggaguucauguaaaguuaacccgauuuuuuguuucauuuuuguuuuagccaccagaaaggcagauugugguuggaauauguuccauggcaaagaaauccaaauccaaaccaaugaaggaaauucuugaacggaucuccuuauuuaaauauaucacaguaguaguauuugaagaggagguuauuuugaaugaaccaguggaaaacuggccuuuaugugauugucuuauuucuuuccauucuaaagguauuaaggggagugggggagaaacuccuuuauccucucuguuuauaaaacuaauacauauuaauuguagacuaugagauaaaacagaaaaauaaacauuaacucacuuucauggacagguaauauuaacauugugauauauuucuuuccaguguuugucuucuauguguauuaucauuuaauuuagugucauaguguauguguaauuuuauauuuaaccuuuuucacuauuauaucaagaaguuuuuuuccccuaccaugucauucuuagauaaugugguuuuuaaugguggcauaguauaucauuguguggauauaccauaacauauuuaaauuuauccaauauccuaacauuuggaaaguuuccaguuuucacuauuaaaaauaagguugugugaucuuuuucacugcauauuuuuguuugcaucucuaaguuucuuaggacaaguucuugaauuauugaauacuuuaagccccuuucuaugcuuuauagaacaagaucuaucauuuuucauauacauauucauacuuuauuuuuaagaacuuaauaauuugagauuuuuagacauuccuugcuauaucuuauuaaucaaacugaaauaucacuucagcuuaaguauuaugucauuguaaauuccacuaaucaaaauuauugcugaggguacaucugaaaauugauagccuaagaaucugugaauuaagugaauuucccacuaagaacuauuaauugaaaagaugugcucucaguuguaaauguauucauauuuaaucaucacuuguuaccaaaauauguucuccugagcuauguuaaagucuuacuucagcaagaagaagauggagcaugguuuugcuaccauagccuaaauugauguucauuauuucauagagaagucaagacacugaucuucaaagacucaggcugcucauuuuagagaaccuuaaaauuucuuccuccuugagaguaaagcauucuucccuuacccucacaugguucuuccuauuaguguuauauuugccuguaaaaacuggguguuauagcuaaugucauauuccacauaccaucucuugguagggaaaaaguuucucuuuaacaaaaacaaaagcaggaaacuguguagguguuuucuauuugcugaauucuguaaggaggcuucaaaucauagacauugagacaucuuuacaagcgaugaauucugagagucuuuauaaaacuuucaggauuuguaauuuguggcuaagugguucuugauauaagguaucuguauuuaaauuuuaaaaacuaagaggaguuuaggaauaaaucugauuuaacuggccacagcuuuuuguuuuaauuucagcauguuuuaauacuuuuucucuuaacuauucugguaguacuauaaaauauagucucuucacagguauacuuaguauuccauaguugaauacuaaaguuauguaugcuugcugauuuuuauccuuuuccauagauauuuauuaaaauauugccucuuaaggaauaauaacagguaacauuuauugagcacuuacuaugccagguacugugcuuagugccuuauauccacacuauuauuaauuccucaaaacucuacuagguaagacugguauacuacucuuuugugcugguaccagaggcuuagagacguuaaauaaauuugcccaaggucacauagcuagugagagauggaaccaggauuugaacgcugguuuaugucuuuaacuguuacgguauacaacugaugauguguauugauggauaaaauuggagacuuugugucaauuuuuuuuuucccccuggaggacagggucuugcugugucaacuaggcuggagugcagugguauagucauagcucccuguaaccucaaacucuugggcucaagugauccucccaccucagccuccugaaggauagaacuacagguugcaccacuacccucagcugauucuuuugaauuuuuuguagagaugggaucuugcuauguugcccaggcugguguugaauuccuggcaucaagcacuccucccaacucggccucccaaaguacugggacaggcaagagccacugcaccuggcauuagugccaauauagagaauaaaauacaaucauuaaaauuuuuuagauuuugggggaggggaccuguucuucacuauaucuacuauuugauuuguuuucauuguaauuaguacuuuuaccagucuacaaguuuuagggacuuaauuucuaauauuuuaauguugaccuagcaauagcaugauucugcucauauauuuugagcauauaugucauauaugaauuaaguuuugcuucuguagcuuuuuuuuuuuuuuuuuuuuugagauggagucuugcucuguugcccaggcuggaguacaauggcacgaucuccacucaccgcaaccuccaccuccuggauuugagugauucuccugcuucagccuccuaaguaucugggauuacaggugugcgccaccacaccuggcuaauuuuuuguaauuuuaguagagaugggguuucacccuguuggccaggcuggucucgaacuccugaccucaggugauccaccugccucggccucccaaagugcugggauuauaggcgugugcccccaugccuggcccacuguuuuuaaaggcacauaagucuuugaauaucagcuaauuuauguguguaggcaucaaaauaucuaagugaaaagaagagauguugaauacauuuuuuaaaaaucaccaggugauucugauacacccauguuauuuacauauagauuucucuuuguguaugaggugaaucuuaccuuauuucaggugacugacuagucagaccuucacucacaugucagugcuccaaauuugguuauauaaccacugguuuguugugccuuaaucaaauuaugaaaaaauaagauuuaauauauaaguuaaaucaagguuuauguauauauuccauaccuuuuauagaaggguguuauguguuaaugaaaugaaucuuuuaugggagguggcaucaauucaaguuaauaaaguauagaugcuuaucuugagauaauacagaauauguuaauaauauguguucuuaggauuuccacuggacaaagcgguugccuaugcaaaacucaggaauccauuuguaaucaaugacuugaauaugcaguaucucauacaagauaggugaguggugaaguuggcugaauuaagggaaggaaaaauaacauuaauuuaguaccuacuguacacugacauggcaucagguguuuuugcauuauuaauucauuguacuuucaaaauaauacucagaaauaguuauuuauuaccuaauuuuacagaugaggaaucuugauaauuaggaagauugauuaaucuacccaaagucacaaguuccccacguaguaggacaaagacuuaaccgagauuguuuaauuuccagagccuacuaaaccauucaaacuuaugagcacuuuuucugucaugggacugaugaugaaauuaggacuuuacucauuauaacuagauuuuuuuuuuuuuuuuugagauggagucuggcucugucgcccagucuggagugcaguggcgggaucucagcucacugcaagcucccccucccggguucccgccauucuccugccucagccucccgaguagcugggauuacaggcgcccgccaccacgcccagcuaauuuuuuguauuuuuaguagagacaggguuucaccguguuagccaggauggucucgaucuccugaccuugugauccgccugccucggccucccaaagugcugggauuauaggugugagccaccgcacccggccuauaacuagauuuuuuaaaugguaaaguauaccuauuuugaaaaauauuauacuguauaucuuagcauucauuuaacagguaaaaagcauggauuucuaauaaauuauaaaauaugaguguauuuauguauuucauucaaucaauguuucacuccuauagcuauucucauaaucucaccagcauucuauuuucuuguuuuaccauuacaauaugagauuuuauguguaugaaaaaugcuuuguaaauaugagaccuuaugguuuuuucacuuuauuuuuuucuauucuuccagagaguaacauuauuaauaucuaaaauuuaaaacauuuucucuacauuuacauauuaauucauauauauguguuuuuauauauacagcuauagcuauagaaauguauguucguuuuaaaugguuugaaaaguaaaagcguaccgaaagccauuuaaucgucacuguaucuaucauauuuuuuuccuauagaaaacaauacauacauaacaaucacauuuuaccaaauuagaaucacuuuucucuaguaugcugugaacauuucuccaugucauuaaauacuauuuaagcauaaggcuuuuaaugcuuagguaauguucuaucauugugauaauaucaacuuuauucagccauuuuuaaaauacauuuauguucucaguuuuaauaauuaguuucucaauaagcuagaaaagaauugugcauaaauuuguguucuuauugcugaauauuuccucagaauaccuuuuuugaauauucgaagugacauuuguuuauuuaaaaaauaaaaaguguugagauauauacccuuuuuaguuauagaacaacaauaaugucuuuuaagaaaacuacaauaauauauucauugugaaauggagcaauaaaacaauaaggauguuucccuuuuucuucaggagagaaguauauaguauucuucaagcugaagguauuuuacuuccucguuaugcuauuuugaaccgugacccaaauaaucccaaagguaagaguaagagauuuuagguaagcuuccuuugccacuugacauacuuuugggccacauucuuacaauaauuaacuggaaggaauuuaaagaauucauaguauucuauuccauuuuaaaaaauaaucuaaacagacaaacauauucaauuaaaaggugacacugaguuaaaaggcuaccuaauaauuuaggaauuauuuauccuucucuucuuuggccuacuuuugacauaucucuaagaaucaugaguuagaauuuugaaauuacauacaaguaaauguguauugauuaaaggugaacaagugauuuaucuaugacuauugaauuaaguauuagaaacuucaugcuacaaugccaaaaacuaaauacuggccaagaauuuggaaauacaguuggcccuggaacagcauguguuugaacugugcuggucugcuuauucauggaauaaacaugaauugaaaauacggaauucgugggucccacauauacugauagccaacuuuucauuuacauggauucugcagagccaacugugggacuugaguaugugaagauuuugguauacgaggggguuccuggaaccagucaccgcguaugacaaggggcaacaguacuucuaaguauuuauuaauauuuuaaagcacuguuugcuccuuuuuuucugguuaucuaaaacauagcauggaagcuauaccuaacuuagucacaaggcaaaauacguguuugucuugaguuaacauuucuguucacacuuaguauuguggggaauuuugaugaauuuaucauaccuuaaaccaucuuuuauuaaaaacuaggggggaggcagaacaagauggccaaauauacccuccagugauugucccacuccccacaggaacaccaaauuauaaacuagccaugcaagaaugcaccuucauaagaaccaaaaaauuaguccaccaagguggugccucuaggagucagcaagaguuuguagcauuccuggacuuagggcgcccccuagugcuaauacagcugcagugaccucaggcuuagaucauaacacuuagucuuuuuugaauauguggaaagcuuucucaagaaggauggauacaaacaagcccaaacggugaagacugaaauaaauaccuaacuuguaaauacccagacaucagugaaugucuacaagcaucaagaacauccagaaaaaugugaccucaccaaacaaacuaaauaagguaccaguuaccaauccuggagugauggagauaugugaccuuucagacagagaauucaaaauagcuguccugaggaagcucaagaacuucaguguaacauggagaaggaaucagaauuguaucaugagaaauuaacaaggagauugaaauaauucaaaacaagccaaaauucuggaacugaaaaauucaguugacaaacugaaauauauaucaaagccucucaacagcaaaguggaucaaguagaagaauuagugagcuugaaaacuggcuaugugaaaauccauagccagaggagaaagagaggaaaagaaugaaacacacuuacaggacuaaagagaccugagagaggagcuugaacaaacuucccagguagcacuuuucaucuuuuuagcccacuccuuucuucguuuuucuuuaagaacuuugggaccuacguaguuaauaaggggaagggaaaauguuaaaaaaaaaaaaaaaaaucuuaaaaauagccucaaagggacaaauccaagaauuagugcucuuaaagagaacauagaucaugguagaaaguuuauugaaauaagcaauaacagaacuuuccaaaccuaaagaaagauacgaauaugcauaggucauagaagaauaugaagauuuaacccaaauaagacuaucucaaggcauauauuaauuaaacucucaaaggucaaggauaaacaaagauccuuaaagcacccagagaauagauguauauaacauguaaagaagcucugauacaacuggcagcugacaucuaagcagaaagcuuauaggcuaggagagagugugauggcauucaaaguguugaaggaaaaacaaaacuuccaaccuagaauauucuauucagcaaaauuauccuucaggccgggcgcgguggcucacgccuguaaucccagcacuuugggaggccgaggcgggcggaucacgaggucaggagaucgagaccacggugaaaccccgucucuacuaaaaauacaaaaaauuagccgggcgcaguggcgggcgccuguagucccagcuacucgggaggcugaggcaggagaauggcgugaacccggaaggcggagcuugcagugagcggagaucgcgccacagcacucccgccugggcgacagaacgagacuccgucucaaaaaaaaaaaaaaaaaaaaauuauccuucaaacaugaagacauaauauacuuuacuaaacagaaacugagggauucaugaauuaccaguaucauggaauuuuucuguccuuauaggacaggauaggaaaaagaucuuacagaucuuuuacaggaaaugcuaaaaggaguucaucaaucugauagaaaaagacguuaaaaauaagaaaucaucugggccgggugcaguggcucacgucuguaaucccaacacuuugggaggccgagguggguggaucacgaggucaggagaucgagaccauccuagcuaacguggugaaaccccgucuuguguccggaauugguggguucuuggucucacuaauuucaagaaugaagccgcagacccucgcggugaguguuacagcucuuaagguggcacgucuggagucugucccuuccgauguucagauguguuuggaguuucuuccuucugguggguucguggucucgcuggcucaggagugaagcugcagaccuucgcggugaguguuacagcucuuaagguagcgcgucuggaguuguucguuccucccggugggcucuuggucuugcugggcucaggugugaagcugcagaucuucgcggugaguguuacagcucgggcagccugcuuuuauucucuuaucuggccccacccacauccugcugauugguagagccgaguggccuguuuugucagggcacugaugggugcguuuacaaucccugagcuagauacaaagguucuccacguccccaucagauuaguuagauacagaguuucgacacacagguucuccaaggccccaccagagcagcuagaugcagagugucgauuggugcauucacaaaccuugagcuaaacacagggugcugauugguguguuuacaaaccuugagcuagauacagagugccgauuggaguauuuacaaucccugagcuagaaauaaagguucuccaaggccccaccagagagcuagauacagaguguagauuggugcacucacaaaccuugagcuaaacacagggugcugauugguguauuuacaaucccugagcuagacauaaggacucuccaccuccccaccagacucaggagcccagcuggcuucacccaguggaucccgcaccagggcugcagguggagcugccugccagucacgcgccgugugcucgcacuccucagcccuuggguggucgaugggacugggcgccguggagcaggggguggugcucguuggggaggcucgggccgcacaggagcccauggagugggugggaggcucaggcauagcaggcugcaggucccgagcccugcccugcgggaaggcagcuaaggcucggugagaaauccagcgcagcgccggugggcuggcacugccgggggacccaguacacccuccgcagccacuggcccgggugcuaagucccucauuguccagggccaggcuggccggcugcuccgagugcggggcccgccaagcccaagcccacgcccacccagaacuccagcuggcccgcaagcaccgccccgcagccccaguucccgcucgcgccucucccuccacaucucccugcaaccugagggagugggcuccagccuuggccagcccagaaaggggcucccacagugcagcggcgggacgaagggcuccucaagcgccgccaaaguggaagcccaggcagaggaggcgccaagagcgagcgagggcugugaggacugcuagcacgcugucaccucucagucucuacuaaaaauacaaaaaaaauuagccgggugugguggcgggcgccuguagucccagcuacucgggaggcugaggcaggagaauggcaugaacccaggaggcggagcuugcagugagccaagauggcgccacugcacuccagccugggcgagugagcaagacuccgucucaaaaaaaaaaaaaaaauucaagaaaucaucugaauguguaaaacucacugguaauagcaaguacacagauaaauacauaauacucuaacacugucauugugguguacaaaccucuuauauauuucauaagaagacuaaaaggcaaaccugucagaaauaauaacuacaacaacuuuuuacgaguauagaaacauaaaaauagagacaacaaaaagucaaaacauggauggggggaaauggaguuaaaauguagaguuuuuaaaauuuucuuuuuauuuucuuuguaaucagaguuaaguugucaucaauuuaaaauaauuguaauaaaauguuauuuguaagccuuaugguaaucacaaaacaaaaaccuguaacagauacacaaaaaauaaaaagaaauuaaaacauacuaccagagagaauuacauauguguaguauuugagauagggucuugcucuucacccauguuagagugaaguggcgugaucacuuuucacuguagccucgacucccaagugauucucgcacuucagcuuccugaguagcugggacuacaagcacaagccaccagacccaaguaauuauuuuuuguagagacaggaucucacuguguagcccaggcugguuucaaaacuccuuggcucaugugauccuccugucucagacuccagaagugcuggggaccaucaugccccggcagaaaaucacuuugccacaaaggaagauaggucaggaaggaaggaagggaggacaaaauaauggaaaccucagaaaacaaaugccaaaauagcagaagcaagucuuuaccuaucaguaauaacgugaaugcaaaugagcugaauucuugcaacaaaacacuuagaguugcuaaauggauuaaaaaauaagauccaacucuauacucucuacauaugaucauuucaauugauggagaaaaagcauuugauaaaauuaaacaucccuucaugauaaaaucucucaaaaaacuggguauggaaugaacuuaccucuaugugauaaaagcgcuauaugacaaacccacagcuaacauuauacugaacagggaaaaggugaaaauauuuccucuaagaauuggaacaagacaaggaugucuacuuucaucucuuuuauucaacauaauacuggaaauuauagccagagaaauuagggaagagaaagaaauaaagggcauccaaauugaaaaaaaaggaguuacauuauucuuguuuauagaugauaugaucuuacaguuagaaaauccuagagucuuuaccacaaaacuauuagaacaaguucaguaaaguugcaggauacaauauuaacuuacaaaaauccauagcauuucuauaugcgaacagcaaacaaucugaaaaagaaacuaaaaaaaaaaaguaaucccauuuacaauagcuacaaauaaauuaaauaccucggaauucacuuaaagaaaugaaagaucucuucuacaaugaaaaccauaaaaugcugaugaaaaaaauugaagagaacacacaaaaaaauggaaaaauacuccauuuucauugauugaaagaaucaguauuguuaaaauugccauacuacccaaagccaucuacagauucaaugcagucagaauagcaaagacauucuucacagaaauagaaaaaaaauacuaaaauuuauauggaaccacaaaaaacucagaauagccauagccagccugagcaaaaacaacaaaacuggaggaaucacauuauuugacuucaaguuguacugcuaagcuauaguaaccaaaacaggaugguacuggcaucaaaauauagaccaauggaacagaaugcagaauccagaaaaaaauauacacauuugcaguuaacucauuuucgacaaaguugaccagaauguccacuggggauaggacagugucuucaguaaguaguguugggaaaacuugauaucuauauccagaaucaaauuaagccccuaucucucuccauauacauaaucaaaauggauuaaauacuuaaaucuaagaccugaagcuaugcaacuacuaaaagaaaacauuguagaaacacuccaggauacuggucugggcaaaaauuucuugaguaagaccucagaaacccaggcaaccaaagcaaaaauauaccaaugggaucauaucaaccuaaaaaacuucugcacagcaaaggaaacaauacagugaagagacaguccacggaaugggagaagauauuuguaaacuacccauuugacaagggacuaauaaccagaauauauaagaagcucaaacagcucuauaggaaaaaaaaaaucuaauuaaaauaugggcaaaagauuugaacagauuuuucucaaaggaagacauacaaauggccaauagguauaugaaaauaugcucaacgucaccaaucaucagagaaaugcaaaucaaaucugugaugagauaucaacucauccaaguuaaaauggcuuuuaucaagaagacaagcaauaagaaauguuugugaggauguggagaaagggaauacuguuggugggaaugugaauuaguaaagccacuauugagaacaaaauggagguuccucaaaaaacuaaaaauagagcuaccauaugaucuugcaaucccacugcuggguauauguccaaaaaagaggaaaucaguauauugaagagauauuugcacucauguuuauugcagcaccacuuggaauagccaguauggaaacaaccuaaggguccauuaauggauggauaaagaaaaugugguaccuauagauaaugguauauuauucagcuauaaaaauaaugaaauccugucauuugcaacaacauggauggaacuggaggucuuauguuaagugaaauaagccaggcaagaaagaaagauugcauguuuucacgugugggagcuuaaaaaaaagaugaacucuuagagcuugagcauagaauacuuguuacuggagggaaggguugcaaggaugacggggaugaagugaggauaguuagugaguauagcaacacagauagaauaaauaagauccaguauuugguagcacaauagggugacuauaguuuacaauaauuuauuuuauauuuugaaauaacuaaaagugaaauuagaauguuccuaacacaaagaaaugauaaauguuugagguggugaauaccccaacuauuccaguuugauuauuacacauuguaugccuguaucagaauuucacguggaccacaaaaauauauacaacuacuauguacccaugaugauuaaaaauaacauuuaaaaaagauauaaaguaaucaucaucugaaacaagaaacuuuucuugucuagagguaaaaaauuaacuuucuaauugaauugcuggcuuacuuugcauauaagcuacuuucuaacuuaaauaacuucauguuuuacgauaucugugauaugaguaaucucacaguuuucagaagaugguggcauucuugaguuacuucucagucuuucuugauauaauaauuucacaucuaacuuugaauucuguggugugguagugugaaaugguaagucuguaaaauuuugaagaacuauagcuuuuaaugccauacguaucauaaauguuggcacauguuauuuacauaaacauggauaauuaaaaucaaguaaguacauuauccaaguuuucuuuuauggucuuuuagugaaaaaguccucgauaauaaugugguguccugauaauauaauaagaauaugugauauuucuugcaaucguguuuguuuuauagaauguaaucugauugaaggggaagaucauguagaaguaaauggggaaguuuuucaaaagccauuuguagaaaagccagucagugcagaagaucacaauguuuacauuuauuacccaacuucugcuggugguggaagucaaagacucuuuagaaagguaacaccuuuguaacuuuuguaugaauacucuucuuuguacauugucguguauuauuaaaagcaaucaagcauuuaauuaccguuaaauauugaacucuugaaaauguaucauuuagagguaaauuuaugaaacugauauacuuuguuagaaaagcauggcaucauuuuaguuauuuaauguuguuaagcagaauuucugccugcagaaugccaggaaagauacuugacuuuucuuuucccucccauuuuguacaucugucaaacuagaaauucacuuaagcaguagcagucuuuuagaauaauggcccagaaaaauaacagcucauagaaaaaguaacacuaauaacuuuacguacaugaaaguauacuuaauuguacucaaaugcaaauuaaauugagauauaaugacauuguauuacuuuuuggauugacaaagauaaaaaauauugagcuaguugagaaauaagcacaagaccaaacauuguuggcagaaauacaaagcaauguagccucuuaacaauauaauuuagcaauguaucagaauguaaaaugcauauacauauagaaauugauggcaauucaaauuaagaacacagugagauaccauuuuaacauccauuaaaguagcagauauuaagaagccuaacaauaacaaguguaaacaaggauguagaacagugaaaacuuacacauugcugaugagacccuacauuguuaaaauaguugauaaagauuuuucauuaucuucacaaguugcauaugagcacauucuauuaaugagcaguuccacuuuuauuauauaccuuagaaacacucauacauguuugccguugggacacauaagaauguugaaagcaacauuauuguaaucaccaaagcuuggaaaacaaccuaaacauacauugauaggagaauggauaaauucugguguauuuacacaauggaaaauucuagaguaguaaaaaugaacaagcuugaguuacaugcagcaaccuggaugaaucuuaagaacauaauucuuaauguucauuguauuucuauguucucuaauauauaaguuaugguaacaauagagacuacuauagugccaaguauauaguaaguuuuguuaaauauuuguggauuaaaaaauguauuugaaaaugucuaagauggaaauagaugguaaauaaacuauuugucauuuuaucauaaaaaugagggaaauaauuugcuuuuuuauaucgauggacaucuuuuguuuucagauuggcaguagaaguaguguuuauucuccagaaagcaauguacgaaaaacaggcucauauauauaugaagaguuuaugcccacagaugguacugauguuaagguaggauugauuaaaauagauuuuaguuuuauauuucaaguuuaccaaugauaucagaaaaaguaguuaaucuuuagcuauaucuaaccuuuauucuggaucucuuucuuuuugauuagggauuccucauguuuuguaacaacaacaucuuuagcagucugaagccuauggacucuuuuuuaagaguaguguuuuuaaaugcuuuaaacauguaagauuaugauggagacaaauuuuauucaaauauaauaaaauauuuaaaaaccaacuuuguguuacacauaauaugucuuuaaaggggcauuaaauaauaagauaccagggauaaaggucuaauaaccaccacaguuuccaagcagugauuaguguaagugagguuuugagaucugugacaacugugaugugauauaaaacaugucugucauuuuaguuggugacaaauaggucuuaaucgcuuuaccuucagccauucucucucuaaccagaauguuuucuaaaguauaaaucugaguaugaauccuuaaaaauucucuaguggauccuuauugaccacaggauaauaaccagauucauaauccugccauacaagauauuucagucuguccucucuuugucuuauaaaccucauuucuuacaguauaaacuacaucagauaacuugccgauaccugaauacaucaugcuguucaugccucuuuccuuuacuuuucuucucuuaccugcacucagauuaugcccucacccuuuuaaagauguucuuuuggaagguuuuuuuuuuccuguaaguuuuauaguuauuugcaucucucauuuguuaaacuaaaacaauuugaggagagcgaucacauuguauacauccuaguauucccucguaauacucaauauaauaguuuucuauagagaaugaaacuucacuuuaccaauuuugcuauauaaugauuacuuacaaccuuucccaaugaacugaaaauuugggcauguaaaauagaaagaugugucuacuagccuggauucugaacuauuuuuuaguaauuuuuucauuguauuuguugucuguugguuacacacacacacacacauacauauauauauuuauacauuuauuaaacauuugugaaagguuuauacaguggguccagauuaugcccaugcugaagcucgaaaaucuccagcacuugauggcaagguggaacgagacagugaaggaaaagaaguaagauacccuguuauucucaaugcacgagagaaauuaauugcuuggaaagucugccuugcuuuuaagguaagauguuauacaggccuauagauccuuauaaagguaaauucuaauuuucuuuuuugacuaagacauuauuggugcuuauaauuggagaaguaaaccgagaaaguaauuaauacaucugaaugguucauguacuuuucaagggauucuuguggugccaauauauucuuuuguauuauauaaaagaaaaccuggucaauuuauucagaaauuaaaaauaaaauaaaaauucagaaaugacucagcugaucaguguuuuaggguuauugucuagcauacuuuuugaaacuggcuuuaaguguuacuuucauagaauugguaagauuuuuuuguugaaugaaaacaguucucaguggucuauguucaugaaaacaauauaaaaacauuucuuuuuuuuuuuuuugagacggagucucgcugucacccaggcuggagugcaguggcaggaucuuggcucacugcaaccucugccucccggguucaagcgauucuccugccucagccuccagaguagcugggauuacaggcacccaccaccaugcccggcuaauuuuuguauuuuuaguagagaggggguuucuccacguuggccaggcucaucucaaacuccugaccucgugaucugcccaccucggcuucccaaagugcuggaauuacaggugugagccacugcacccggccaaaaccauuucuugaaaaaaacuuuuuuacuucugacauuugacuaauucucucaaucuauauuguuaaguuucuuccuaacuacuguauaguaaagauuuaaauagaaguacuacaaccuuccuuuaaugaaggauaaaaauuuuaccuucuugaaaucuuaaagacuaguauauauuacugguuguuaaauaauaaauaauuauuuugugccuuaauaauuugaagugucuuucauggaaggaauguuagccuguaaauaaguuuuaauagcuuuauagaaauccuuuuauuaugccaggauucugaaagcugugacaaaaaaucacauuauacuaauaccugaugauugaacuuaaaauguagaucagaaaguucuuagagccugaguggcaaauucaugccuuuuggccauuuucuucacccagauaaaguaaauuuauuacagguguucacgaauaugugguauuagggguuuaaaagaucacaggauuucgacugggcgugguggcucacacccauaaucccagcacuuugggggugcugagguagguggaucacuugaggccagaacuccagaccagccuagcuaacauagcaaaacccugucuauacuaaaaauacaaaaauuagccuugugguggcucacaccuguaaucccagcuacugcgguggcuggggcacaagaauuccuugaaccugggaaguggagguugcagugagccaacauugugccacugcacuccagccugggugacagagcgacacuaccucucaaaaccaaacaaaacagaucacaagauuuccucuggaauauguccucaaaacuauucuccacguccauccuccuuuuuuuuuuuuuuuuuuuuuuuuauuaacaugguguaauuucugcuagagccaauuuuuuuuuaucagauccuuuaaaaauuuugcuuuuguuuuuaaauuaaauguuaauugaagaacuuugugaucaaauauauuauuuuugggccucuguagccccuuaugcguuauuguuguacaucuacuuuaugaugaaagacuuaaauaaucauauagccucuauaauguauuuucagaguacucaaguuauaaauaaguaauuucuuucauuucuuauuaugaaguaaaccacuauauaguaauauacuuuuaagcauuuauaaaauuugauauguucugauaggacuagaaaacugugaaucuuaauaauuuaaauaaaaccuuaaaguuuauaacuuauuuuaaauagcaaacaguuuguggcuuugauuuguuacgggccaauggacaguccuaugucugugaugucaauggcuucaguuuugugaaaaauuccaugaaguauuaugaugacugugcaaaaauacuuggguaagaauuuuuaaauuuuucuuuuuaccuucauauacuaguuauucagaaaccaaauaacuguuaacauuaaaugaucaggguuuuuaagcauucuagaguaaagaucaguguucauaaaaugauacccccagagacuaugccagauccugaauuauacuuuggcuuaucaaagacagauuaauuuaugaucaguauagaugaaaaccuuuaacuucauauguuuacaaauacuauaacaugcugauuauuagucaaaaguuuauuuguuagaauacuuuauuccucaaauuuuugccauguaguuauaguggaaaagguuuucuucuacuuaauggacaaaauuaacauucaugaaauaaacagaguaaaauagaaauauuuagaauucaugacucuuuugcaugacaauucauucuacaagcauauguuacuugaugauauuuucauaagauuaucaagugaauguaaaaaaauuauuguagguagaaaugccauuuuuauauucuucaaccuguuuucuuuauaccuugauucagaagacuagcaaggcaauaacuauuuuuaagacauuuccagguauauaugacaaauccauaggaaacuuacauuaaaaaauguucgauaauuggagcuagcuuuuauacugguuaaguaucccuuauccaaaaugcaugggaccagaaguguuuuggauuucagauuuucagauuaagaacauuuaacccacaguauguuucaaagauuuacaaacuuacccuuaaagugauguaagggagaguuuacuaaauuuuagcauaaauaaaugcuaaauuuaaacaaagccaaaaaguaaacauuuuuccauuuuuaacccuauuaguauaguagugauuuguuaagaugaacacaauauuuagaguagcauuauagauguucaauaaagugauaagaauuuaucaguagccacacagaagagacaaucuugaauuucagaauguauguaguuagaugugauguaauuguagugauuucuuugaauccaauguugauugauauuuuaaaacuaaaguaaauaaucucaaauuugugaaaucccauugaugugucuaauacaucaauuuggaacugcugauuuuuauuuuuucuugaucagaauggauucuguggguuaucuuuuaugugauguaaucacuagauaguuuaacucuuaugauucucucucauccucauuaaguacccaguuuugucuuaaaacguacuaauuuuaaaucuuuucuuuuuugucuugaagaaauauuguaaugcgagaacuugcuccacaauuucauauuccauggucaauacccuuagaagcugaagauaucccaauuguaccaacuacaucuggaacuauguaagucugaauuauuuucauuuagaaauugaguuuuccuugccaucugugcuauuaggauaaaaauuaaauuucugaaugaugauuagacacuuuaguguguaugauuucauaugauucagcuugaagauagaggaguagauuauacguauuuauaaggguccacuaauuguuacaaauaaacuacugaaacaugccuggauaauuauagaauuguuuaaucaagccauaaaaauaaaaaagguaccaauaggaauguuacuuaaagguucauaguggucuuacaacuuuugcucucucaagucauaucuugcauaauuauaccaguauugccaaaauguuuuauaacauucucuuacugaaaauuauuccuuuaaauucaugucaguugacugaaugcuuuuuuuucacaacuuagauauuuauauuaacauguuaaauauccugagauguacugaugauggggggaacuaauuuuguuuuuaaucagcauuuuucauacugauuuaacacgcaaguguuaaauaaaauuuuuuucagguaacucaauugauaauccugcaggguuauguucugcaguucacacuucagcacacacuagauuauaccucugaauucuagcaugcuucuaagaugauuuuaucuuccaguaauuugaguuguaaauacuuguucuccuuacaugggcaaaacuuagcaaauauauaaauauagcaaccaucauguaaaguuuuauuuugauuuaaugaagucucagucuguagugaccuaaugcuauggaucagauauauaagaaagcucagaaauuguaguccaucuacuuuuaucccagaguuaauguagccauuucuagagaagaaaagguuguauucuacuauauagcuuaauaucaccucccucccccagcuucuuaaguucuuuuugaauuuuauuucauaaaguuaaaacuagauuguuauaaguauuauucuucaugggaaagaucuugaagugguaaaagauggcuuuaaauagaugacuaaauguucauauuaaucugaauuauacaacacaaaucuuuuuuagagaauuaagaacauauauauuuuuucauuuuaggauggaacuuagaugugucauagcuguuauacgucauggggaucgaacaccaaaacaaaaaaugaaaauggaagugagacaucagaaguauguuuucagaugaauaauuuaacaugcaugauacaauuuuaagauuucugauaagugaucaacucuuuugauuaauacaucauauagaaaaacuuuuaucuacugucucuuggccauuuauauuuaaaccaguggguggguacaaaauccauuuaaaauauguucauuagcaucuaaaauuauuguggcaauauucauaaauaucaucagucugcccuggcuuucauuuauugucauaaagguguucuauuuaaucuuugcuuaucacucucuuguauugcauucugagagugaguaaucccucagccuuuuagaagaaaauuaguagaaugaaaguuucuguuauuucuauccaguguuugguuuggagaugauaaaauuugaaaacccugagccauuaaguauguguugacacaaguaauuuucaauguauaugcaaugacuucagaaaauauauaauauuaugaacuauaauuguauguuugguuuccgugaaaaaacuuugaaaaguaguauggugauuauuaguuugguaucauuuaggaaaguacuaaguuuuaucaaucaaaguugagcagcaacauguacagugaaagaggaaacacaguacuugaaauccuuagaucccaaguucuagucccauagcuuaucauuuauuauuuguuaguuuaaacauauauugguaauguuaauuauugcaagugacuaacaguguucugucuuuuuuauaagauuuuuugaucuuuuugaaaagugugauggauauaaaucagggaaauuaaaacucaaaaaaccaaaacaguuacaggcaaguguauuugcuuucuuguuuaauuuuaaauuuuuuaguggugaaauuacauaaaaauucaauuuuuuauuaauuuauuuuauaggaagugcuagauauugcacgacagcuucuuauggagcuagggcaaaauaaugauucugaaauugaagaaaacaagccaaaacuugaacaacuuaagacuguauuagagaugugaguaucuuuuugaaacgcuuaauugugguacuacauauagcucuucuuuuuuauguaugugauuuuccauuuuaauuacuuucacagucugaucuuuuuacucuuuguuacuauaguugagacaugaaggaaaaucuaaugugaaaaaaauagauugcuguauugaagguuuuagcuuuaguuuuaauuuuggugagaagauuaaacaaggacaucaaauuugugucuucugugaaauacugcuuagaaugaaggccacauugcuaacuugaccauagauucauugcaguuuaaauauaaaaaauuugaauuuugccuuaaucaaguaaaauggauacccaccaauauuccuguuacagcuuuacauuuuuaaucucuuacaaucuuauuuccuuuauuucuuaaaacacauacaucuguguuuuuacauauuucuguacuuuaucucuucagaguugucuuuuuuuuuuuuuuuuuuuuuuuuuuuuuuuuuuuuuugagacagggucuuauucugucacccaggcuggagucaguggugugaucucagcucacugcaaccucucccccucccaaguucaagcaguucucaugccucagccucccaaguaucugggaccacaggcacacaccaccaugccuggcuaauuuuuguauuuuuaguggagacaguuucaccauguuggccaggcuggucucgaacuccugaccucaagucauccacucaccucggccucccaaagugcugggauuacaggcuugagccauggcacccacgccuguaauuuuuagaaaaacauuuuuguuuuuaaugugguuagaaugauuauauaugguacaauuuuuuuuugauagaauauuucgaagaauuaaacaggcgguuacaaauaaaagggagcaugaauaugugagaauuaguuuuucccuacauguucuauucuguuuaucauuuuauuuuucagguauggucauuuuucuggaauaaaucguaagguucaguugaccuaucucccucaugguuguccuaaaacaucuagugaagaggaggguauguuauucuuaaugcuuauacaguaguuuuauauguaguaacuuguuauucacuguugauuaccuuuggaccaucuuuugcuuaguaguuuagggaauggcauggugaggaaaaauaaaguggaauuaucuuagcugugcuuccuuuucuuuaaauaaaggauacaauuuuaaaauuaccuauucuuuaaacaaaggauagauuuuauuguucugaaaacugcauaggaauuccuuuuaacugcgggauuguuucggaaaacuuauuuguuuauaacuaaguguuauuuaaugggcuccuuacaucaccuuuugauaguagagggcagaguauauaagaagaaaggccaagaaguacaaaaagacuuugaaaaaauauacaauuaaccuguuucuaaaauaaauggguauuuucuuccacccaguaaaccagaguaagucuuuaaacaaguuuggucuccuaagagcagucaguauccacauucauaaaugcauuuaccuuacaaaagaaaaggguagggauuggggaagucauuucauagagaaaugcagaugaccaauaaaauaauaaugauaguaauaauaaucugucuugccuaucauauuggcaaaguguuuucuucguuucuguuuuaaacugguaauaaagugugcugaugagaauucauugagacaggauuucagucuauaguagaaguauaaauuggcacaguguuuugaaaaguaacuuggcaauauaucaaaaacuucagaaaauguacuuaugcuuugaccugaauucugcuuaucaggaucuaacccaaagaaguaaucagauguucagggaaagauuaucuauagggauauucauagugguauuauuuauaguagcaaaaauuaaugauuaucuuaaaugcagacacauauuuauaauaaucuuuauauauuuaguuuaacauuugauauauugcucuuaucacauuuugugguuaauaguaauacagguuaauuuucuauaucuuaguauuuaucaucaaaaacauucuauaagcaaauaauuuaaaaaguuagguaacuaacuuucuuuccauaaauuaauauuggucuacaugacaaagcucacagaaccgcuaacuugcugcaggggaaggggugauuuccucucaccuuuaaagaaugauuauuaaguucuuuuagugcuuauaaugcuuauuuuugaauuacuuuuuuuuucagaacccaacacagaucuuaauaccaugaaaaggaguaggucaaaauuaaguacagaaacucauuaacuuaugguauuuucuuuguucaagaaaauacucugauguguaacaugcagagauuccacaauuucaaauuuaaaaagcugcucuugaauaccuuuuguuugcguaaaauuuauuagauugcauaaaauuuaaauuagaauaaauguuaggcucugucaucucacaucuuccuaaaaaugaugcaaaucaccgauuuccaaucuuaaaaacauauguaucuggccgggcgcaguggcucacgccuuaaucccagcacuuuaggaggccgagguggguggaucaccugaggucaagauuucgagaccagccuggccaacauggugaaaccccgucucuacuaaaaauacaaaaauuagccaggcgccuguagagccaagaucgugccauugcacuccagccagggcgaccaagcgagacucugucucaaaaaaaaaaaacaaaaaaauauauauaucuucuucacuucaacuaagguauuuucuuucaugggacagcacugcaaagggugcuugauagcaaggcagauaaaaccuggauucgggcaucaaggagcuguuaauccagcagacauagcacaacuaaauuaaguacaaugaaaaaauuacuaugagagcaggcaagggagaaacauuacaucccugaagaaaauugggagccauuuuucuaaaguaugagagagauuuucaaauuucaguaagauuuaaacagguauagcaagggaguauuccuuacagaagcaacugccuacaaacggcauuaaggaacauacaugcaacagcauuuaaggaagaaaauaucuuacauaugggccauauuucacugcagaagagagcacagagaaaaaaaugaaucuuaagucuguuuaaagaaauaaacuuaacauuuguuuuauucauucauaugugucauagacagccgaagagaagaaccaucuuuacuuuugguucuaaaauggggaggugaauuaacuccugcaggcaggguccaggcugaagaacuuggaagagccuucagguguauguauccuggaggucaagguaaaucuuagaguuuucuuuaauuugacuaauuucauaaauuguauuuugaaauccucauuugugauguuauuaaacauuuauagaaauacaaugaaaugaaaauauagcugaagugauuugaggauuuauuuucaggagauuaugcaggauuuccugguugugguuuacuuagauuacauagcaccuacagacaugaccucaaaauauaugccucugaugaaggacgaguccagaugacugcagcugcuuuugcaaagguauaaauaauuuuuuuuuagaauuauuagaguuuuuaaucuaauauuguaucuuaaaacauuuuuggcugggcgcaguggcuuacaccuguaauccuagcacuuugggaggcugagguggucagaucacuagagcccaggaguuugagacaagccugggcaacaugacgaaaccugucucugcaaaaaaauuaaaaaaauaaaaauuagccagguguagugguucacaccuguagucccagcagcucaggaggcugagaugggaggaucaccugagcccaggaggucaaggcugcaaugagccaaaaucacaccgcugcacucuaccgcaggcaacagugucagacccuugucucaaaaaaaaaccaaaauuuuuuuaaccaaggaauauuuaaaaauucuguauuuggaacuuucaaguaaaacucuaaaaugacaauaaugaacuguaguauuaauaaaguuuauuuaugauaaacuuaacuuauacuuuaugaaaaucaguauguaacaaaauauuauuuuacguauuaauuuuuuaaauucguguuuucuuuauuuaauaugcuuaggggcuuuuagcuuuggaaggagagcuuacacccauucuuguucaaauggugaaaagugcaaauaugaacggucuuuuggauagugauagugacucucugagcaguugucagcaacgugugaaggcaaggcuucaugaaauacuucagaaagacagagauuuuacugcugaagauuaugaaaaggugggucuuagcaaacucuuauauugugaaauauuacacacacacagaaaagugauaagugcauaaaacauacauguagagcuuauuguauuauaaagcaaauacacauguuaucauccuccagguaaagaaauagaacauuggaacaacuuuggcuucuguaugccccuuuucaaucgcaacccauucccuaccuccucaaaaaaacuacuguccugacuuuuuauauucuuuucauauccagaauacuuacuugaauaauaaguauagucucuaaccaguguagucuaauuuuuggcuuuuuucuaacuuuaaaucuauugauuuuaauuggcaaauuaaaauuauauauguuuaugacacaacauguuuuaaaauauauaugcauugugaaauggcuaacuuaagcuaauuaacauauguauuaccucacauccuuauuuauuugugaugagaacauuuaaaaucuacucucagcaauuuucaaggauaaaacauauugcuauuacuauaaucaccauguuguacaauagagcuccugaacuuauuccuucuguccaacugaaauuguguaucccuugaccaacaucuucccaaccccuuccuuuuccagccucugguagccaucauuuuacucugcuucucuaaguuuaacuuuuuuagauucuacauauaagugagauuauacauauuugucauucugugccuggcuuauuucacuuaacauagugucuucuagguucauccauguuguugcuaaugauaggauuuccuucuuuuuuaaggcuagaugaugauacuucaucuuguauauauacuacacuuucuuuauucauucaucuguuauuggacagguugauuccagaucuuaucuauugugaacaguguuacaauaaaaaugggaaugcaaauaucuccuugauauacgauuucauuuccuuuagcuguauaccuaguauugggauuguuggaucauaugguuuuucugucuucaguuuuuugagcaauguucauacuguuuucuauaauggcucuacaguauuaauuuacuuuggcuauuuuuuaagguucauagaacauguuuuauuuuauauuuggcuucuuuuauuuaauauuuuauuugugaaauucaaccauauuaaguaauggucauaguuaguuaauaaucauugcuguguuugcuguauuccauuucaggguuggcagaacuuuucuguaaaaggccagauaguaaauauuuuauuuaaaaaaauuagacuuugcaguccaaauauggucucuguugcauauuguuuuuguuuucuuuuaacugccuuuuaagcauguaaaaaccauucuuagcucauggccuguguaacaggccacauuugaccugcaggcuauaguuuguugauccauguacuacuuuaugaacauauuacaauuuauauaugcuuucuauuauuguuagaguuuuggacuguuaggauuaaaguugccaugaauauccugguauggcaccugugcaaugagcauacguuucucuuggguauauuguaggaguggaauuauugugaccaugguauacuuauuuacaauguuagcagguaaugucaaacuguuuuuuuuuucuuuuuugucuuuucauucuuuuuuuuuuuuaaauuauacuuuaaguuauaggguacaugugcacgacgugcagauuuguuacauauguauacaugugccauguuggugugcugcacccauuaacucgucauuuacauuagguauaucuccuaaugcuuucccuccccccaacccccacccccacaacaggccccaguguaugauguuccccuuccuguguccaaguguucucauuguucaguucccaccugugagugagaacaugcgguguuugguuuuuuguccuuucgauaguuugcugagaaugaugguuuccagcuucauccaugucccuacaaaggacauuaacucaucauuuuuuauggcugcauaguauuccaugguguauaugugccacauuuucuuaaucuagucuaucauugauggacauuuggauugguuccaagucuuuguuauugugaauggugccacaauaaacauacgugugcaugugucuuuacagcagcaugauuuauaauccuuuggguauauacccaguaaugggauggcugggucaaaugguauuucuaguucuagauccuugaggaaucgccauacugucuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagccaugugucuguuggcugcauaaaugucuucuuuugagaagugucuguucauauccuucacccacuuuuugaugggguuguuuguuuuuuucuuguaaauuucuuugaguucuuuguagauucuggauauuagcccuuugucagaugaguagauuguaaaacuuuucucccauucuguagguugccuguucacucugaugguaguuucuuuugcugugcagaagcucuugaguuuaauuagaucccauuugucaauuuuggcuuuuguugccacugccuuugguguuuucuaaugcuauugagcuaauuuacacucccaccagaggucaaugauaguugucauugcuccacauauucuccauucuugggauucucagaugauuccauuuuggucauucugguggauauaccuagaauuuacuuuauuguggcuucaaugucuauugaccauuuagauauccucuugaaugaggacaagucucuuguccuuuuucugugaauugucuauguuuuucuucuuggaugguagaaguucuuuauauauucuggauaugaguucuuuguuacauguagauaacauaaaguuaacaccaccuacucugagccuuaaugaugucaugauguguuuucuuuuuuuuuuuuuuguuuuuuuguuuuguagagacaaugucuugcucugucacccaggcgggagugcaguggugugaucauagcucacuguggccugaaaccccugggcucaagugauucuccugccucagccuccugaguagcugagacuacaggugcacgccaccaugcucagcuaacuuuuuaaauuuuuguagagacugggucucacuguguugcccaggcuagucucgaacucuuggccucaagugauccuccugccuugacaucccaaggcuuuggaauuacaggcaugagccaccaugcccagccaauaauaucuuuugauaagcaaaaguuauaguuuuucaugauuuccaaguucauuuuuuuccccuuagggucaaugcauuuuaauauauuguuuaagauaucuuuuucggagaagaggccauaagauauauauaucuucuauaaacuuacuguuuugcucuucacauuuaucuguauaucagauaaaauugacuuuugugugugcuaugagcuaagaaugucaagguuguuauuuccccugcaacuauauauacaucugggugucccagcagaacauacugaaaagacuauucuuucccauuacucagaaguaccauauuuauuauauaugugugaucuguuucuggacccuguauucuguuuguugauccgugugccaaugaauaauaccucccaacaccccaaauggauccuucuucaaguguuuuuuuuuuuuuuuuuuuuugcauuuucauauaaauuuuaaaacaagcuggucaaaaauacuguugggauuuuuuuauuuagguuguaugauaucuguaguuugugcaaauuuacauuuuuuucucuagucuuucaaucugugaauguaguguagcucauuuauuuagauauucuuuaauaucuuucaauaauguuuuauaauuuacuucacagaguucuugugcaucuuuguuagauuuaggcuaaggugauugauauugugcaauuauaaaugggcccucuuuaaaaguuuuauucucuguuguugcuauauagaaauauaauuaguuuuaaaauauugagauuauaggcaucaaccuugucgaacucauuaguucuaauaauuuaucuagauuuguuucauucuuuaacugcacaucuauacuuuuuuucuuuuccaaucuuuguuuuuuaaaaauucuuuuucuugcuuuccauagguaggacccucaaaauaauauuaaauaaaaguagcauuucuaguaacacuuguacauuaaauauaaaguuuucuguagauauuuuauauagcugcccuucaaaauaaggaaauuucauuguuucuauuuggcugaguuuccauuauaaaaacguacugaauuuuaucauauuuucuuucaucuauuauaucuuacaguuuuuugaaugugaaacuaaccuugguucuagaauauccucagcuuuuccauguaugaucuuuuucuuucauaucacugauuuuaguuugcugaaauuuugguuaggaauuuugaaucuauguucaugucagauuggccuuuacuuuuuuauuuuuguugugucuuauuucaaugucaggauuaugcuagucuuguaaaauuaguuagggaaugcuuccuauuugaggagaauaguauauguacaaauauuucauuaaauuuuuaguaagcuuuacuaguaaauaguaugguaaauccuguggguguuuucuuugugggaaaguuucuaauuauggaauucagaauaguuuaguacuucucaguuauguuuaugucaauauuauuaaauuauauuuuuuagaaguuuguucauaauuucuuuguaauuuguguaggaucuauagagauuucccuuuuucuuucauaacauuauacuuuuuuccuuuucuucuugaucaguuucaccaugguugauuaguuuauuaguccuuucaaagaaccauuguuaagauuuguuaggucucugaauuauaugcuuauuuuccauuugauuaauucucauugcuuaauauuuuauuucuucuaccucucuaguuuuauuuugcuauuuuucugauucucgaaauuaauaacaccaggugaauacuuacuaaguuauuaauguucugucuuuuacaaaaugugcacccuaggccguauauuuuccuuuaugcacucuuuugacuggagucauuuauuauauucauaaauauaaauguuuccaguggagaaacagccuuaaauucuaggcucacuuucuggaucacugaccuuugaguuuugcuuccauaauucuuuaccaccuuguuauuucacagauuccuuaaagcauacauauagauauucuuugcccagaauuuuuacuucccuucaguggauauauugguccaaacuaccuaguuuauuauaaccagaaguagaauugcacuugacauuuuuuauauuguagaaacuuacuuaaugugguuaaauaacuugccaagcuaaaugucaaaacuggaauguggaacuauauuuuuauugauggcuuuuauucaaaaaaauucauuacaaauucauuacaaaggcauaacaggauagugguuuagagcaccagucuguagccagacuaccugcauuugaguccuacuccuuuacauccuagugguuugaucuuaagcaaguagcuuaaccucagguaagucacucaucugggaaaagauaauaauagaugccuagaguuauuacauguaaauauaugucaaguggucagaaccauauuuacacauguuaacagagucagcagauugucaucaaauuccauuaaguuagaguguugcugcuaaauuuucuuuauugauaagacagcuaagguuuaauauuuuuuaacaugaauucugagucuuuuacuuccuccuugaucucauuacuauacaguucaccuuuagacaauguugggguuggaagugccagucccccucacaguaaaaaaauucguguauaacuuuugacucugcaaaaacuuaacuaccaaguuaagccuaccuuugacuggaagccuuagcaauaaugugaacaaugaacauauaugaaugcucauuaugaaaaaacuauacacaaauuucaacuuuuuuuuacacuaaaauaaucuuguauuaucuuguuaugacaugucugaacaggauuuaguuugaggcacuaacaagaguaagacaucaguuugaagagagccccugcgaggggcaacaugaauucugcuaaaauugaaacaagaacaaacagcaaauuuauggugaagcuuaagugaaaaaaauggugaaaucauugacacuuuacaaaaaguuuauaggaacaguuucccgaagaaaucagcaguauacaaauggauaacucguuuuaagaugggacgagaugauguugaagaugaagcccucaaaggcagaccauccacaucaauuuugcaaggaaaaaauuaaucuuguucaugcccuaauugaagaagaccaauaauuaacagcagaaacaauagccaguaccauagacaucucaguugguuuaacuuacacaauucugacugaaaaauuaaaguugagcaaacuuucugcuuagagugccagaaccauugugcucagaucagcuauagacaguagcagagcuuucaauggaaauuuuaaacaagugggaugaagaucccaaagcauuucuuugaagaauuguaacagaagaugaaacugauuuuaccaggaugacccugaagauaaagcacaaucaaaguaauggcuaccaagaaguggaauugguccagucaaagcagaagcagacuggucaagagcagaggucauggcaauaguuuuuugggacgcucaaggcauuuugcuugcugacuuucuggagugcuaaaaagcaauaacaucugcuuauuaugagauuguuuugagagaguuagccaaagcauuaguagaaaacacccacaaaaucuucacuacagaguccuccaucaugacaaugcuccugcuuauuccucucagacaagggcaguuuugcaagaguuucagugggagaucauuaggaaucuaccuugucguccugauguggcuccuucugacuucuguuuguuuccuaaucuuaaaaaaauauuuaaggggcacucauuuuucuucaguuaauaauguaaaaagucugcauugacguggguaaauucccaggauccuccauauuuuaggaauagacuaaauggcugguaucaucgcuuacaaaagugucuugacccugacagaccuuagguugagaaauaaaguuuuuuacuuuuaucuuuuaauucaauuuuuccacauacuuucuggaaguuccccaguauuuuguauauguauuauaugcucuagucuuacaacagagggaacuagagaaaagaaaauauuaagaaaauucuagagugagcuagagaaaagaaaauguuauuaagaaaauuauaaggaagagaauauauuuacuaugccuuaaggggaaauagaucaucuuagaggucuucaucuuuauuuucacauugaguaggcugaaaagaaagaggaagaggagggguuagucaugcugucucaaggguggaagaggugaaggagguggaaggggaggcaggagaaacaguacauuuugguguaacuuuuagggaaaaacccugcauauaugugguccuuugcaguucaaaccugugguguucaagggucaacuguauuuuguggucauuuuaauuucugcuauggaauuauucuccagcuacuggaaaauuuuguauauauauauuguucucuuagacaauuaggcauaaccagauauaaaauauauacuuuacucauuuguagcuuacuccaucuggaagcauuucucuuaucaaaucaaugcauuuaauuaaaaacccugugaagaccugugauaaaguuuauuccuuaauucagaguuugacuucucaaaucagacaucgaauggaagauccuaaaucaucagguaaauauguuuuucuuagagcauagaacaaauaaaaguuacuauucaauuaagcauuuaauauaugaugcaccaaucuuguuguaagaaaucaagccucucuugagagcuauguauaguaugaguuaauguauaucaagcaaaaaaauaauggcuaaguuauagugguuuuuauccaugacagcaugaaagagaaaauaaaauauucucauuugauuaucuuauuaugcagcauugcuauauaguuaagcagugaguagacaggguaauaagaaggagcaagcaacaggaaagugaucuaggcucuggccccaaagcuuacuugguuaguaacucagacaacuuuggcaucuuggguuuuuuucuggcagaaaauggaucauuuggacuauuuuuaaugucuaauguuccucugcuagucugccuauucacuuaguuaugugagucuaauaagaauaacaguauugaaaauugaaaauauaugagcuuaaaagagcuuuguuaaaauuguugcucuuuuucuucuuauuguuauuaaagucuauaauauauggaaaaagucuaagccuaguuccuaacccuuuaagucuaaaagauauaugguugcuaguagcguaugccuaaaguaacucucuaacuucauacaguuguauuuuugacacuuuaaaaaguuucuaauuauuaacauauuaauauauauucuaaaucagauuuuuaaguugcauaaacuaaaaauguuauguuguuuuagauauucagcuuuaccauagugaaacauuggagcuuaugcuacguagaugguccaaguuagagaaagacuuuaaaacaaagaauggaagauaugauauuaguaaaaucccugacauauaugacuguauaaaauaugauguccagcauaaugguuccuugaaauuagaaaacacaauggaauuauauaggcuuucgaaggcauuagcagauauuguuaucccucagguaagucauucuuaagaaucaauuucuuauaauauugaaaaaauacuuuuaaaaugucuguugguggauaaaaagguaguugguuuucauguccuuggaaaaccaguaacuuuaaacaggaaauuagguaauuaugaauuuauauuuuaagguuuuuaugguuguauugaucacauuauuugauuuucuaauaguuugacuacagugacuuuuuuuaguagacuauauuuauuagagcaguuuuauguucacagcaaaaucaaacagaagguacaaagauuucccauaugccccugccuccauacauagcacguccucccccgcauuaugauugucccccacaagaauggugcauuuguuauaacugaugaaccuacauugacacaucacccagaguccauagugcauuaggguucacucuugguguuguacauauggguuugggcaaauuuauaaugacauguaucaucauaguagcauacagaguauuucacugccauaagaagguaguaaaguuuuuuuuuaauuuaagaauugauacucuuagagaauaauaauaugugaacaaacuaaagaauggaaaacaguauggaauaaaucaauuaagcauuuauugaacaccuguuuugcaucugccaucucuauauggaaauauguggagaguaacacauaaagaauuacggucuuauauaaaauuuuuugcaagucuuuuuacuuuaugcaaaaguauuuugaaaauaauguuuagaggucaagauauauguaguuguucuuuugggggacaugggucuuuucauuauaggagaauaaaaauaaagguguaacaagaauucaauuaacuaaaaugcaauuaagcagagaauuggauugauaauaaagggguaaguggcaaaacauauugagaucaggacuauguuagaagaacaaaguuccagaugucacuuuuggaccuuuuuucaacucaguacaagauuauuuggauauuguaaagaggagguuggaguagaucagguauuccaaccguggacuacauaaaguuugaaagcaggaaaauauuaaauacaugaaaaagauaaagauuaugaaaaaaaaguucaaaaagccuaacuuauaaauacacauguauaagaaugguuaaaauaacugucccuuuccuaauauucauagacaguacaggaaaaccuauagauuuugaaaaacugagaauucauacaauuguacaacuuaccuauagguauuuguauacguguuaacaauuagcuuguuucuucaacaugaaagagaacuauauauuugaucagauauauaauauagacaauuuuagguauauuguaugaaucugugauuuuaaaaauuauuuuuagaagaguaugaaaauaucucagacuuuacgaauacgucuuuaggccuuuaggaaacauuuacuuaggaaacaggacucauucccugacaauuucuuucauuuagcaaaugaaaaagguuaaguuuuauucuguaaaagacaaguuuuauuuugcauaauaaaaauguuuugguuuuguaaguaugcuuuuuaacaauuagcugugaauacaagacuuuaagauauuuauggcagcuauaagcacuuuucaaggugggcugucaguauaucuaaauguaucaccuacucagaggcuaaauacacaaugcuuugucuaaucuuuagcauaaccaugucugugccauugcauugcuuauuuaaucucaccccucuacuguuuccauuauauauacuaaauauuuuacaacugggaaugaaaaauuagucccugagaguugagccgaaaagaaaacucaaguguuaacaguauuguagauggucauuucuccuccuuacaugguguauguauuucagguguauuguuuauauaguugaagacauuucucaccauguccuuguaacuuaaauaaauucauaauaaauuuuuuuaaauaccagaagaagcacuaaagauuaguauguuacgaaggaguugagucaccauuuguaucuaucaaaguaauucuucaagcucagcuguucucaguauguuauggugauucucuuugcugcaauuagguuagauuuucaugacggucugagaauuuauuugaagacaacucuaaaauuauuuuucucggauaaguuauuuuuuaaaucguuugacucuucagauaaaauuaugcccaaguuuacauaaaucaguucuauuuuugguaaauucauaguuuuaaaacaaaaggucuuuuuauaugcuucccugguguccugagauuauuuuauaaauugaggagaggacaacuuuggguuuaucucccuaacuuuuucauaugacaaucuuuauuguaagagaaacuuuggauuuuuuuuuuucagaguguugaaucaguucaauaaauauuaucuugcuuuguuacuuuaggccucauaaauacaaaaacuguggacagaaggcagguauuuucaaucaccaaaaauauaacuaacaauuauaaacauauuugcaguaauuuauaaugaaaaugugguuuguaauggaaaaaaauaaaauuuugcauacauaguucucaagcaaauaauauuuccagcuucaagacuugacucagccaaauaauacaaaguuuuaacuuguuuagaauaauuuaauguagauuaacaggguaccacugugaaagagaaguguauauacauauguucugguguacuucaaaaugauacuaugccuuaaaaaaucaguuucuacucuuacauugauugauuaauuuuuaugucugugcuaugugaauuauguaauuccaaucauuucuaggcuuaaaugaugcauauggucuauuuuaguuauuuuaacaguuaaacuaguucugauagguguuuaugcuacaauagaaucaaauuuucacuuuuuaaccaggcuuaauccucagaaaauuggggcccugguuuaaaaaugaugcuuuauagccaugaugguauagugguaaauaaaaacauuuaaagacuaaauuugauauuaaaauuauauuaauugagaugacacauauuaauugaaguuuaaagauguuuucuuugguuaucuguagauuaugaaaugcagacaguucuuuauaguagcauuucccaaagacaguucaaugacauucucauugaaaucaccauagaaagcuuucaagucgccuuagcugguauuuuaaucaguucuauuuguggcacaaauauugaaacuacauaugaggacuugcauaucuaaaaaauuguuugguccuaguugauagaggcagaugagcaaaaugugucacuguuuugaagagagaaauuucuugauuauaaaaguaauauaucuuugugauaaaacuagaaaauacagauagagcaaaaaaauuacuauaacauuaccaacaaaagaaaaacauaucaauguuuuggaauauucuuaaaggccucuuuccuuaaauuuauuuacauauaauugcuuccauaaaugcguauauauagcaaauacauucuuuaugaaaacugaaucagaaaaagcauacuauuuuacaaccuaauuuuuuccuucauuuagcauaaagaacuucuuuccaugccaauaaggcuauauauacauuauuauucccaaugucugaguggugugaauguaagaauaauuuauuuaaccaacuugucuuuggaaaucuagacuuuuaaaauuuguuucacucucuuuacacaugucuuuccauucauucaagaucauuucuguagcuccagaaaucuuuaaucaguuuuuacccagaccagcaguguaugaaaaucccuguuuccucacaucuugcuaauaacaaauuuaaaaaaaaauuauuucccugaugauuuuuuaauuccaacauuuuucuuuuguuuacacauaaauacacaguugcauauucacuauauagucaccuacauuggcaagauuauugaaccaccuuagcuuuaguuuaagguaaaugaccacaggaaguccuguuuuccuaggucuuucaucuguaaucagucagcauuuucuuuauuaggcaguuuugagaucuauugucuguacugauguuauuccaugugaaucuuucuggagguaucuaguagcaggaaauagccuuuaaguugaaauauccuagaaugaacuuggagagagaagguauauguguuucuuuccucuucccuuuucucccucuuucccacucuacccccacuuuucugccuucuuccuuucuccucuucuacugcuuugaacuauaauuuucauugcaauuacucuuaaaauugccauguuuucuggacacuucacauugugcuaauuccuuacaaauccaauuaacucauaaugauuaugucauuaaauuugauaauuucauggaaucuuugcucacuuccaguuaaaacuuuaaaaauauuggccaaagccuuuugaagaauguguuagucuuuuaaaucuuugacauuuggaaaaacagaaaucucaagguuuaauuuuuuucauauauuuauuacauauugugcuuuaguguuuguggccuuaauccaccuuucuuuuaggguuguuuuuacauuuaaaaccacugauuuagugaauacuagucauaaaaauuacauucacccauucauucuccgccuucagaaauuacuggcuuuuguucaguuccaccacaaaauccuuccaauuauacuuaauaguuugaaaaucauacauuugcaguugcaaaaaaugcaaacucggaguuauccaacguucaaaaaaggcuugauaaaauauuugucucucacuagacuaauuuaggaguguauuuuuuuagaguacuuugucauuauauccuuuuucuaaugucauguauuuuuugcucaggaauaugguauaacuaaagcugaaaaacuggagauugccaaaggcuacuguacuccucugguuagaaaaauucgcucagaccuucagaggacacaagaugaugacacuguaaauaaacuucauccuguguaagaaacuguacugguuauuuaaaucucuaggcaucuauuuuugcauacuucaaauuuaaauuauacuuugaugguccuaugaagucagaagugugucauuggcauacugugaaaauaguauuaccuagguauuucuauuaaguuccaaccaaaguuauuuuuggcuccacuuuagagaaaacuaaggugaguggggaaaagggaauauaggucaucguucacauggaccaucaauguguaccccauuuagcagcauuaaugucugugagcaucuuuaggucuauaaccucugucauugcuacuaaaggagauaaaauaaccuauuuacaguguacuugacuaauauuaagucuauucuuugacuacucucagagguccuaguuaguuauaguuugugucauguuagaagaauauauacuaagauaaauucucuauugugguuggaagaauaauagauuuuuguggucuuuuacuucuagugaaauuacauuuaauuuuagaaaauaauuucaauauuuagugaguuuuugauuauaugguuauguuugaacacugucugcuucuaauuuuagguauucuagagguguucugucuccugaacgucauguucguacuagauuauauuuuaccagugaaagucauguacauucuuugcugucuauucuucgcuauggugccuuaugcaauguaaguagaauaaguuauuucagucuaacaaauauauuuaauuuuguaauuaaaucacuaacugcuauuuuuacugugaaauuuuaguaauucauccuuaaguuuuacuacuuaaugucgucuuucaagggacuacuauauaccaagcauuuugcuagauuuuagggauaaagauguucucuucagagaagauacauuuaagcaaacaauaauauaaaguauuuuaggugauuuuauagacugguggcaguaaagaguagccugaugaauuugagucauuuaggggucagaauugauggaacuugguguuugguuagacauuguaccacugaucuacuauuauguacuaucuacuauuaucuacuauuacguaaugacauaccaagacuuaguggcuuaaaacaaccacagucauuucauuuuuaucucauacaguuuagauuguugacuaggaucaauuaugaaguuucucuuagagucucaugagguuguagucagacaguggcugggucucaaauaaucucaaggguuuucucucauguuuggugcuucauguuggcugucagcugggaccucagcugcgguuaucaagcagaacaccuacaucuggccucuucauguggccugcuuccucaaaauauugcaccugaguuccaggagugagcuuccuaugagagcaaggugcaagugcauggcauuuuuaugaccuaacuucuaaaaucauguagcaucacuucugcugcgcucucuugguugaggcaaucacagagguucauccagguucagaaggagaggaaacaacccacagcaccagaugggcugagugucccuguccuauuguaagaagaguauguagcauugaauguguaugucagccaucuuuggaaaagacaaaaucugccacagugauaccuauuugccacaguaauuuguauucuucccacauacaaaacucaauucacaucucccucagugccacccccuccacucagugccaugcuguaauagaguaauacuacuugaaguccagaaucucaucuaaaucagucaucucuaaacuagccaaaagauaagaauguucuuuuauuuuucugugcguauauugguauacgcaucugugcacgucuguguagaaagugaucuauaaaagaaaacucaauuuuguuuucuuaauguacuuuuaaaagaagggcagugacauauauagugaugauuugguauaggucuguuuccuaaucaaucuuauuacugguccuugagaguaauuauuaucaaagugauccuaaggguguuucaaaguucuguuccaauuaaaauuccaaauccauauguucuuucuucugguuuuuuguuucuucuuugucccacuaaagaauagaaaagugacauccuuacauaaguauguggauuagugggaaaaaaaaugacccuuaauuagcaaggcaaaagcuuguauauccaguaguauugauggaauuguuugugaagaggagcgauacaucucuuacaugguccuuuuugacauacauagaggguauaaagaucaugaguaauauaggaacugauagaaagccuguaguuggagaauaguaguaaguauuggauaaaaugacagcagauaugguugaagagccagugccuuguauucuaauuggauugggaagccauuuaaagguuuuaagcagggaaauggguggcuuugguuauuguguggacagcagauaggugaaaguggguaugaggaaaccaguuaggaaauuauuacagugguccaaaaagaugucauuuggacuagggugguagcuguggaucuagaguuuuuugggcauauauugaauucaggcugcauuucuaaaacaaaaacugaacaacuucauuauuuuaaaaaucagugcuuccagggggaaaaauaauuacauguauuuacuaagaugaaaauuaaagucugccaaaauguuuuguuuucauuaucccaacucuuauuauccuuguaagaaucuguaaguaauauaauuaaaaucuuacucaguauauuccccuuuguaauuuuuaauuauucagaauggaugggguaaaaucuuucuguagaauuauuuguaaaguuuguuaaggaacuaagauuauaaauaagauuucaggaauauguguaauggggccuuaauuuaaaaagauauuuuugugucuucuuacauauuaauuacguucuggaaguuacuacuaaauauuacuuaauuuuaucuauuuauuagagaagaccuagcaaaaucuauaacugcaacacugaguuagauauuaaaugguguucuuaauacuggaguaucacaaaaucacaagaucaauuaucuguucaccuaaugaaaauuuucaguauuuaaacucaucauuugugcuaacuuacauuuagugaaacucaguaaugcuaauuuauguuuucccuuaucaauuuugaaaaaaauacaucuuuucacauacuaccuccuaaacuugcacacaugcaugugcgcacacacacacacggaauguauaaugucuaaaacagaaauaaaauacacgcugaauuuuaaaaagcauacagucaauguguggucuuauaauuugcuuuuaaaacaaggugcauucuguacuaaaguccauaauauuguauacucuuaguguauacaaaaaggaaauguuguccuuuuauauauuuguaauguaauuacauaguauacaacaaaggaaauuuaucugugauguacguauaauuuaaguagauccuguuaacuguugacuauagacuuuacuuugaguaguuuugccuuuucagauagaauuuucuacuuugaaugcuuguaguacauguucucuaagauccuuuucaguucugaugcucuaugauuacauguuuaaagaccaugauucucagaaugaagauggaggaauggugaaggagaugguaagaucaauagaauuuacauaugccuccuucuucugauuuuugaauaucacuucaguguaauagggauacuuguugauaggccuauauugcauacaugaacuauaugauggugggaaaaaauggcauuccuguuauaggauaguauucugugguuaugaaauaugauacuauacuagguacuuuggaaccugacaaaguuaaaaacggucucuuacccucagaauucauuaguguuugucauauuucaagaaauuauuuauuuuucauuuuguauaagcaguuaaaaaagguuaccacuagaacuucuaauauagguugaauaucucuuaucugaagugcuugagaccagaaguuuuuuggaauuuggaauuguuuuuguauuuuggaauacuugcauuauacuuacugguuuagcaucccuaaucugaaaacccaaaauucuccaaugaguauuuccuucgagugucauguuagugcucaaaaaguuuugaauuuuggaggguuuuggauuuuggauuuucaaguuagggauacucaaacuuguagagauuuuaaaaauauuuuaucaaaacaagcuuaaauaacauacuaagacuuuuaaauguaguggaauuauuuuuuaaaauuuugcauaugauaaguauucacuuuaugugguaucacuaggauuaaacaagcuaccauagugacaauaaagugacuuucaaguaacacaguuugagaaaaugauuaccacauguaucuuuuguucaggaaucaaaggaugaacaguggaaacgagcuauggauuauuuaaacguugucaaugagcucaacuacaugacucagauuguuaucaugcuuuaugaggauccuaauaagguaaacagagcucuugauuuguguuuuaccagacauaaauaaagagcuuaaaguuucucauuuugaaaauguucugucauauuucuuaggaucuuuccucagaagaacgcuuucauguugaauuacacuuuaguccgggagccaaagguugugaagaagacaaaaauuugccaucuggcuauggauauagaccagcuuccagagagguaaugaagguggaacucucagugcuuaguuacuacaguucuagauuuucaugagguuucuauaagagauuuuuauaauguacuauaaauaauucuuauuuuaacuucuaagcaggaaaaugguuuaaauuuuuuaaagugugauuuguauagacuguacuuuuaugcauauugcaauaccuaggaauuuuaucuuuuguuuagauuguuugaauuuuaaggccguguuuagaauggauaaccuuaaaccuuuaauucaccaaaauugacuuuuuuggauguaguacaugugaugugcaguccaguuuuguugucuucgcucuaugaauaacuaaaccccaguaucauagauucaagaguucauacuuuuucugccaccuauaguacuacaucugauacugcagacauauauugugucuguauuuugauugguugguuucugaauuuuuagucuuacuugauugcucuauuugucucucucucuaccaguaccacagucuuaauuauuauagcuuuauaauaaauauugauauugaguauagaacuccuccagcuuuguuguucuuaaagauuauguuaaauauuucauguuucaugcauuuucauauaaauuuuauaaucauuuuauaauauucuaaagacucuuugagauuuugauugagauuaccacuacucugcagaucaauuuggagaaaaaugauacuuuuucaguauugggucuucuagucuaaggacuugguauauuucugaguuuauuuaacuauacuuuauauuuuuugauaaaaucauuauuuuuucauuaaaaauaauagcaaaaaccacaauuacuuuugcaccaaauaauuguuuuacaccaucuuugucauauuaauuccuaguuccuuuauaguuuuuuaugcugucauaaaugauuuauuuaugauaaauuaaauuucauuuaugauuuauuuaaauuucauuuuuuguuuuugucauauuaaauuuuaacucaguuuuguauaaaaauuuuauagcuagcaaacuuauaacuugauauaugcuguuauucauucuaauaauuuacccuuagagucaucuggauuuuuuauguauaugaucauaacaucaucuaugaaugaugaauagauuuagugauaguggacauucuuaucuuucagugucuuauuauuaacugugaugagcccuucaaguuuuggauaucccuuauuugauuaaagaaguaccuuuuuauucucuguaacccuuaauuugaugaggguuuuuauguacucaguuuauuuucuuuuggccaauauuauguuuaugaggcucaucaauguaguugcauuuaguuuuaguuugugcguucuuauugcuuuaaaauauguguuuuacuguauuacuaugguccaacguaugcauuaucuuauaguuggauauuugauauaaaaauuuuuagcuugccugucucccauacuguguuggaggauucuugcaaucugggacugugucuuauucaucuguguccuagaacaauucauggcacauguuauacacuuaguaaaugcuuaaugagucacugaaugauuauuacuuuuaaugcaguuaucacauuuauuagaaauguuuggaauagauuuaaauauucuaaaauauauaaauacaagugcuguuuaguucaugcucagguugaugagacuccuauauaacaaagcucaucucuauuauuucuuacugucauuuauuauuauuguuuauuuauucuugcacuugaugaaauguaauuaaacgcuuugucuuaugugguuuuuuaauugucauuuuacuguuuaauuucuccauagaguauauguauuuuugaacucagagacucugccuuuucccucauaguacacagcauaauacuaagcuguuagaagaguucaauuaauguuaauucaucugaguaaacaaacuuguauauguauuucaaguaccucuaccagugguaguugaaucuguucaucagaagagauuucuuaaaucugaauaguaaaaguguuuuauauucuuugcucacagaaugaaggcaggagaccuuuuaaaauugauaaugaugaugaaccacauacuucuaaaagagaugaaguugaucgagcugugauauuguuuaaaccaaugguaucagagccaauucauauacacaggaagucuccacuuccaagaucuaggaagacggcuacaaaugauguaaguauauguaucagaacacauuuuucauacaguaaacuaacuauauuuuaauaaaacagaaaagaaaauacagcuuuaauuguggagcuugggaaaccaacaaauuuuuaaauguuauuuaaucuauuuuuaaauaaauuacaaaaaauauagaggcaguucaaaaauagauuagcuuuagaauguugagcuuuacauauaguuuucauaaaaaaaggaugcaaauauaaaauaagcuguuucuaggaacuugaaaaaugaaugcuuuuuuuuugucuuguuacauuaggaauauuuacauuagguugaucuucaauaaugaauuuuuuuuaaaagccugauuuaauggaucaagaauaauuuuaguuagagagcaagccgggcaugguggcucaugccuguaaucccagcacuuugggaggccgaggcggguggaucaugaggucaggagaucgagaccauccuggcuaacauagugaaacccccgucucuacuaaacauaaaaaaaauuagccagguaugguggcgggcaccuguagucccagcuacucaggaggcugaggcaggagaaugacgugaauccaggaggcagagcuugcagugagcuaagaucacgccacugcacuccagccugggcaacagagcaagacucuccccaaaaaaaaaaaaaaaaaguagagaacauuugcuggagaugcuuuagcaauaacugauucaagugauacuauagguaaagaaaugaaauucuaaauuguuagccuaauugcaaagucuauauaggaauuugaauguuugauaauauaauaaaaaauuuuaccuuuauauuaagaucuauaaauagguuagaauaauucuuaugcucucuaauagaaaaacauuuaaauaauuaauaaaguaacauuuaaaaggaaaguuuagcaguuagaaugaagcuuguuaaauaaagcuuuagcaccuguauacauuuuuaauacuuuaaauaaguuuuauuugggguuaucucuguuuucuguaggaugagucucccagcacugauugaggucagugcuucuaacuguuuucuaaaugcucuaguaaaaguauaaaggaagaggggccuggcgugguggcucaugccuguaaaccuggcacuuugggaggccgagguggguggaucaccugaggucaggaguucgagagcagccuggccaauauggugaaaccccgucucuacuaaaaauauaaaaauuagcugggcuugguagugccagccuguaaucccagcuacuugggaggcugaggcaggagaaccacuugaaccugggaggcggagguugcagugagccgagaccaccccccugacugcacugcagccugggcaacagagcgagauucugucucaaaaaauaaauaaauaaauaaauacacacacauauauacauauauauguguauauguguguaaaggaagaaauuaagauagaaccaucaacuuuuagaauaaagcauuauuuaaauaugccaguucugaagaauuagguauagcauuuuuuagcauuuaaugggugagaauaaaaacaaugaaaagaauugugcucauuucuacagccccgaauuauacaaauauauguguuuuaugauucucaaauuucaaauauauaugugcuccaguuugacaauuuuguauaggcaaaaaucuguccauaaaguagauccuuauaacuuuauaauggaaaucauauagucguuaagguucccuugaaugugauauuuuaauuacaaaagaaaaggguuauuaaagaggguauuuaacaauuauagaacuuggaauuauuuguucuguuauaacuuaauggaaaaaaugaaaaaucugggauuauguucagguauccuuaauuucagaaaauuugggaaauaagcuauauuaauuaauauaaccuacacuacuauuugugugagggcagugauuuugauguguuauugaauaagcaaucuauaguucaucaaauuauucagaauuucaccauuaaacccucuccucugcccuccaaaaagccuauauaacacugaauacagcaaaauguauuguaagucuucauuuugcaacucaucuauauuuauaaaaccucuaacaaaaucacugcccuuguuaaucuuuaaaacgcaaaacacauuuauaaaccuuuuucucauaaauacuuaguugauuucaagagauuauuucuaugccaugcuaaacuuuuacuuccauaagguaaauuauucaaguaaaaucuugaagacuuuuuccagcguccaucaucuccauggauauaagaaguuuguacuuccaaaagacacacagagaaaaagacuguucucuucauuuugugcaaguagauuuuacucuguccucacucucugaaaccugaacaugcaaacauguaaaaugagaauguuugcugcauguuuugccuacugaaucuguaaauaucucuggagggggcaaauagauagcuugaaaguauaaacaggugcaauuugaguccaucuuaugauuucugaauuuuuuaaauauaucagggagacagauuuaguuuucuaaguuauguauauugaaaucccuuugacccuuugcacaauucuuuagugucucggguugaaaaauucacccaaaauagcacaaaaucuuuugaauaucuuaaauuaagcagaaaaccuguauauuuuaaaaguugcuaaaaaaagaaacuuacuaaaauauuuccaguuuuaacagggaagggacaauuaugaagcaguauaaguauuuuaugucuuuuaagguaauaaaauauuuccauaguuguuaucacauacaauuagauuuauuagucauuccuaucaaauucucaaauagugaaauauuuggcucccaaauugcuguguaaugguuuuuuaaaaaaauuaauaagcaaauaugaacaaacuguauuuuuuuuucuuucugaucauuuggcucuguuguaucuaacuuugcaugcucugcuuuuuuuuuuuuuuuuuuuuuuuuuuuuuuuuuuuuugcccccuuucucacuuccaggaagagagcccccugagugugucuagcccagaggguacugguaccuggcugcauuauaccagugguguggguacugggcgucgaagacgcagaucaggggaacaaaucacuucuuccccugucucccccaaaucauuggcuuucacauccaguauuuuuggcucauggcaacagguuuuuaaacuuuacuucauuaaacauuuuuccucccugcauucagagcaacaaacagcugucuuugaggacaucuaaucccuuguauuucacaucagaguaaauccuucuguuuuuuaauuuugaguucauuuaaaaauacuuaaugauaucugccaauauucaagggaaagaaaucacuuacauggcauguguuuaguauuuuuacugagaaguuuccaaauauccaggauuuuaaaacaaucaauagauguuauucuccuggaauuucaccuuguuaauaaaauuauuuaaaaaugaaagaaaucuuuuuugacuugucuuuuaaaacuuucagaaacaaauuauguaauuugauuguaagaaaauguauuaauauuuucuuccauaauugaaaaaauuagauucaauuuggaauuugcugagaagguaaacauuuuuuaaaauaucagaauuuauguggcccaguuuuaauuagcaggauauaucgaauauugauaauuuucuuccucauuauuccauuauuuggaaguaucuaauuuaaggaauacauagucuguuuuucuuuggacuguuuaauauuuuaauguucucuuuaagagggaacaauugcauaugugcccaucaacaauaugggucaaaauaaaaugacuucagaaggacuuccugugaugacauuuggaaacuuaaaauauauaugauuucuauuacauuggaaggucuacugucacacaugagguuucugauaauuucagcaauuuccuuuuggaaauauaaugcauuugacuauaggaaaagggauuaugguauccauuaaggcugugaauauuuaaagguuacucugauaaagcccaugcauggaucaauaauuguauggugaucucaagagucucugucuguccuuucuuuuguuuguaguuguuuuuucccccuucaaauacaggagcuguuuaagagugggcauuuggcuucuuuuaagagugaaauuauaucaaucucuuaauugcuucuuuucaucugucuuguuucauacaugauguuucauucugaaugccugcuucgcaccacuucauugcaaggaccucaugaaauggacucccuucaaaaggggaucuugcaugaucuuucauguuuuauguauuucuacuaauauuuaucauacagcuuauuaaccuuugucugucuggaacaggcugcauaugaaguauagacuuaugaauuuauuuuacucuuuuacuucauuuauuuuggauuccuuaugcagguuguaucugaaaaugcuaauuaccugagaacaccaagaacucuuguggaacagaagcagaauccuacuguagguaugugguguaaaggaaauuguguuccauacccuucuuaaacucacuauugugcacacauguaaaacucuuuggugaaagcaugaccaaaugcuaugcuguaguuuuuauuuaauguguacuaauucagaaauguugaguuguauaacucaaaauaaaguuuugauaaaaugaagaagagauagcauuuaauuuuguuacauaacccuuuuggaugccugcaaugauaaccacuuaguucacuugccaaugcuaguuuuuaaucuuguacucuguaaguuaauuuaugaaggaaacuucauuuucccaguugauaaagaugaaaagaugcuauugcaugcagaaagggacuuuccauuuuucugguuaaaaauauuuuuaaaguacagaauacuucaaacccuauaugaauauauuaauuuuccuuugagcagcucguaaggaaaaccaagcaaaacuaaugcacaguggcagucucagucuuuauuaaccuauagaacauaauugguucuuugcuaacacucaaagcaacauugaaaaagaccuuucuaaacucauuugguuugaagcucaugguugauaaacuaugaaauaguggcguauuauuuucuguaaauaguuguccuaauagguuuaauaaaggcauaaacagaucucguuguaaguuuauguauguacugugaucucuguacuaaguauaugaacuguugauaccuacauacuugaggaucucucuuuaauuucauauagcuuguaaugauaguuuuuaauauuccuacaguauauuuauagaaauuuauauauuacuccuucuuauugauguaucauaguauauuuuauagaaauuuauuuaauccuuccccagugaugaaaguguuauuuggauguaaaaacuuuugcuacaaauugagcaucaguuuauacuggcuguuuuauuugcuuauaauguuuuucauugggagucuuauuaauuaagaucuuaagucacuuguuaaguauuuaaagugauuuaggccuugaaugacugaaaaggaccuggucucacaaauaaauaaauuuugauauacuuuauuucauaagaaagaguaguaauucucaauucaggggcaucaggaaagauuugucauuuauagacauacauuaaaaauacugauuuuauaugacuuaauuugugcuagaaggaguguuuuuuuuuuuuucuuuaaauauggcuugcccuuggaaauugauuaacagaguccuuucuuguccuaaguuauuuuuauggcaguguuuuuaauacuuuaggauguauaugucuaauuauuauauggacauauuuuuuuucucaaagauaacauuuuguccaauguuaaauuaccccauuuguaccuaugauaaaugauagugguguuuagaaguauuguauuaaaacugaccucauuaggaaauuacaagaauauugugagccuguucaaggcacuuccaaagguugccuuauaugugguaagagccauguuaauugcaugcugcaugaauucccaaugugaauggaagaacacccguuguguauguauuuucucuaacucccaucagggucucacugugcgggccuguuuagcaccucggugcucggggguucuucaagcgcaccuaaccuacaggauuaugcucguacucaucguaaaaagcugaccucuucuggcugcauagaugguaugugcacacaugcacacacagauucauaccuacacccaugcacacacccaugagcaguauuucucaaaggcaaaucuaaggccacugacugauucgagugaaauccugucaucuuuugccuaaaugacuaucagugcucucuguuaucuacaacuuggauccauguuucaucagacaguuaauuguaguuagauuuacaguacuuguacaauaaguuuguugaaauggaaaacuuagaagaguauuauguguauucuucuuuuagauaauugauuauauuauaaagagcaagcguuucuuugaucuuuuaaacuuuuauuuauuguuaacacuuauuuuacuuauugagcuaauuaaagugaguggaauguuuauaaguagaggacaauaucauauuggcaauauuuuuauaaaaauaaacacaggaugagaauauuuuaggaucacuagcugaaggagauccucuuaauguuguuaauauaccuuaaguuuuaauauuaagaauuuuuuaaggcucauggaagcgugucccuuuuguuaagagaaguggcucuagcucuuucaggaucgucuuuauuuaaaacauuuucuuauuuaucaacaaauuuauuuuagacaguaaaacauggauuuaccagaauugccagcucaucuugcuuuucuuucuuuuguauauuucauuugacacuuuuccucugucaucaagcuaguuaacuucuuuuaaccaauauuuaccuuauuacauucucucauugucccuucugcaugucaccuuucuaaccuccucauauauuuguuuuuccccucuuucuuuuaaguguucuuuuuguagcuguuacgaauuucagguaccuguuuuucucuuucuuagacgccacacgcgguucugcuguuaaaagguuuucuaucucauuugcucgacacccaaccaaugguacguuuugcuuuuauuuuaaaagauacuccccugcuucaucccuuuuuuauuuuuauuuuauuucaaaaugugggguauacaguaucauucauuucuucauccuuaaugucaauuggcguacaauuccaacuuguuauucacccaaauuauugauacugucuagcucccuuuucagcuguaauucacauaauaauuuaacauuacucaucaaacuuuuaaugaccacaaugaugaugaguuuuaaugcuaaauuaacaccugaaaauuucaucuaauuucucagaugaucagucuacacaaauuuuuaaauuauaauuaguauucuuuaauuuuucuuaauucucaauaacuuuuuucuuccuaauuuucugaucacaugguuguuuuauugagauauuuaaacaaaaauacagagccacccaugucaaauagccaaauaagaugugucuuugaaaaauuccugggcaccuggugaugcauauuucacuguauaacaucgucuguuccuggcuauuuuucuaaagcaaaacccuguucggucuggagcacucugaaaacuuuguccagcauucacuuuguucuuguguagcaaugugguuugcuauuaucaagcaacuaauuccuuuuaguaccacugcuuuuucuuaaaauuuagaggacuccugauaggaagaagauuaaguuaagaucuagaaacccagcucuguuaaauuccauuuuugaggcugaauaggaaaguguuucaugaccauuauuguaaaaggaauuauugccauuacaacuucuaacauagagcuugauauuguggggcaagagggaauauuuacugaucauuuuacaauaauucaggaucaaagaauuuaaaagagcacuuacagauuuuugcuuguauuauacauggaaugaagauacuuuuaucccuggaacucuuuuucuuuuuaacugcaaguaagucuuucaaaaacucaagucagaucuuucagaaauuuuuaugaagcuaaaggauucaacacaaguuuauggucauucucccccuucuggauccuuuaacaacacaucuaaauaacagugcacuaauaauucuugaagguggaauaagaagaucucauccucaacaaguaaaaauuuagccuuaaagcuuaaugugcuuucccuucauuguagcuauuuaaaugcuacuuuuugaagaaagugauucuuauuugauacagcugcagcuucuaaagaaaccgcaugccuaagaaccucuuagaagaaacacagaagucacaagaaaaacagaagccacaaaaauucuaagaagagacauugcagguuuaagaccauaguuuuuguacugaaugcuguguguuuaaaaccaguauuugagguauuauuaucuaggagaaucuguguuuaacugaagguuuuuaaaaaugaaaaauauuuauguuaaauuuaauagaaaauagaguaauuuuauauuccuuugguuuaggcucuuuuuuaaaaauguggguuuuccgcacauacaaaugcacauaaggugcauucuuuucuauucuacaaauauuucuuuugaguuuuaagguuuccuuuuuuccuuuuuuaauauuguguugucuuaucuguccuaugaauugucauuugacucuuccuuuuacuuuuuauuuccccuaacuuucauguuauuuccaucuuuaacacauaucauggacuuaccccucccuucaucuuuaguucaaggaacauggugaaacaaguaucuucugacagugcuuuaccuuauuuucugggccucugugcagaacaccuacaccucuauaggugcugguccguuuccucuguggaauuucuaggcuccagugguauguuuuuauagcuucuaaacaugucagcaggguggcuuuuuaaauugcugcgcuaacccuuucauugugcauuaaaggaaaaguuuauuaaagauaaguggaaaaaaauguagucuagaggaacuuaauuauauugucauuugccuguuauaaaaucuagcaggcaaaugaaauaaaauaauugcuauaaaagauuuauaaacuuugugaggaaagaagaaaagaucucaucguuaaguuuaguguaaugcaaagaaaggguuugcgcucauuugcaugaaucuuguacuucuaaaaaauguaacaguugugcaagccuaauuucuuuagugcuuaauuuaggugcuuuaguugcuguuauaguauaguuuuguuuuuguuuuuguuuuuaaaguauguguaauguucugucaugcuuugguuugcaccugaaaaucagacauaucacuuuugcaaguccuuugguuauuuuccuaggaagauuagauucucuuuuaaccaaaguuuccuuauucuaacugagaauuaggcaguucuugggucaauauuuccuucaauauuuaaaugaaucaaacaucagucaauuuaaaaaugagcacacgccuauugaagcagaauguugcagucugagguuaauuuuguacuuuuaaugauauuugacuuuauauaaaacuuugaguauuauaaguauuuaacugcgggaaauuaauuugaauuuuuggaagaguagaugcagaaagacucguuauuuuuaacaguauaugaaagcaauuuuaaaagccauucaguugaaugaaguuuaaauaaacaggcaauuuucuuuuuuaaaaaagugaauaaccuauauccuauuuguuuaaaaacauaaacuguguauuuaagugcuuuuguuucacugaugguauuaauacauauuugcaugauuguuucauaaaauuuucguauuucugugccauuguuaaauaggaacauauuuguauuuguauugcuuuuuacuuggccuaacuuuacacagccagugauuccuaguaauauaauuauguguuaauucaguaaagguaggugaaauacguuuuggaauuuuuauuccagcaugaaugaaugaauguuguuugggguucauacuagagaguaucauuggucuuggcacaccuggaaaaguaucuaaaauaauuauucacaaguaauuauauaauuuuucaacaagaacuuacuguuagcguccuggcaucagggauacaucauguggcaucaguuuauucaccuauugaauagaccugacuucaaaaaauaaaaacugaaaacuuguauuucuuuguuuuuuuuucccuagguuuuuuaaaguauuauucuuagauuuuaccaauauagaaugaaauugugugcaugcgauacuacgugauuacauuuaaaaagaaaucuuugucacaucuuguuccagcuccauauugcauagcaucuggugucaugacuucagagauauuguguguuugcaugugauagacugaaaagaccuaaacuguccaguucuaagcaguagucuuccuuucuaauuacugauuuuuaaaauauccaucuuuuauuuuuuguuuuugguuuuuuucucuucuaggcuuugaauuguauuccauggugccaucuauuuguccucuagaaacucuucauaaugcccuaucuuuaaagcaaguggaugaauuucuugcuuccauugcuucuccaucaucugacguuccacggaagaccgcugaaauuuguaggaaauuuuucuuucauuguuauuauuuaguugcugggcaacuacauacuaucugaguauaacaggaauuauaacaacauaaaagcagguagugguaaugaguaggaguacaaaggggaguguaaagggacauuauuaggaauucuuugguguaaugugaacuguaccucuuuuuuuuacucugccaaaaucuuuucuucuuaccaaaaaaaaacaaaaaacaaaaaaccaauagcaguagaagucaacaaaauauaggguuguggucuuuuguuaaaacuauguuugcuagaaaucucauauuccuauuguauaucauuuuauagcaaaguuuuuuaaaacugcaaaauaucaguccacauuaacccauucauacacacucaucuccugacuaccuuugguaaguaguuagaaagagcuuuuaacuaaagacagcaaauuaggacaacaauuuuucaaauuguguaucucagaaaacauucugaagagguuaauuuguguguuugaagaaaagauguucaugguuaaauaaguuuuagaaacuauguuauaucccaccucccuuuggagagguauagcuacauuagcauauaaaaggcugacguucuucuguaaagaaagcuguauaacccagauuuuccaaaacuuauuuuuuagaaaacacuuuuaugguaacacauuaaauaucauguggcucuauucugagggacaucauuuggggaaaugcucagggcuuccuuuuuaggugugagaagucagcugccaguugucguuuucagcucuauaggauuccucaguacuuuggaaauuccaguuuagaaagaguuaguuuugggagagagugcuuugcuuagagcuaagaaucuuacuauucuagucauaucuuagaaagugacaaacuuucuuuguguaucauuccucuuuuucugagugcuguaaauaaauuuugcucaauaauaaaaugagauauuagagcucucggaaugaaugccacuuuuaugucugacugucauucucuucucuuuccugggccaucacaucguauaauucuagagagcucuauucucuuuauauuuugucuaaaugauacccccugcauuuauacaaaguagugaccuuucccuuuucuuccauuuuugguaguagaggccagcuuucaaucauuaacaguaauagagauguauacuggugaguguucuaaaauacuucacuuuagggaugguuuuaggaaguaggucuuaacuuaaaaauuugcauauaaauguguccgauuaugagaauugauaauacuucaaaugaaauaacuucuccaagugguaaacgucagagacaggaaaaugaaggugguaaucuccuuuuauauucucuauaaccugcuagaauggacaaugcuguuaccucagaaugcaguagagaaccugaauaaauucuaguuuaccccuucacccuuaaugauguuucauugcuucccuggggcaaggauuugaaaucuuaaaauagagauuaaagaauuauucuaauuaguaaauaagaguuuagggguagaucucaacacuauuuagauuguagaagacuugcaaugaaugauuugaagguaauagaaauaguagugacauguuuguuaugaaaggauaauuuuaguagaauauuuacaaaaagauaauauuuuaagguuuguucugugguacucuugauggauucauuuuguaguuagugaauucaguucaucagaguguauuacugaaggauauuaaugaggcaaaggauauuagauucuuuuuccaguugugcuaauuucuaauuagcucuucuguauaucauggauacaaauuguaccucagucccucuagcucucuuaaaauuucaugcaauuaguuacuaacagaacuagaugagaaaguaaauguacuuaauguggcucauagaauuggauaaaccuuagagauaaucuaguucauuggucuucaaacuguauucccaagagucuuuggaaauuccaugaggaagagaaagaugcugaauaguuagggcuugugucuuucauggcugcuucaaccagaguaucuccuuuggucuauuuuauuuaagauuucacuuaagaacagcuuuacuauuuaaagaaaaaaucguagaaagacacaguugaggaaaucaauaaauuaguggucaagcaagacuaaaauccaggucuucuaaagccucuauuuuucucauuauuuuugaauagcaaagaaaauagggugccaguuaugaugaaaguuuuugaaucauguauuuuauagaguaacuguaggaauacuauuuauuaaauuauaggauauuuauauuauuuacaguuaguucccugaguuaucaagcuguaguaucauauacauacaauuauauucauuuugugguguuuauaacaagggaaaaggaacuguuaaucauugucuguccuuccaaguuuuuuuccucaucuaacacaaaauuaauaaauauuaauacuaaaagauagcuuacaauggggaagugacaauaucagauuggagaaaaaggaguagguauauuaauuaggauaaguuagugauggaaguucauagaguaggguaaaaauaugcaagcagaaaagggcuaaguaaagcuagguuguuuuaugauguuuuaaggacuuuuuaucucuuagauuauuuccauuagugacuacuuuuuauuuucauuagugacuacuuugagcucuuucaguuaaaugaauaaucauucauuguaggugucaaccagcaaaggcacauuugccauaacuagcccacaucuugguuuucaaaagcaugcugccucucccuuuguuuaggcagucuagaagcucaugccaguagugucuccuucuccccuacuuuggccuguccuugcccagaggauuccauacuuaagaauuaucccuacuucuccuuuuuacaccucucaauuucucugccuuaguuagaaagaaaaccggaaagacucaacuuuaaaauucccuuccucucauuuaguuaaauuucaacuggcuaauauaggaaaauaguaucuuuuauuacuuauaacuuaauuaguuuauuccuaaauaugauaguuuaguauaccauuauauuuguagaugaaacaucccugaaucuguaauuguuauuuuuuuuuaagacaaaaacaguuugagacucugucucuuuguuuuuuuuccccccgagacagagucuugcucugucgcccaggcuggagugcaguggcacaaguauggcacacuacagccucaaccuuccaggcucaagcaguccuucugccucagccucccgaguagcuggaaccacaggcccagcuaauuuuuaaauuuucaauagaaaugaggccucccuguguugcccaggcuggucuugaacuccuggggucaagcgauccuccugccuugccuaacuaaauuauaaguaauaaauaagucaaauuauuuuucuguauuagccaguugaaauuuauccuccuagucccugggcaggcacggugguucaugccuguaauuccagcaugaaacaccacgccuggugaggggauuacugauucuguuaccaggcaagaaaacuaugccauuagcucuuuuccaugccuuaaaaaccucaguuucuguaaggaaaggauaaagucugucgcucuauucuuggcauuccuuuggugcauacuauuuaaaugcuuaucauuuacaguauaaacaaacaucuauuugucuaaggccauaacagaacuaucuuuuuauuaaaaaaaggugauuuugcugaauuuaccuugaccauuuucuucuguuauuaugaauauucguagggucacuaaauuauaagaaacuuucuaugauguuaagagauaauuggcaggaaauuauuaaauuaacauguuuguuuauuuuuuuucagccucuacagcuuuacguuccaguccaauaaugagaaaaaaaguaucuuuaaauacguauacaccugcaaagauccucccaacaccaccagcuaccuuaaagagcacuaaagcaagcagcaaaccagguaagggguguguguguugaguuuguggauuugcacagaaauuagaggaauaguaacuugcuuuuuaaaugucaaauuuguuuuuaauuaguaucuuugcacuucccuagagcguaaugauccuaaggguuaaaaaucgauuauuguagucaauugauauauauuuguuuuuugucuguugucuuccccucuccccacaucuguuaacaaaauauauuucacagucacacuuuuccccaaacuaauuuacggacugucuucuuuugccuuucuuuugaguuuaaggcaucaucuuacaugaaaauuucuauaggccaggcauaguggugcccaccugcaaucccagcuacucaggaaguggagguaugaggauuaccugagcccaggaguucaaguccagccuagacaacauagcaagacccugucucaaguauuaaaaaaagaaaaaaaauuucucuuuccugauaauauuuucaucucuccauucucagucugacuaugugacuaccaaaauuaauuuuuauuagcauuuuucuacuuuaauuauguggcacauuuaauuguauuuuugacccuuccugaaaugcucucuuacccuauuacuauauugugauauucuauccauuuaucuuauuccucuacuuuucuuguuugaucauccuucuucuuucuacauucuuaucccagacaagaacaugauacucaugauauucauuuuucuuaccauauaucuuuuuuccucagagaauuucauauaccuccaaggcuuugacaacagccucauugcagaugucuucauucuuuuccucuagugcucucaaauguucuuuugguuaagaguuugugcuuaacagucagagaaaccuagauuaaaaucucaguucugcuacuuauuagcuaugugacucuggacaaguuacuuaaccucucugauccuuagucuuauagucauaaaaucggguuaauaguaccuucuucauauaacugucagaaaugauugcaaucuuguauauaaaguacuuggcacacauuguaaacacuuacuaaaugguaacugcuauuaauuauuauacuguauccaguguucucuuuacuucuccccaaauaaauucccuuagcauucaugccauuuuuuucuauuaaaauguuuucccuuuuaccucacguccuugaagacucaacccaaccucuuccacugauaauguauuuauaugauuaucaaaacaagaacuucaauaacacucugugcuacugauuuguucuauuauaccagauuauaacucuaucagauuacaaggccuuauaagucagaggcaauaucuuaaaccacaaaucuuacagauuugaaccuugcacauuccaacuaauaaguaugugaaacaacagacaauugaauaaguaucuuaaacauaaguugugaugcaucccauaugccacacaaagcuaacauuuguauaguucuuuauauuauaagcauuuuucuauuaauucucauaguucucaccauaaccuuuagaggucaauaccauucuuauguccauuacagaugaaaaaaguaacagagauaguaacuuaaucccagcuuacauagcuaguagucaguagaccuaggauuugaaugcauuuugacucauaguacauuguucuuuagacacauaauaaaugcauuaguucauauacauuuuuaaguaauaaacuaaaaaugguguuauauuugacauuucaaauguuaagucaaccuugcauccuuaggaugaacucuacucaguuaugauauauuauauauaugaaggucuauaaaauucucugaggaaaaaaacauaggguaagacaaaugaacagaguagcaugucacugucugggauaagaaagugggaaaaagaaggaucaucaaccaggaaaguagaaggaucagagaaacagaaagaauaucaugauagaguaauaucuuggaagucaggguaagagagcauuucaggaaggaucgacaguacaaucagaugugccacgaaguuaagauagaaaaaugcugacaaaagauaguuaaauuugauuuugaagaaauuugcaucugcguuugugaaagauaggauacuggucuguaguuuuuuuuguuucuguuuuuguaaugccuuuuuccagguuuugguaucagaguaaugcuagcuucauaaaauaauugggaagugcuuucuauuuucugaaagaguuuuuauaagauuuuuguuucuuccuugaauguuugauagaauuaauuuuauaucaauuaauuuugauagaauuuauguuuccuuuuugugauacuuuugguagcuguauuuuuuuaugaauuuguucauuuuaucuaaguugucaaauuguugcucuuuuauuaucuuuuuaaugaaugugguaauaacuucuguuauucauguuacugguaauuuguguucuacuuuuuuuuugugaucauucucacuagggauuuaucaauuuuguuuacuuuuucaaagaaccaacuuuuggcucuuuguauuucuguugguuuuauguuuaaaacacaaauuuuuuuuuuuuuuuuuuuuuuuugagacggagucucccucuguugcccaggcuggagugcaguggugugaucucagcucacugcaaccuccaccucccggguucaagcgauucuccugucucggccuccuaaguagcugggauuacaggugacugccaccacgccuggcuaauuuuuuuguguuuuuaguagagauggaguuucaccauguuggccaggcuggucucgaacuccugaccucaggugauucgccugccucaaccucccaaaguccugggauuacaggugugagccaccgcacccagccuuaaaacacaauuuuuaaaaaauuauuuuaaauuaauuauuuuaauuauuuuaaaaauuauuuucuacauccuacuuacuuuggguuuacuuuuauccucuauuucuaguuucuuaggucauugauuguuaucuauuucaaacauuuaaaccuuuaaguuucccucuaagcauuuuaguugagucucacaaaaguuauauuguauuuucauuaucauucaguuagaaauacuuucuaguuuauuugugauuucuucuuugauccauugcauauuuagaaguauauugguuaaauuccaaauauucaggguuuuuuuauuguuuuuaaucaauuucuuauuuaguuccauugcaguuauaaaaacauacacugugugauuucagucuuuuaaaugugggacuuauggcuuaacaucuggaauauuuugaauauaauuuguguacuaaaaaaaaaacccaaauguuuaucuuauaguucauugauccuaauggacacuauuuuaucauuaugcaugaggugaagguuguugauaauguucagauagucugucuuuacuauuugguuuuucuuuggcagagggguguucaaggaagggauugauugugcuaucaguuguacagagagcgauuacacucacaacugcagaauugucuguuucucccuuuaauuugguagauuuuugcuuuuuguguuuuggagcucuguuacauaauuagaugcauauuugauuauuggauauucuuaauaaauugacucauuuauuaucaugacuuuuuucucuuuaauuuccaguaauguuuuguuuuauuuugucugaugugauauagcucaacaaacuuuauuuaugcaaggcauucuaacaauaucugccuuaugguugcaguuuacaguucauuaacauuuaauguaauuguugauauguugagguuagucuacuacuuucuuauguuuucuguuuauuccuuuugauuauuauaccuuuauucuuuccuacucuaccucauuuuguacuaauucaauauuuuuaagaauuuuauuuaacuuuuucuauggacuuuugcuguaucuuuuugcauuuuuuuuuguugcucuaaauauauauuccuaauuuuucaccaucuacuuaggguuaauuuuguaccacugaaaguaaaauguagaagccuugccacuguauagauucauuuaccuuacccucuucccauucuuuacacauaguuauccuuauguguuacuuccacauauauuauaaacacuacaauacaguguuaugauauuugcuuuaaacagucauauguauuuuaaagaaacuuagaggagaaaaagauucuauauuuauccauauauuugccauauuuuuugcucucuauuccuuccuugaagucuguguuuccaucugguuucguuugccuucagccugaaguuuuuuagcauuucuuaaucugcaggucuguuggcaacaaauucuauucauuuuuuugugucugaaaaauggcuuuauuuugccuucauucuugcaguguaauuuuugcugaauagagaauucuggguagaaaauuuuuuauuucagcacuuuaaugauauuccacugucuucugguuaccauuguuucugauaagaagacuuaguuaauuugaauuacuguccacauaaaugcaauggguuguuuuucugugcuugcuuucaauguuuucucuuuaucuuugcuuuucagcagguugacuaaggcauauuuaugucuauuuuuuuuuuucuuuuuugguaauacuccaaaaaagauguucauugguugauguugauuugguugauuugguuguuguuuacuuuuacuucuacuuuucauucuguuguuaaacccaucuaguuuuuauuucagaccuuuuauuucagauauuuauucuuuuagauguucuguuugauucuuuuaaauaguuuuuuugcagggauuuuucucuuuuuauucguuauaaacuuauguuucuuuguccuagagcauaguuagaauugcugcuuuaaaauucuugucuguuaaucugacucaucuccaaagugaucuguaucaauuuaugcauucucagcaggaaagauguuuuucuguuucuuaguauauuaauuuuggauuauauuguagacauugugaaugguauguuauagaaacucuggauuuuguuauuucuguuauguuccuccaaaaaauauuguuuuguuuguuuuuaaacaaagaguuagccuuggcugagcucagauuguaaaauaugguguuccgugaaguggcuggcaaaaauuucaguucauuuuuugcuuuagcugggcuccuuggacuuuacucugcucaugccauacauuugaccaucauuuacaaauagaauugugggcucauccuuuuugagauuuuccaccuuacuuucuagcagcuguaguugcugcaauacuugucuucugcuucuuauguuggacuuguagccauuguacauggugcauauuagggccuguccucaggcuaaaaagaaggggaauguuauuccauauuauucccuuuuuccaagugcugauucuuaucuaguaacggccugcucuuguucacuauuuaguaucuucagguaguucuuccucauauuuaguacagaguguauauuuguuaucugugggaagauuggucugauagaagcuuacccauacaucuauucauccauaguagaaauguaauaauguaaugccaccuagaaugguuuuuuauuuuauuuauuuauuuauuuauuuauuuauuuauucuuuugagacaaugucuuguucuguuacccaagcuggacugcaguggugcaaucauggcucacugcagccucaaccuaucaggcucaagcaaucuuccuacguuggccuccugaguagcugagacuauaagugugugccaccacacccagcuaauuuuuaaaguuuuuuguagagaagggggucucacuauguugccagggcucgucuugaacuucugggcucaagcgauccucccacguuggcccuccaaaguguugggauuacaggcaugaaucacccugccuggccuagaauaguuuuuugauaauucaugaagacuucauguugguuuagacacagaaggaugauuccuaagucaagcgugcuucuaguuuucuuaccuucuagcuuuuuagagagggauaagauagaagauacaagaggaaauagaugcuuguagagaaaaugaugaguucaguuuaugcauauuaaguuugucuuucucgucagauaucuuuaaagaaaguuucaauuggcaguuguauauacauaucuugagcuaaaggaaaaggcccaggccagaaguauaaauuuaaaaaucauuagcacaauggaugguaguuaaaaauuaugaaaauauauucauuuccuaggaagcauguagaguaaaaugagaaauuaauuuugugaacacagcccauugucauuaccuuucuauauuuguguugaauucugaaaaguaaaagguuaaaaaugcuauauuaaauuuuuacauuucauuuacaucacaauuauaacaagaauuguuuugucaaucagcaguauuauuugaacuuggauuguuuguguaaauuuaagcaauaguuuuuuuuuuuuguuuuuguuuuauguagcuacaaguggaccuucuagugcaguuguuccuaauaccucaucucggaaaaagaauauaacuagcaaaacagaaacgcaugaacacaaaaaaaacacugggaaaaagaaaugaaaucuuagcagaagcuggaacuuuuuauacuuauaaaaauaguauguucuuauguuucuccuuaugcauuuauguguucacuuaaaaauguuuuuaaaucuaagguuuucuuuguuuauguucagguaaggaacuguugucaugaucuggaaauguuuaaaacaauguuuguuagcauucugugagcagcaaaacuuauagugauaaaaaucgauuguuguuaauaugauguuuaccaugugcacauaguaaugaaaaggaacauaaaagcccagcaggcucguaccaaagucacagcaguaaugcuauguacugcagagucugaugagcuggccuuugugcacacuuuuauuuucaugggauugcaucuuagcuguuaaaacuucuagauugaaauuugacagccaggguuacauauuggggacuuuuaaagugucuuuccaaagagauuucauuaaccguuuagauuagaauaucuuucccaauuguuacagugacauauaugcugcaauauuuaacaacuggaguauuagccacauggguuauuuuuucaaucuguguuuugaauuuuuuuauuguguguuauuuaaaauauuacauaugcagcugggagaacuacaccuuugugcacauagauuuauauauuaauuuguagaaaauauuuucuuuauauauuuccuuaccauacaaggugccuuguucaucaggaaaacuuuuguuuuguauuuugacaagaaaggcaccuucagaguuucuuuuuaaguauaguugacaaguguauaaauguuacacuuacuuucagaguucuuuuuagaucuaaagaagucaguucaaaaauggaaaucaacaauguuaggagaaaucugaauucuguuaaguuaguaaguauuauguauagcaucuguuuuuaaccauuuccauucuuaucccuaguguaucaguugaucacacuaagaaagcuuaaagauugagcauuugaaauaaaugcucuuuauaaaugauuagauuuuugaagggauauugaaaucauugcgcugugauuucaucugugaugugaaaaaucaauuuauuauccuuggugcuuucccccccaccaaugcacaaauaauugugaacagcuugaaaugacuuaaacuguaauccaaaugggacaaucugauaagaauuucaugcauugguaguuaaauaacuuaaauugcuaaagcuuuagcuugaaauuuauguuuagaaaaacuauugauuucccaugguaugaauauaacuauuguaauucuucaaaugagacucuucucaccuuaaauagucauauauuaauuaacuuauaggaaauaagcauacuauauguuagcuguuuuaaaagguaccagauguaagagucauaaauauaugcaauuaaagaaguucauagauuucacaugaauguaaauguguuauauggagacaugucuuguaaacaguugaauguauguaaguuuucuguuugugaaaauguaguuaauguacucacuguggaggucauaaggaagcuacuuuuuuuuuaaaguggaaccuaauuaaaauauuuccagaaucaaagagacuuaaaugguaaauuuuuaaaauuuucuuaucucuuacuuuuuaguuuucaaaguagaaaaaaucaggaauuuuuuuauuaacuaguacuuacauauuaaauaaaauuuauuauuggcuauauac

SEQ ID NO: 12821 - RNA, 645 nt, Homo sapiens
cccacccucccuggacauguucgcugaggaguuggcggaggaggaacuggagaccccaaccccuacccagagaggaggugagcuuggaggacagaggagggggcaguggguaggaagugagacacuggaggccaaauggcuuugccuguuauuuuagaagcagagucgcggggagauggucugguggaugugaugugggaauauaagugggagaacacgggggaugccgagcuguaugggcccuucaccagcgcccagaugcaggugagcugcuuucucccuccuccugccuugucccugcuucccccacuccugucaguuguuccccagcucugcccucuccuugcagaccugggugagugaaggcuacuucccggacgguguuuauugccggaagcuggaccccccugguggucaguucuacaacuccaaacgcauugacuuugaccucuacaccugagccugcugggggcccaguuuggugggcccuucuuuccuggacuuuguggaggaggcaccaagugucucaggcagcgaggaaauuggaggccauuuuucagucaauuucccuuucccaauaaaagccuuuaguuguguacuggggccuuggcugugcugauggccagaagccaggggccuucucca

SEQ ID NO: 12822 - RNA, 1893 nt, Homo sapiens
gugcaccauuauucccgaaucccugcaauuugguucccauuuuucugcacaaauuuucuugcucagucgagccaaugacuuuuuuuuuuuuuuuuuuuuucaggauucacugccugggguaucccacuauauauaucucaccuaugauguaguggugcuugaaauacucaucucauuagcucgauuuuauuauucuaaucuaagguuuuuuauauuauucauacuaugauauuuuuagggacaaucaguaauauuuggggcagaguacugagggaccucuugaagucugcaacagcaugcauuuucuuuguuuuugugggagugcuucccuguagcugucuuuguucuagaacacugcuccaaauuuauuuccaugggauguagggcuaguagcccaugugaaagucuucuguaaucuccuuggggugugaguuauuggguuauucuaacaggaguuuuccaaagggauggcccauuuuuaauucaacauuugcuuuuugaaaauccagaaguagacaguuggauauaauagugguggaagagcaugggcuguaagcagaaggaaauagagaugacaaaugccucuuaaaggggaucuaguugauaccucuguuaaauagugggagaacacaguagcugguaccuuacacugugcuuuaggaaaauccuaugaggauuucauuuacaaauccucauaggauuuucuggguugagggacaaugcaacuauuaaguagagggagagggagagggaaagggagacaugaagcacugggucuaugugaagggacaggcagauauacccaaagagggagaaaauacuuaauaaaggaagaguauagcugcaaaacaagacauauaggagcugaaggccagauauggcagaaaccagcuggagaaagaagcacaggacaacuaggacaacuuagucaagcacaaucugucauuccaguacggacuaccaaguucaauucaggaugcuucaguugaagacaugugggguaaugugcucagcucaugaggguccaaggaguccccauuuucccuaucacccuauccuaugcucgugguuuggauuguuagcacacuaggcaauuucagaguccgcucuagaguugguugccacgucagugcagacagacucuagaauccucuuaaccauggaaugcaaggccuguuccuguggaucuauccugacuugaguaugucaguacuguugggaaaaugaguucaagaauauuucaguuuauauauccugguugccgucauauauuuuuucauuucaccacuuguuuguguuugccucacucaacagucauggguguagaagcugguuucagcuuggggcuguuacaaacucccuacauaagccauguagcugcaauccaggguuccucccacccuacggcuuuagcgguggguucucuggcccucuugauaacaaauacuccagucuaauggcuauauuaaugcugcucagaggcuauuaacucaaauccuugauguguuucauuuacaauuauguggauuauuuauuuuaggagcuuuuuuuuuuuuuuuuuuuuuuuuuaagggccaaauagcccuacagauaaaugagcugcugggcuguguagaaaauauuguccaaauguugccaaauauugacuucguaaaggggauaucaagcugcuguuuauaaaucugaaugucuuaaaagcauucuugcuugcucucucuguuauagauggugucuuagccaguccugaguuuuccaaugaacccaauuuuaauauaugguauuuuuguaugccaaacuggugucuuguccuuuguauaugugguaauguugauuuuaugacuaccguaaaaacacauuugcuaugauuaaaguucauaaaaugauuucaaauag

SEQ ID NO: 12823 - RNA, 119968 nt, Homo sapiens
caguucucgcgagacuggagaccaggaagacgccugcagagccgggcugcuggugcagcagaggcugaggcaucaggugcagcugcauccggaucuccugccuuggagcguacuccuugucucuaagucgggaggcaggacguggucaggccggggcuguggaggugcgcuguguccccugaggccuagaggauucgggcugcggcccgucggaaccagucagggaggcgcccacacuccugacaggauaagauggcggcgauggcgccuggagguaguggcagugguggcggcgugaauccauuucucagugauucggaugaggacgaugacgagguagcugcaacagaggaacggcgggcaguacuucggcugggcgccggaaguggccuagauccuggcucugcgggcucgcugucgccacaggaucccguggccuuaggaagcagugcgcggccagggcucccuggggaggcgucggcggcugcaguggcccuggggggcaccggggagaccccggcccgauuaucaauugaugcgaucgcugcucagcuguugcgcgaucaauacuugcugaccgcccuggagcugcauaccgagcuguuagagaguggccgggagcugccucggcugcgcgacuacuucuccaauccaggcaacuucgagaggcaaaguggaaccccgccggggaugggggcgccaggggucccuggagcagccggcguugggggcgcuggaggucgggaaccgaguacagcgucgggcgggggacagcucaguaaguggacgcagccugucacacuccggcaggguauuugggauuguacggaguuacuguaggggagaggggguauuucugcgugggucccgauagggacauuuuaaggaacgagaguauuggggugggggcgcucuuuugcgguggaagcaagaggaucaggcaaugacuguucucucugccugcuuccaacccuuggcugguguugcacuuggcuccuggcuccccuacuggugucaguaucuauaaaauaucaagaguuucuaguucacuggcuauuacgggacuccagaagguucccuuuuauacuaguuuauugcuuuaagcauuuuccuuuuucuccaguuaccugaaucacacuaccaggaaauaguguuaccugaauugccugcaguaguucuuugagucugagccaggagagaaagaauaggacacacugcugcugucuccgaaaagucagauguacuuaagacccuuugucuuugggacgacuuuuucaccgccaaaauuggguuuucugcugcacaaaauuuguucuguugagauaaaguugauguaauucaguuucaaugccuuaauuuaaguaauguccaaaauuacaggaaauccaaggagcaaggcagacagguucuaccagcagucugucucaccaucccaccaccuugcaggcuuuucucuuugcauuagauaggaauugaccuuuuuaccuuggaaugauuuuuagcagcauagaguaaucguuuaccccauauauucguaagcaucucuuauggcuugaaaacuuacugucaaagauguaguguacuguauguaggauucccagugucucccuuuugggagguaucuuaaauauucccuuacuaauguauggagauguuuuaguaugaggccauauauuaauucuauauuaacaaguauucauauagaauuuuuaaacugcagccuaauugauuuuuuuuuaaucacuaugcuuuugaauagugccagagacuuaaauugccaaacguagacgugguggaagcuuagggagugcauuuucuaucaaggugaaucuuaaauauauuucccccuuggauaugggauuuucucaguaguuauaauuuccuuacccaauauguaggauaaucuucuuuuucgggaaaagauuuucucauugcugaccuuuaagacuauaaaaugagacaguaguguaacaaaauuguuaugugugguggugggucuuuuuuuguuuuuuuuuuuuguuguuuuuuuuuuuugguuuuuguguuauuucuaagauuucuaaauuaucucaugauuuuucaccagacaaggucuagcuaagaugucaccuuuguacaugcuuccuccaggcuuagguaguugcuugguuucuuucauuguuaacacuuucaaaccuccaucauagccuuuagcccguuuguaugugauuguugacaauaccauuuuucuccauuggucaguucuucagagacauuuuuauaauaaauuucucacacuuugcucagucccuggcuguugaugaacauaacugaauuguaucugcuguguuuucaaccguauuaauacagugaaauggauuauuccuuaguugguaacuuuauucauuuaauuuuaaagaauuucuugaccuuuucacccugucuuauuagggcuaucauagcauuguuucuagugaaaauuccuccuugcaaacuuuuuguauugaaagaauuauaauugagcucauuaaauaguuuagcaguguuuuagaguaaaaccuuacuucuaagugccuuugcauuauacauuuuuauacuuucuugaaauaacuagagucuuaugaucaaauaucacaauuaaauauucaugugcaccugugcuuuucuauuauccucauuuauuuguaccuguuuuagguacuggauauauaaguguuuguguuugucucuauguguguguguacacaucaaguuuauuaaauuuuuacuuaauacuaagcaaaugaacaacaggacaaaaaauucaaaauuauccauaaucccaccaaugguauuugcuuuuccugucuuuaaugguaguugccuuaccugucuuuucugugcauguguuuuaaaaaacaaaaaauggauuaaacuguuuaacauagucuuauacaggcacuauacuuuuuagcaucaacuuggauguaaaauuugcauacaguaaaauuuacacguuuuaagugugugcaguuuggugaguuuugacaaaucagucacuaccacaauuaaaauacagaacaucggcagggugcaguggcucacgcccguaaucccaacacuuugggaggaugaggcagccagaucacgaggucaggauuucgagaccagccuggccaacauggugaaaccccuucucuacuaaaaauacaaaaauuagcuaggcgugguggugggcaccuguaaucccagcuacacgggagacugaggcaggagaauugcuugaacccaggaggcagagguuacagugagccgagaucccaccacugcaguccagccugggcgacagagcaagacuccaucucaaaaauaaauaaauaaauaaaaguaaauaaaauaaaauacagaacauuuuuauuauccccagaauuccuucauucaauauccuuacuuccaucuagaccaccacugaucacuuagaacagaauuucucaaccugggccuggguacuuucaacauuuugggccugguaaugcuuugccguggcugcuggccuguguauuauaaaauguuuaacagcaucccugaccucuacccaccagaugccuuuagcaaccacccccauaccuaugccaccccaguuaugaccaccaaaaaugucuccagcauugcccagggaaggggagggcauaauugccccaguugagaacuacgucuuuagauaaguuuugccuguucuaaaauucgauauaaauagaaucauagaacguauuuuuuuguguaucugccuucagcauguuuuuaaaagucaucuaugucuuuguguguauuucuagaucauuccuuuuugguuuuauccccaaaagggggggauaaaaaauuugugucuuuuaagacauuuguguuuuuuccaguuuuguguuauuguaaagaaagcucccauuuacgucuuuaugagaaacugccaaacuguuuuccaaaauggaccauuuaaaauuuccaccaccaauguacaagaguuccaguuucuguacaucuccuaaacauuugguauuuuugggcuuuuuaaucugucauuuuagugagaauguagcagugucucauuguggcuuuaauuucuauuucccugaugacuaaugauucugagguccuuuuccugugccuuuugcuuaguauauuuuuuaugaaaugccuauucaaucuuuugcaccguuuuuuucaccuucaacuuccaggguacaugugcagggugugcagauuggugacauagguagacaugugucauggugguuuucugcacagauuaacccaucaccuagguauuaugcccagcacgcauuagcuauuuuuccugauacucucccccucacccaccauguccauguguucucacuguucagcuccuacuuauauaugagaacauacgguguuugguuuucuguuucuguguuaguuugcugaggauaauggcuuccagcuccaucuaugugccugcaaaggacaugauccuguugcuuuuuauggcuggcugcauaguauuccauggugugcauguaucacauuuucuuuauccagucuuucauugaugggcauuuggguugauucccaugucuuuccuauugugaauagugcugcaaugaagauacacaugccuguaucuuuauaauagaaugauuuacauuccuuugggcauauacccaguaaugggauugcugggucaaaugguauuucugguucuagaucuuagaggaaucaccacgcugucuuccacaaugguuuaacuaauuuacagucccagcaacaguguaaaaguguuccuauuucucugcaaccucuccagcaucuguuguuucuugacuuuuuaauaaucaccauucugacuggccuaagaugguauuucauugugguuuugauuugcauuucucuaaugaucagugauguugagccuuuuuucauaugcuuguugccgcaugaaugucuucuuuugagaaauguccauucguguccuuugcccacuuuuuaaugggauuguuuuuucuuguaaauuuguuuaaauuccuuguagacucuggauguuagaccuuuaucagauguauagguugcaaacauuuucucccauucuguagguugucuguucacucugauaguuuauuuugcugugcagaagcucuuaaguuuaauuagaucccauuugccaauuuuugcuuuuguugcaauugcuuuuggcauuuuuggcaugaaauauuugcccgugccuauguccugaaugguauugccuagauuuucuucaaggguuuucauaguuuuggguucuacauuuaagucuuuaauccaccuugaguuaauuuuuguauaaguuguaaggaaggaguccagugucgauuuucugcauauggcuagccaguucucccagcauuuuauuaaauaaggaauucuuuccccuuugcuuguuuuugucauguaugucaaagaucagaugguuguaaguauccagucuuauuucugaaugcucucuucuguucuguugguccgugucuguuuuuguaccaguaccaugcuguuuugguuacuguaaccuuguaguauagucugaagugagguagcaugaugucuccagcuuuguucuuuuugcugaggauugucuuggcuauacgggcucuuuuuugguuccauaugaauuuuaaaaguuuuuucuaauucuaugaagaaugucaaugguaguuaaaugggaauagcauugaaucuauaaauuacuuugggcaguauagccauuuucaugauauugauucuucuuauccaugagcauccauuuauuguguucucucuauuuccuuuaacagugguuuguaguucuccuugaagaggugcuucacuuccuuuguuagcugcguuccuagguauuuuauucucuucauagcauuuaugaaugggaguucauucaugauuuagcucucugcuugucuguuguugguguguaggaaucccugugauauuugcacauuaauuuuguauccugagacuuugcuguaguugccuaucagcuuaagaagcuuuugggcugagacagugggguuuucuagauacaggauugugucaucugcaaagacaauuuaacuuccucgccuccuauuugaauacccuuuauuucuuccucuugcaugaucccuggccagaacuuccaauaccauguugaauaggaguggggagagagggcauccuugucuugugccaguuuucaaggggauugcuuccagcuuuugcccauucaguaugauauuggcuguggguuugucauauauggcucuuauuauuuugagguauguucuuucauuaccuaguauauugagaguuuuuaacauaaaggaauguugaauuuuaucaaaggccuuuucuguaucuauugagauaaucaugugguuuuugucuuuaguucuguuuaugugaugaauuacauuacugauuuguguauguugaaccaaucuugcaacucagggaugaagccaacuugauuguagugaauaaacuuuuugacgugcugcuggcuucgauuugccaguauuuuauugaggauuuuugcauugauguucaucagggauaguauuuugcccuuuuuuaaauuaagguuuuuuacauguugguuuuguuucauuauugaguuguaagaguucucuauaugugcauuaucaaaugugaauuuugcaaauauuuucuuccagucugauuucccuuuauuuucuuaaugaugugucucagaccaggcguaguggcucacaccuguaaucccagcacuuugggaggaugaggugagcagauggcuugagcccaggaguuugagaccagccugggcaacaugacaaaacuccgucacuacaaaaaaaauacaaaaauuauccgugcaugguggccuaugccuguggucccagcuauuugagaggcugagauaggaggaucgcuugagcccagguggccaaggcugcagugagccaugauaccacugcacuccagccugggagaaagaacgagacccugucucaaaaaaaaccccaaaaaacagugugucuugugaacaaaagcuuuugauuucaucaaauccaguugacuguuuuuuucuuuaauaauuuauguucuguauguccuuuugagaaacauuugccuaccccagaguugcaaagauuuucucuuacaaguuuuauaguuuugacuuuuacaauuaggucuauggcggcaggaaccguauuuuaaugaagguaucauaaaggagaaaagaaauauuucuuaaauauuccuccuauaaacauguagacauuuauaguacaaacuuuaguacaguuuuaaaauacuuguauaaaacugugcucaguacuguauuuggaagauuucaacuaagcuccugaucacacaaauuauauugucuaggacagggcuacugccuauuuuuaaagguccucuauauauucaauuuuagcaugucgauugauacuacuuggaugugauuuuauaauacucaauaagcacuuguugguugauuauaaacgguuuaaagauugguaguauggauuaucuaaaacauuauuuugauuuguuuuuguauauauuuugauugauaugugucugaucugaaaauucagaauacuucagaacaauaaauguauaauaaaaagugguuuucuuuauuuaaugauguuuaagaacaaugcaauccuauuaaccuuuauaauuuuagauuuagugaauuaucucccuaaaacuguugacuuaauacuguaauauaguuguacuuuuaaacauacuuuaagaagucuucauacuguuuaauuuuuuucuugauuauaagaauaauccauauuuacaaaacauucaaauaugaacaggauauauagcuuuauaaguuugauguuuucaauagaauuucuauuaacugaauaaaauuacuuuuaacagauauucuaaggaaaucucaguuuuggauaaauucuuguagcaucguuguaauguuccuacuaaauuuacaugaugaaccaauuagaucuuuuauauguaauauuauuugcuggaauauacacacacucuguguguguguguguguguguguguguguguguauacacuguauuuuugccaggugagccaggauagcuuccauucaguacuuuguuuucuaguuacauugcaagauaaaaauugugguaaugacauugaugaacacugagcagguuauaguaacuuagcaagaguaaugcuuuuucugcuugaagcauuagggcucuaaucaaaauuagacuguaauuucuuaugauuagcccaguucuuugcacaguagagauguaaugugaucaaguggagagggcaacuaacaugccuuuuggugauagauuucuuuuaccaugccuucagauuuuuauaaggcagcuaacaggagguagucauuuauguuugaauguaaucauuucaccuaugagcuugcagccuuccaaaaucaucuuccuuuuuuuuuucuuuuuuuuucgagacggagucucccucugccaggcuggagugcaguggugcagucuuggcucacugccaucuccaccucccggguucaagcaguucuccugccucagccucccgaguagcuaggacuacaggcgcaugccaccacacccagccaauuuuuuuauuuuugguagagaccagguuuuaccacguuggccaggcuggucucaaacuucugaccucaugugauccgcccgccucggccucccaaagugcugggauuacaggcgugagccaccaagccuggccuaaaaucuuucuuucaugauccaacguaucguuucucagaacucugaaagcauauaucuaacuaugcucgguguuccuuucuuagcaucgccaacacuaagaugucacgauugcuuucuuacaaacuuuucaucccuucuacuuuauaaaguaguuccccucuguuaaguugggauuggauuuaguguuuccucugcuuucugagagagaaaauaccagcgcaauuuuucuuuucuuuucuuuucuuuuuuugagacauagucgcccucugucggccaaacuggagugcaguggcacaaucuuggcucgcugcaaccucugccuccuggguucaagugacucuggugccucagccuccucaguagcugggauuacaagcccgcaccaccacaccuggcuaauuuuuguauuuuugguagagauuagguuuugccauguuggccaggcaugucuugaauuccuggccucaagugauccaccugccucggccucccaacgugcugggauuacaggcgugagccacugcgcccggccccaucacaacauuucuaaaauuuauuaaguucacugcuuuuaccugaauuagacuuuccacuauucucugggccauagacguuccuaaauauaucuacuguguaacugucauuuuucuuuccuaugucuuuccaauuguuucaaauuuauuccuguaguuagauauaaucccugcuuagcaugguggccugaauauaguugguauucaguauuuuuacaucgauauauuuauuaaacauuguggucaguuaaggauuacagcgaucuaaaaguuuaaugcauauccuugagcuuauguucuugauggagagguaagacuaacacaugaaagaauuugagaauagucuccuguggcaaagauaauguuuacagaauauaaacauucuguuauagaaaaaucuuuguugauugugaaaaugaaaugggccuguggggaaaguaaaaguuaaguuugacccuccagaguggguaaaauuuugaauaaauaguaacuuuauuauuuggcuauauuuagacucuuuauccugaguaaggaaaggaaaaggaaguacaggugaaggaaagauaauagcucuuguauuuuuucauguuuaaaacaucaucugggaacaugacacucccugcuuaccaucaucugcuuaccauauaauaggguguuuccacugggguaguugcaaaaauacaauaugacauuucagccucuugugguacucuacaaggaagcaagauaaggauauuaaucugggaaaaccaaccuuauuucugugaaaaauuaaaauuaugcuuucuacuuuucaaacaaggaaguuagagcuggaucuucaaaauguuuguuaaaaaccuagauugguuguuuggcauuuuucagucaaaaauuaaauugagugaauuuguuuuuaauuuagcuuuuaacugugcuguuccacccuauccugcagcucccagccucccagccuugucuaaaaauacacaauacuuauaucugaauuacaaauaucaguugagaaacuucacaucuacaguauacuuaguuucuacaaacuaaggaaaucuauauaggaaaaccugaacaaguugacuguaaauugauuaauuuucuuuaaggauagauuccucauagauuucugagaauugaauacccauuacaauugaauauagcaaugguauuuaccaagauucagcaaaagauagcgggaucaagaagaaugcccuagagcugauaugauuggauuauacuaagauacaggacagacaucucauguuggugugaacaaauagagaaauaugggcuucaucauaguagcuguggaaacauuuugacugauaaaacaacacuaggucugugccagacuauaccagcuauaauuuugaaaucagccuauuguuugaagaccacuggacuuauaccaaugucugaucuucaguucugucucugccacuuacuagcucuuucagcuuggguaaaucacuucuuaaugcagaaggcaagccagauaguacaaaauugaucauuuaaaaaauaauuagagugacaaaccauagcaccacacuaagucacagaugaauaaucugccuaaagcaucacuucauuucaucaaggcgcccacacugcauagcauuaaacuuaaucaaaauuaggauagucacauccuacaugugauuguaggauaucugggcaaagcccaggaucaacuaaaccucaacugacagccaaauauagucaucaacuguuccucucugugaaauaaacuaacaaggccaaauuagcuugugcucucuuuuuuuuaaucuucaggguuugcugcaugguuacuuauaaguugcugaucuagucauggagcaugacuaaaccucaaggaggaguagaacacaguugcaaucauggguguagccuucuuccagauuuucucaccuauuaugucaaaaauccucagccgucagaaauaguguucauuuguuuuugaaaccagcugguccuguuguggguggauaagauugcucaagguaguaucguugacauuucuguuacuucaaaccaccuaucagugugugcuugugagcucccuuaguuuaggcuuuagcucacauuuguaccaucaguuuuagucuuauccuauagcuuuaaucucuuccuccauccuuacucuuacuugauuuuaagaguuauucauucauaguuauuuauucaugucauucuagcuaaagccuuuuaaauaaaauugcuuccuccuguccgaagcaacuuuuucaaaccuuuuuuaguagcaaaaaaauauauauuacagaaaaaauuuauaaaccucacuaggaauuuuuuaauuucuucucuuuuuguacgguauauuugucaaaguauaaaagugacuuuaaaauauuuuauuguggcuauguauaauaaaguuaucccuuuaguuuugcuucuuccugcccuuucaaccauguuguccauaugcaaaaccuuuauucuacucacauuguuucauuuuucccuugaaacauguguuauauuuucuugaauauuuauauuuauuauauuauauuaauauucuauuuucuugccugguauccuuguccacauuauuuuuuuuuucuuauggaauacuuguccugucuuccauauuucuucuaaauccugugcauccuuaaaggaagauccuguuuauauuccugccuuucccuaaaguuucuccagcccauggugaucucuaaaucuucuguacuugagggguuuuuuuggcuguuccacuuauggaaauuaauuauauacagaccugugaauauguguuucuaauuaacucuuaauaauauuauugaaauguuuguguguagauguuuuagcugacuagauuuuuuaaaagauguuagcucauaggucuuauauuguccucuuucaugccuagcauaaaugccuaagguagacaguuuauagaaaauuuaucuguguaucaacaguacuuaauauugugccuggcauacaagcuuucaguaaauauugaaguuacguuaaagaauugaucuuuagguaguaguuuccuaaacauuuauaaguugggaauauuuucuugugaaaauuaaccuuuuacuuuauauccgauuuccucaacucugucugagcaagauuccaucaaagcucuguuucugaggccauucacaacaucaaacccaacuuaccuggaaucuaggcgaucagaaccuggaugcucuuacauauuauucaagagaaccaaugguuuagagcucaggcuuugcugucggagagcuugaguucauauuucuauucugccacucccucauugcaugacucuggauagucuuuguuuccuuuacuguaaaaugcagaugguaaugacuccuuuagcacaggguuguuaugaaagguuaucuguguaaaguauguggcauaaaauaaguggucaaaaagaauguuaauaauaauaauuacuauuguugucaucacuaacaauaaucauucucuuuacuaauagcuuuucauaugauaaagucaucuuguauuauagaaauuuuaagugacuagcuugucaauaaaguuucagcauguaaguuucuucccaaguguaaaucuugacuuugaaguuccacucuuucugaaacccugugacaaagagaaaaagacagugggcugcaaacugggaggcuugaauucuacuucuggcuugcucacagauuaauuuuuuaaccuuuaagauaaaguaagccaauuguauuauuguuaucccuguauaugacuuaauuccaaugauucauaagcuuccuuaaggcaaggacaaaguuuuaccgaaguuuuaucuuuguacuccucacuauggcuuaguaaauacugcauaaguacauagcuucaguucucucaucuguaaaaaugaggggauuguacugucuuaauuccuuuuagcucucaaauauuuuggacauagaggucagugaaaaauuagccccaucuuuggagaggaauugaggaucaggaaaauauaaaugugagugccgcaguugcuaaaaguaaaaggcuguccccaacuuuuuuuuuuuuuuuuaauggagagauagaccaagauccuggucuauccagaaauuagccuuucuauucugguguaucauguguauucuaaaguguuucacaucuuuccuuucuuuaucaccaagguuacugcuauaccaagccuuccaaauaauuucagaacugaccuugagugggaggaggcagaguaccuuugugguuuuacucugacguuuauaaauacagugcccacauaaaagaaacuuuucauuaguauugaaugaauuuuauauuauuuccaaaguagaaaauuuauagucuuauuuuuuuaacuuucauauuuuagaguagccuuauagguucucuuucuuugacauacaucucugagaucccaccuuaagugaauaacuguuuuuucuuugcuuuuuuuuuuuuuuuuuuuuuuuuuuugagacugagacuagcucuguugcccaggcuggagugcaguggcgcgaucucggcuuacugcaaccuccgccucccagguuccagugauucuccugccucagccucccaaguagcugggucuacaggcgcaugccaccaugcccagcuaauuuuuuguauuuuuauuagagacggaguuucaccguuucagccaggauggucucgaucuccugaccuugugauccgccugccucggccucccaaagugcugggauuacaggcgugagccaccgcccccggcccuugaauaacauuuuaaaauguuuacacacaaccucagguuuaaauagaauuacuuuuaaaguaagucuguuauuagcaauaucuuuauauuuauugaauuuauuauuauaaauuucuuucucaugacagauuuuuuuaagcaugguugaauaaaucgucuuuacugaaagaauuguaauauaaagcgaauugcuugauuuuuuuuccauuuaauugugaauuggauacuuucaugauuuuuaaauuauaaagugcccauauuaaaguauauauuaaauguaauuaugggggaaaaugccaaaaguaaaaacaaaaagcucaaauaauacaaagagaaauauguagugaaaaauguacuucugcuucucagagucaguuauuauuaauaauguauuguggauguuuacaaaaacauuaaugcaaauguaagcauauauaaacaugauuacuuagacuuauauauccauguccuuuaaaaaaauuauuuugcuauuccugucagugaccuaguucacaguaguuguucaauaaauauuuaaauuacccaauacucuuuuauuagucgacagcugguccguuuuucugaugcauuugguucuuaaagugccauguaguuuucaaggaucugagacuaaguuuuucaauuauaguaaaaacauuuuucagcaguacuaaaauauuaaauguaaauauaaauaaaacuacuuuuguaugugauuuaaaacaucaaucugcacgacuguguauaauagguuuaguucucagacuugauaaaacuuaugaacagguuuuaccaguuuaccaacuaugaugaaaguaccugauuauuuguuucugaguuauaaagugaauuguuaagaaguuacacaauaggcauccugguauuugaagaaaugcucuguaguuaaaauacuucauauuagaauaugguagauucuuaauaaaagaggcuaauuuucccaaacucuucuuguauauuaggacauuuggaaaacaaaaggcauuugcuucuccuggaaaagaauuguggcuuaaucuaaagaagcacauuuaccuugaagcuuuaauauaaccuguuacuagucuuaaaauccaaaguacauauaggguaguccagucaaaguuaaaauuacuuucuuccauaaauaauuuuucuuucugacaagauggaguagauuuuaaugaauugagagauuguuuuucuuuugugacaucauauuuauuauauuaaaagauaucagagcuuuuuuuuccuggagaauaugaaguuguuggcuuggaacuagaaaaaauuagaaaauauauuuuucaacggccaugauaaugccaaguugaaaauuaaaguguguguuugcuuucccccaagagucucccuguugaauaaaugaguucuuuaaaacuuuuagagaaauaauaaugguguuauugaagaauaaugucucaugaccaaaguagcucuaaucuaggcuuguauauaugauuuaaaauauuagaaggaagaugaaaaagacuuaguaaacuaauaacagauggauaccuaauaagaaauauuuaucugaaauuaacagccaacaccauaccuaacauucuauuaaaaucaggaauaaaacaaugaagccugguaucacagcaccagaauauugguugauaaaaguucaccauugaguguacauguuuuccuaugcagguuagagacuucagaguagcuaauaaggagccacgacaugggccuaagagaagagaagauaguacucaaguggaguuucugcuuagggcagcaauggccagaucaacuaauauaucaggaauaucuagauauuaaauacaagaucaaaagacaugaauagauaauucacacacaaaccccaaaaauaaauggucaauauauuuuugaaagaauguagcuggacaugguggcucacaccuguaauaucagcacuuugggaggccgaggcaggcagaucacgaggucaagagaucgagaccauccuggccaacauggugaaaccccaucucuacuaaaaauacaaaaaauuagcugggcgugguggcgggcgccuguagucccagcuacucgggaggcugaggcaggagaauggcuugaaccugggaggcggagguugcagugagccgagauugcgccacugcacuccacccuggugacagagugagacucugucucaaaaaaaaagaauguccaagcucacuagaaaucaaagagauacauaauuaaacaaaauauaauuuuauagcauguuaaauuggugaagauuaaaaauaauacugaacauugacaaaugcuguuacauauuauuguuggaauucagauugcuauguacacuuauuuuggaaagcgauuuagcaguagccuuaaucaacuuuaucaguagccuuaauaauauugcaauuucucacuauauaagcuucauuuuuaaaaaacaauacauaugugaucccagcacuuugggaagccaaggcaggaggacugcuugaggccaggaauuuaacaccagccugggcaacauagugagacccaucucuacaaaaaaauuaaaaaguuagucagcaaugguggcacaucucuaguccuagcuacuuggaaggcugaggcgggaagaucacaugagccuaggaguuuuggguuacagcgagcuaugaucaugccacugcauuccagccucagugacaggguaagagccuaucucaaaaaaacagcaagauauaagauuguauauauaaauuuauucuauuuuuuacacaaauaucuuuacauacuuauauaugggggaaaauucaaaaaacaauauuuagaaauucaagcaaaaaauuugaugauauacugcccuuauccccaguuuuagugguguuaggaugauuuaucuagucuucuauguacuuuuauuuuauaauuauuuauaguacuuuuuuaauaauucgaaggaauaaucauuuauaguguaauaaaaaauauuggagaaaaguaguuagauuaauuuuauuuuaaagaacuggaaauuuuagguauugcauaguaauccaggaacuucauuuuauuuuauuuauuuaugcauuuauuuuuugagacagagucucccuccgucacccaggcuggaaugcagugucucaaucauggcucauuacagccucacccuucugagcucaagugauccucccaccuuagccuccuagcugggacugcaggaaugugccaccaugcccaacuaauuuuucgauuuuuuguagagacaaugucucacuacguuucccaggcuggucucaaaccccucaaacagucccccgccucagccucccaaagcgcucugaugauagccaugagucaccacacccagcccuccauuuuauaauaugucauauuaguuauuuaccaaggcagacguacugauaacccaaugguuuauuccaguuuagcauuuuauauuuucaguuauuuaaaaggucuauuaguaaaaagccuuauaaaguuuauccacaauauuuugaaauuuguuuccuuucuuuuagugauucauggucuagcuuugguucaauuucaaacagagggagaaaaacacaaaauuuuuguuuguuuauuuaagacaguaagaauagcuauuuuccaggauucaaccuugauuauuaauggauccugaucaguguuagcucauuuuacccccauacauucaaguuuuauuucuuuaacuuuuuauuaugaaaaguucaaagcauacagacaaguugaaagaauuuuuuacccauacauccaccaccuaauuccaguuaaccauacuugguuuaucucauaucaauacaucuuuucagccauuucuccaucaacaguacaucuuauuuuuuaugcuuuucaaauuaaguugcacauaucaguacgcuuaauacuuuaucaugcaugucauuaauuagagcucaauauuuuaaaauuguggagguuuugagguaauauuuaaagagaguaaaauauauaaaucuuaaguguaccauuugauaaguuugaacaaagaauguaccuguaguaacccaaacucauauuauauauacaauauuaccaucacccuggaaaguucccucaaggcccuuuccagucaguuccuaccccuucuagcccuuuaccacaagaaccacuauuaauuuuuuccuaccguaaaguacuauugccuguucuaaaaacuucauauaaaugaaauauuguagguacuccuauaaggcuucuuucagcauaaagcguuugagauucacucauauuauugcacaugucaguauuuuauuuuuaaauugcuaaguaguaguccugaguucagcacauuuuuaauauuaacuuuuugagaugucugugguuacuguauuugguauuucuuagcuugugcugaaagaaacuauguuauaaugaagaguacuguaauauuuggcuuucugucaucauuauuuuuguuuauguugucuuaaaacuuaaauugggcugggugugguggcucucgccuauaaucccagcacuuugggaggccaaggcaggaggauugcucgaacccaggaguuugagaccagccagagcaacauggcaagacccugucuccauaauuuuuuuaaaaaaauuagccagaccugguggcucauagucccaccagcuaacugggaggcugaagugggaggaucgcuugagcccaggaagucgagacugcaguaagccaugauuuuaucacugcacuccagccugggcaacagggcaagacccugucuccaaaacaaacaaacaaaaacuugaguugauagauagcaaguuuuuuuguuuguuuuuguuuguuuguuuguuuuuugagauggagacuccuucugucgcccaggcugaagugcaguggcacaaucucaggucacuacaaccucugccuccagaguaacugggauuauagguaccugcuaccauacccggcuaguuuuuguauuuuuaguagagauggguuuucaccauguuggccaggcuuguaaaggagaaccugcaagcuauuacuuagcagguauaauuaaacugcagggaaauuaaauguuucuccagauagaaacaguguuuaagaagaaugauauauguagaauuucauuuaguucaccuaauagggauuuaaaggcaagugguacauugauaaugacauagcccuauuugaagagucaaccaucuugauuauugugauguacuaacuguuuuaaaaggugaugggggagcccaagguggaguccaaaucuguauuccuauaacuuccauucauuugucaagauugugcuuucuauacacaaauaauccauuuccuuagaucaauauguauacuuuaaguacuguguaaguaacaauuuaacagaggguugacaauagccucuuauuugucccuuuuuaaacauuagcuggauaaaaaaaaguuuuguguguguaaaauuuaauagagaagcaguuaaaauguccuuccugcuacuuuacaaccuaccuagccucagcugucaugacuugccugcucccgccccacccaccacccccucuccccgccccgcagcuucuguacauuguaacugcuauucauacacaacuuguccauacuuggaaaacucaauacacuuguuuguucuuuccuucugccuuuacuuuuuuguagaggcagggucuugcuauguugcccaccaggcuggucuuaaacucguggguucaagugauccucccaccucagccucauuuaaaguguacaauucauugguuuuuaguauauuuccauucauuuuuaguauauuuacagaauuguacaaccauuaccuaaucuacuuuugcagccuguucauaauccccaaaacaaaucucuuauccauuagcguacacuccauuuucccccucaacccccaaucacuaaucucuaugucuauagagacagacuuucuaucacuauauauuugccuauucugugcaauuuauauagauggaaaucauacaauaugugguucucuuauaacuaucuucugucagcauaauguuuucagaguucauccauuguuguagcauguuucaauaguuccauccuuuuuauugcugaauaacauucuauuguacagauauauaccacauuuuauuucuucauuuaucaauggacagauauuuaguuguuuccacuuuuuugccauugugaauaaugcugcuaugaauaauuauguacaagauuuuguguggacauauacuguccuuucucuuuagguggaaguagaauuacuguccuaugauagauaacucuguagccuuuuaagaaacugcuaaacuguauuccaaaauguccauaccauucccaccagcuagauguaaggauuccaauuucuucacauugucaccaacacuauugucuugucuuuuuauuaaagugaaaaauaauucauauaccaucaauucacccuuuuaaaguguacaauuuggugguucucugugcauuuacaaaauuguacaacugucaccacucuaauuccagaacauuuuuaucaccccaaaagaaacccuguaccuauuaccagucacuacccauucuccuaugaugccagcuaaaaucuacuuuguguuucuauggauuugccaauuuuggacauuuuauaugaauggucauacaguauauagccauguagccuuaugugucuagcuucuuuuauuuaguauaauguuuucaaggaggaacugccaaacuuccaaagcagcuguaccacuuuacauuaagaagagugauguaugaggguuucaguuucuccacaucuucugcaacuuaccaucucuuuuacuacaaccaucuaguugauuugaaauguaccucauugugguuugauuuucauuucccuaaugaauaucauuucccuuuugagcaucucuccuucauucauuggccauuuccauaucuucuuuggagaacgcuuuguccauuuuuuaauugugcugucuuuuuuauugaguuauaagaauucuuuauaucauguagauauggcccuuaacagauacuugauuugcacguauuucuuccauuguguagauuguguuuucacuuucuucauggugacuuuuaaagcaaaaaaaaaaaaaaaaauuuaauucugaugaaaucuaguuuaucaguucauuccuuuaucacgguauuaguuuccuauggcuacuuuaaaaaguugacaaaaacgucauagcucagaagaacgcaaauuuauuaccucaugguucuuuuuuuucuaauuuuuauuuuagguucgggggugcaugugcagguuuguuauauagguaaaguuguguuacggggauuuguuguacagauuaauuugucacucagguacuaagccuaguacccaguaguuauuuuuucugcuccucucccuccuuccacccucuaccuucaaguuggccccagugucugucguucccuucuuuguguccauguguucucuucauuuagcucccacuuaugaaugagaauaugugguauuuggcuuucuguuccuacguuaguuugguaaggauaauggccuccagcuguucccacaaaagacgugaucuucuucuuuuuuauggcugcauaguagaaaucucacagugggucucacguugagcuaaauggucuaaaaucaagguauuggcaguucuggagguuuuaggcucuaggggaagccuuuuccagguccuagaggaugccggaauuccuuggcucauggcccuccuccacuuuucaagaucuuugugauuacauuaggucuaucugaauaacccaggauaaugucucuuuuuuaaggucagcugauaagcaaucuuaauaauaaccucacuucaccuuugccauguaaaguaacauauucacacauucaaaggaguagaauguggacaucugugaggagccauuuuucugcuuacaacauugcuaaugcuuuguguuauaucuaagaaaugauugccuaacccaaggccaugaugauuugcuucugcauuuccuaauaaaaguuuugcaauuuucacuuacauugggucuaugauccauuuuugcuugugaugugaaguagugguccaauuuccuuuuuuuacauguagauauacaguuggcccagcacaauuuguugaaaaaacuucuuuccuccagugaaaugucuugguacuauugucaaaaacuacuugaccauaaauguaagggcuuauuucuggacucugaauucuauugcauuguucugaaucuguaugccaaaacugugcugccuugauuacucuuaaguuugaaaucaggaaguaucaguccuccaucuuuauuccuuuucaagauuguucagcuauucugagacuuuuuuguuuccaugugaguuuuagcaucaaguucucaauuucugcaaaaaaaaaaaaggcagcuagaauuuugauaggaauugcauugaaucugaagauuaauuguagaauauugcuguucugauauggaucuucuuaucuguaagccugagcugucuuucuguugauuuagaucaucuuuaauuucuuuggacaauguuuuguaguuuuuacuguauacauuuugcauguuuuuguuaaauguauucuuaaaauuuuuuugauguguuuggaaaugaaacuugucuuuguuuuaauuuuggauugucauugcuaauguauaaaaauccaacugauuuuugugcauuggucccauguucugcaacuuugaaaaacucauuuguuacgucuaauguuuuucaguggauuccugagaguuucuuauauauaacaucaugucaucugugaauagcaguaguuuugcuuguucuuuuccaaacuggauguuuuugguuucaugguuuuuuaugaggaaucagcagucauucacaucauuguuucccucuaugagaacauuguuuuucucugucugcuuuuaauauuuucucuaaauuuuugguuuuucgcuauuugauuaauaggugccuaaguuucucuucucuuuacuuacccuccuugauguucucugaccuugaaccuguaccuaccccaucucuugccucaucaguuguggauuccaauucugcauauguuagaccuuuuuuauuguuccacaugucccuaaggcucuguuaauuuucuuuucaaucuuuuuugucuguauucugcagauugaauaauuuccauuaauccaucuuugagauuucugacccuuuccucucucaucuccauucugugauuaggcuguacaaggcauuuuuaauuucagauacuuguauuucaguucuagaauuucuauuagcauuuuuuacauuccauaguuuuugcuaagauauuaacuccuuucguuuauuguauacauauauuccuuuacuucacugagcauaguuauacuagcuauaauaaaaucuuagucuacugauuuuaccauuauguccugguaucaucuaggaguuggucccauugauuguguuauuucuuggaguggaucacauuuuacugguuuuuguguaucaaguaauuuuugacugugugauggauaauguguguguuaggccgugaagacuggauucuguucuuucaguaggcacuuguucaaucuguaaacucuuucuuagguggcagcucaaacuucuguuuuguuuguuuguuuuguccuugccugggcugcuugcaauauucccugugugugcauuauuugggaguuggccggagauuugggcagggaaacuuaguuaaaguaacuugauugcugugagcauuuuuacuuuguucuguuguuguuguuuuaaaagaauuccuggaucuuagaauuccagguuuauuaacuggaaauaaucauaaguauuugaauuccuguuccuuauuuuaacaauuaaauuaaaaaacuuuuauauuucucuuuauuauagaucgagcugggagcauuaguacccuugauucuuuagacuuugcaagauauucagaugaugguaacagggaaacagaugaaaaaguggcaggugaguaaaauuguaaggacagauuuggauucuuugacauuccagaaauaaugaaauggcuugaggaauuuuuuuccuucuacaguuugguaugugacuauaacauauauaguuauuauacaaaguuauguuacuaauuacuaauuuacugcaaguuuggggguuccccaacuuuuucuucuugugguacugaguuucugguuauguaucccuauaauuugcuaaguuauacuuggagccagcaguuuacaaccacacaguuguaaaacuaauguaugacagguccaagacaaaguugaaccuuagccucauuccuuugauccuccaaaccagggcugauagucauauuuguguaccaauacaacucuauugauuguuaaaaauugguuuugaaccaggcauggugguucacaccuguaaucccagcuauuugcuauuugggaagcugaggugggaggauugcuugaggccaggaauuugagaccagcuugggcaacauaaugacacuuaaucucuuaaauuaaaaaaaaauaaauaagcaaauaaauaaauaaauaaaauaaaaagguuaaaauacuucugugcuuguugcuaaaacuuugccuugaguucccugagugcucaccaaccaucacagcaugucuucagaaauuucugacuuugcuaugauccaaaaaaaagaggguuaaagaggguuaaugauugguccaguaagggccuccaggacacugcccaucccaauaagaaggacaacauccuuuuuaauugcuugguugcuaauuucaaucuuccucccuucccauccccccauccucucucccauaccagucuugccuucuaggcaccaccauuggaucuguagggacuucagaggaucaguuuguacccuguguucugccuacaccagauaagccccauuggaauuugcuagggguccacuuuggaauucaccccguuagcagccuuggcuccuugaguguaaauaucugcuaccguucuggugccucaagucugugucugucugccauugaaaucauucuugagugccuugcaggaauuguaguuuucauaagacuuaggcuuugagagagauggagaaagcagacagacaucaguuggguaucuugagcuccaucaaaaugguagguacuucuggaacaaaagggaugccacaugggacacacacggucugugaaaaaaauauggggucagagaauacccauaaugugauuucuguuuugaccaacucuguugaauuuuucuuccauuuacugggacaaguuuuuuaaaacauaccaaaugcuuaacccucguggucauuaugaauaaaaaugagugcuaauucuuauauaacauuuguuccauucuaaacacuguucuaaauuuauauuaacucacugaguuauagaacuguuaucuuguuccucuccccaggauauugaggcucugagagaaauuauguaagacuuaguagcagagcuaggauucaaauccacauagcccaggaacagucuacgauugacuauuauuugcuaccucuuggcaugaaagauuagguuugaucuaauuuaaaaugucauuccaauaaaugauuuucauuccuugcucaagacuagagauauugaauauuuuaaaaucucagacaguguuauaugaguuagaaaaaaaauguaauuguuuuucugagagaagauucagcaauauaaauaauagcagaauauccauguaauggggaaaucacuagaauaguuuaauguggcucuccaugucaaaucaugguugaguuaugagcaucauuuauugacaacuguaucaaaguggcaaaucacauugguaauaucuaaaaauuuacaauucaaauuuuaggaugaauuuauccuaauuguaucacucauuaaauagcacuuguuauauauauuagcuauuuauauuauaaaauauauggcauuuuaguuuauuuagagacuauaucuaguguuguauaguuuuauuguacaaauuguuacauauuaaaaaauaacuccuacccagaaguuauccauauaauuauguuuuuuccuuuaauuuccuuauuaaaacuuauauuuuagauugaguaaaauugaagagguuuauuauuauuuucauuauuuagauauuuuaguacuucuaauuagggggaaacugacauaaacgcaaaauguuuagcauaaauuuaugaucauuaggccgggcgcuguggcucacgccuguaaucccagcacuugggaggcagaggcgggucgaucaccugaggucaggaguucgagaccagccugaccaauauggugaaaccccaucucuacuaaaaauacaaaaauuagcugggcaugguugcgugugccugcagucccagcuacucaggaggcugagacaggagaauugcuugaauccaggagguggagguugcagugagccaagauuauaccucugcacuccagccugggugacagagugagacucagucucaaaaaaaaaaaaaaaaaaaaagaucauuaauuguuugguauaaucucuauuuaugucaauauagguagaagagaagaagaaaauagaaguuccucugaccaaauuucacuguguacauaacguuuucuuucccuguguaacuuuuuauuagaaggcagaguaaaaagguucauauucucugucugaccuaaaugcuuuuugagagacaaugagcaaaggguaguggaccuggauaagccucagauuugcacaacuaggagugaaauauauuaaauaugugauaguuuuggccuguuuuuuuuuuaauuugagacuaucauaagacagcagaccuuacauuuuuaaccuauagaauauacuauuucucuuaaguuuggagaaauaaaauaaccuuuaauugcuguacugugcucauauauaaauaaaugcugugauucauguucaauaggaaaaggaggaagaagagcauauauaaucccaagagaauaucuuucagucuuuuagugcucauguaccauggcuuguuauugaaccaaauguguguguagaugaaacuuuuuuuaaaaaaauuucaauuaaucauaauuccuauuuccaaaaagauugugacucuuugcuuuuacuugaaaagccuaucaaaaggccaguaauugggaaaagauaauugucuuucaucugccauugaauuacacguaaaccucauuaacuccucaugguuuggagucuugugccugcagcucucccaggcuacuccugcaagcugguagcucugcaguucugggucgcagaagugguccuacucccacagcuccucuugacauugcucugauggagacucuguggcagcucugacccugcaguagguuucugccugggcccccaggcuucccaauacauuguuugaaaucuaggugcaggcugccaugaccccauagcucauacacucugcaugucuacagagucagcaccacaaggaagcugccaaagcuuacugcuugcacccucuggagcugcaccacaagccucacuuggaccugcuggagccauagauggaguggccaaggaguacugcaccagaaugcagggagcagaguuuugaggggacuuugagcaguaaaaccauggagggcacucugguccugccucccaaaacuacucuaccccccuagaacucugggccugugauaggagggacagccugaaagagcucugcaauggcuucaaggucuuucucccauugucuugaugucuuaccuggcuuccuucuacucauauccuuaucaaauggccacuuaccacacccuugguuuguucucugaacauacguuuucaaucuuuacauggacaggcugcagauuuuucaaaucuuuccacucuuuuaauuguaaauuccaucucccaaugauuuaauuuugaagcuucugugacuuaaaguguuagaauuucucauuugaaucuacccaaauuggcagaagcucugaaauaagcuucuguaggauaacagaauaaacugugucuguuacuaugauaugaggcaaaaagaagaagaauaaagagacaucuaagaacaaacaucuguauuauuuuccuauagcaaugcuggguagaaggagcuuguggauaacacacuaaugagucuguuuacccaccuggcaaaugaagggucuccucuaacccuuaaucagcuguuaauuuaugagacagauacuagauuuguuuucggcagcauucuuaccaccuuucuccuagauuuaaaagucugguuauuuuuucacaucugcacacauauuccuucaaagaggaagggaucucuaaaggaacaaauguuuauuaaguaccuacuucaugccaggcacuaugcuaggugcuuuauauaaaauauuuuauuuaaucuuguuaggaaugcugcaaaauaggucauuuuuagguuuauaguuucuauaagccuagaaaacuaaugcuuauaccaagguugagaaauuugcccaguagcuuccauauaguaaggggcaugaucaggauguaucacauagagguuuuauuccagagcccacaauagaucuuuuaguaccaggcuguaguucugacccaucuguauauucauguggauagcauauucuugucuuucuuauaugaaacuauuucacagagccauuuucuuagaaaaguaaaauuuuaaaaacuuuuuuagauauuuuccauuucucaauuuaguuuucauaugaagcauacauuuuuauauaaaaugauuuaaguaguagcagacaccaaaccaaugaguuuaauauaggugauuuuucauuuuaaguaaaagccuuucucuauguuauuaaacaaaacuacuguacuuagugcauauacaauguaccucuucaauuuucuaguuuuuuuaaagguaacaagagauaucuguauucuaaauaucgagauagccauuauuuaacuuauuuuaggcauuucaagcaucugcuacguguuagguacuauguguuagguuucuauguagacauacaagauagauaacguuucugcucuucaggaauuugucugaaauaugucuauaucugucauaacagauacaaguucaguacguuggaaaugguaauagagaccuuguugauuuuagaaccccccuauauuccuguuucagguucacaagauccaucuuuuagcaucagauauguucucauaucucuauuacugaauuacuucucuaguucacaccuuaacucuguuuugagaucuggagaacuagaacuaugcuuucugauuuguagggaaagacauuccugaaugcugguaagaucaguuaauguuucagauuuaucacaugucacaucaaguaucggaauguccauucauacucagcaaguauuugcugagugcccucucuauaguucaagcauuaugcuacucuuggaacaacggucaauaguacagacauaugaagccuuuaggaagcuuacauaaucuaguagacauucuaaaauggucuuuagauuuuugcuguaggaucaccugucccuguccccuggauuagaaguaggcuucucauuucuuagguaauggccuggcagcauccauauccagcuuuaucaggauuaaauaagccuauuuggcuucuaauuuuguuucucccuagguacagauaaaucuuuuccuuccuauuagcaguacauuuugauuuucuugauuuaaaccauaucuaaaucuuauuucauaauuuugucagauuuaaaauaggauaggugcuccaacaaggcuguaaagaagauaaauagcauuuugaaaauagauuucuuguuauucgucaccaugaaauuaaaauaggcucagagaggaaaaaaagaauacaucauuguggugggugguuauauuuaaucuaaaaauaaaagugauuauauguucauuaaauuuuagugggcuggagaaggaggguuuuaucuuuagauuaacauugcuaaaaguguauuucaugagaauguucauuucauagggaaaaaacaaaagugggaaaaaagaaaaagaguuucaugguuagauaaguuuagaaaaucaugguuuucuguaugauuuuucagucuuuaggguuuuagguuauuguaguaauuuauauauuaagucauaaaggucugaacuaugacaauugcagagacaguguagaugaaugguuauuucaggaguuauuaaagguuggaaucaguauggcuuaaacauuuaauuagugugagaguaagggcaaggaauaagugaauagucaucuucagguuucccauuuggccaacugggucaauaauggugccauuauuggagagacugcaggagaaccacauuugaaaggaagaugaugaaauccauagauaauauugaacuaguaauuuaugagacauucaagugggcauguccaggagauaacuggguaggucggugucuugugaaaagauuuuuuaaauuucggagucuucagaguacuugugaaacuuaaaaccaccagagugaaagucauuccagugaaguguguaaauuaagaaaaugucuaaggaugauacauggauaaacaccaacuuugagaugagugauagaggaacucaagcagaaagaacaauagugggaagaauuuuuuuuaaggcugugggaaagaggaugcuuuguucccaccaaguugaauauagaaaaacaaguaucuacaaacuauggagauugcaucuugcuuucacuuauuuauugcuaagucaugccuaacaguacuaaguuucucaagucuauaauuggcagggagaauuuucuaaaccuaguaaaggugaugauaguacugccuuaggacuuuuguauuauuuuagggacggguuuuuauucuaacucauauucuuaugaaaauugaaaagagaauuuuuucuuuucuuacaacuguucugggauacuaaaauaaguauuaaagacgggaaaguguuauuucaaaucaccuuauagucaggaaaaaaauuccagaaaauucugacuugaaagaagacaauuuuacauagcaaaauagaugacucagaccuauugauuggaacucaucaauaaugaacuagaaugggaaugaaaaaauacuucuucagaccaguguuauggaaaagaucuuuuaaaauacagcaauauuuugagugugggccaaaaagaacuaagucuagcaagcauuucaagauaauauuagugaugaauugaguuggacaacaaaguauugauauuuuauuucuacuuugaaauuucacauuccaccuuuggugucuccacauaguuguacaucucauaagucaugaaagcauaaucuuuaagcacucaagugccucuaauauacuacaguauuauccagugcaguuugagaaauaacuguuucaacuaaucuggaguugcuuauacugacuuuuaaguguuaacuauuuugguaagauuauaauaugcgauguuaauauacaucuacaucuuugcaguuauuacuuuaguucuaguaaaauuguauucagcagaguuggacuaugagccacuugguuggucauuccugcagcauuuuuaauaaacauacauauccucaaauauuuuuaggaaggauuacaauauuugaaaaauauuugcaagguuguuccgcacaaugucucucuuuacaggauaauuaauuuuuagcuuuaaucuaaugcuaauaaagaagauacauucauauaucuguaaauacaacauugcuauuaaccuuucuuuugaaacuuucucauguaacugcaauuacuugaucauauuaugccuuuauagaaauguacuauagauucaaacauacgccuuugucuuuuaaagucuauauuguauauuaagaaacaugcagcagagugaauucauauugauaaguauuaucuuuucaaaguauugguaaauucuaaugacauuuggcaauauauauguagaugugcauaaaaauauaaauucuugccgucugacauggguuuuucuggcuuucugugccuuaaucauucaguguuuuacucuuggucaccuaaacuuucaccaauugcauuuugaguuuuuucccaguuuguguuuuaaccaguuuuuuuuucuuuuuuucuuuuuuuuuuuuuuuucauauuucuaucauucuggcguagggcacuucugaucugcaauuguucuguaaugucuuagaaaauuuuaagugauaucaaaagcaugauauauauauuuauuuaagauacaguuagauauuuuuaaaucaaaaucaauugccuagaguuuuaaaauguaaaaaaaaaaaaaaaguaaaccaacaugcuguguaaaccuauucuguacuuaccuuacacacugaauguguccagucuuacuucaaugcaacucuaagaguuuccggaaguguaaauguuaaggaaaauguuuaacuuuguugcacagaaguauuugcagaucagcauugcugacuaccaaaaaacauaaaguaacauacgaugucaucugauuuuuaguggugcuuccauguugcugcaguuaaauucugugcaucaaaauaauuggccuuuguguacuagaugugauucaauuacaucuuguuuuuauugaaaaugugcaaacugagugaauccuaauuuuuccauauauuuuuauagcuguggcucugauaacaucucauuuggcaucuuuuuuauguguauuagucaguuaggaaaaaauugcaucuuuaagaugaaaccuucaguuccaguuuuuaugcagaaugauuuaacuacuguaauuucuuaauauucauuuguggcaaagaucacuuaauuuucccagagcuuuacuucucagaaauauauuuuuucucaagucuaacauuuuaaagagcuuauuaaaauguuuccucaauauucauauuuaugucauaaucacacucugugauaauaggagaaauccugaguuucacuaguaccucuuaacaugaacaaaucuauuagaagaguuaucagaaacuuugaaauucuacuuaauccuacucaguauccuuagaaaacuauacuuuuagaaauguacacauucauuugcuauagaauuaucuuaauuaggaauuaaaagugaaacuguuucuauccuguggcucuaaaugaaaaauaaaacccuugggguuuuggauuuuuuuuuuuuuuuuuugauauguguuugauguaucuguguuuguuuuuagaaaacauacucuuguuuguagaaaaauguauaggcaucacgacauuuguuaaauauugaaaccauauuccuucaacauccuaaugaagggaacuauucacuaacgucucuauacguugauuuauaacauuauucuagauaaugcauuuuaaguuaacuuuuguaaaaaaaaaauccuaaguuuuucuuuuuaagaauauuugcuugggcuucaucuaauuuuuaccuuauccccugaaauuaugucaccugcacacauccauuacauuucuuaccuagacugaauaaagcagaaguacccagauuauuaauauuuuuauuuaucuaaaugagaguaugccauagauuuuauuuuuaaauagagcuauuccuugucagacagcuagaacauuugauaauaacccccugaauucuacuaaaacuauggaaaacauucaccaguuugcuugcaaaucaacucugcugcaugcguucacaaguuucauaaagauugcaugcuuucuguuuucaauacaaauuguauuuuuuuuucauacccauccuugcuuuuuauuuuuuaauuuuuguuucccuuuucuugguuggaugccuguguguguuuauuccaaaucccuguccaguccuggaguuugaacuacggaaagccaaggagaccauucaggcccuccgagccaaccugacaaaggccgcaggugguguacauaaaacuuuuuugagacuuuucaacuuugacaauguagaaguagcugagauauuuuaaaauguaaaauaguaaaauaguacuuauguuuuuuuccaccagaacaugaaguuccuuuacaggaacgaaaaaauuacaaaucaaguccugaaauucaggugggugacagaagacaaauguaaaauuaaucuuccacauuaaaugguaacauaaauauugaaggaggaauacuuaugauuuccuguuugccucuuauuuugcuuccaggagccaaucaaaccucuugaaaagagagcucuaaacuucuuagucaaugaauuuuuauugaagaauaacuauaagcuuacaucaauaaccuuuucagaugaaaacgaugaucagguaaaguuacuuuuuguuuuuacagugauuuuuuucuacacuuauaauucacuuuuucuuuuacguaguuucuuuuuuuuuuuuuuuaaguuauauauauaguaaaauucuacaaggcuaguuacuagaacagcagucucuugccugaagcuaauucuauuagcuuacagacuuuauucuuucccuguugcuuucuacauaaagacuuuucauucuuucuagauuccuuuuuacuacuccucagugacuauauaguccacucauuuuugcauauauucauaaaguaugcuuuuuaaagacauacuuuauaguauagguucuuguguacuuauaaauccaguuuaacuauaaaccucuucaauuccacuguaacaauuaagauguuagauaaauauaugacaguauuuaagagaguauauuguaaaugagagugagaaaaucagcuguaucucucugaauaggggccaauuuuagaacuuuauuauuauuuuccugauaaaaucucuuuaagcaaaaaagaugucuuauuuuagugucaucucucaaauggaauauuuugacuucuuagugcuaauggauugguuugaaucuuacaccuuaaaaaaguaaaugccagugaauuuauuauuuaggaaucugaaggccaucauuuuaaaucaagauuauucuguugguucauaaaaucuccuauagauccuuuagcaaaaauagaaauuuucugaguaagauaguucaguuaaccccucaguuauuagaauauauuuggcaaaauuaaaugcaauaaguaucuaguuauuuuuuauucaaugguagugucacugaacaugugcuauguaagagacauuaaacuaauauuuaacaugaguauuauacaaugcuauacuaugguuauaguuuagguuaaucauguuuuuuaaaugaucgacuaaacagugaauaggaaagauuuugaauaugugagaaacauugagaggucaaaaagaacacagaaaaagaggaaaagaggagcaaaaaauagauggaauacauagaaaacagauaauaaaaugguuagauuaaaaccuagcucuaucaguauucacuguaaguguaaaugauuaguccuucucgaauaaaaaucagaaauuagagaugucaacaaugcucucucaauaauuaauagaacaagucaacagaaaaucuuuuaggauauagaaggcuugugcuauguuaucaaccaaugggcauaauuacaauuuuauaaaaaugcuucauccuucaacagugaauacauacucuuuaaauucaaaugguucacuuacaaaguuagaccauauuauggguuauaaaacaagucuuaagauggugaaauuaacuagcaauuaguaacaaaguuauuuccaaauaacgcaugaguuaaaaaagaaaagggaaauuaugaaguauuuugaacugagugaagaugaaaacaaaacauaucaaaauuugugggauauaacuaaaauagcacuuagagggaaauucauagcacuaaaugucuauacaaggaaagaaaaaaauucaaaucagugaaaucaggcucugccuuaagaaacuaaaaaaagaaaaccaagugaaacccaaaguaaguagaagaaaggaaaugauaaagaugauagcauaagucaaugacacaggcagcagaaaacaauagagaaaaauuaaugaaacaaacaaguaguccuuugagaagaucaguaaaauugauaaaccucuagccuaacugauuaggaaaaagagagaagauacaaauaaccaaaaucaacaaugagcaagguuacaucacuacagauuuuacuuauauuagaagaauaauaaaagaauguuaugaauaacuuuucuuguaagaagacaacugccaaagcacacucaagaagaaauagauuauuugaagggcuuuauauuuauuaaagaaauaaaauuuguacuuaaaaauacuacuaccaagaaaacuccaggucuggauggcuucacuugcaaauuugaccaaacauuggaggaagaaguaauacaaacucuucuagaaauuaaagauaagggaauacuuccaaacucauucaaugagaccagcauacuucugauaucaaaaccagacaaagacacugcaaacaaauaaaauuacaggcucauuuccuuuauuaauauagauauagaaauuauacauaacauuuuagcaaaucaaauuaaacagaauguuaaaaggacaauucauuaugaccaaaugagguuuaucucaggaauauaagguugaguucauauccaaaaaucagucauuguaauugaucauauuaaaaagaaaaucaaauaaucaucugagaagaugcagaaaaggcauuugacucaauccaacauccauucucuuuuaaaacuuuaaagaaauuagaaauagagagucauuuccccaacugauagaggacauuuauagaaaaccuaucacuaacaucauucuuuuucuuuuuuuuuauuauuauacuuuaaguucuaggguacaugugcacaacgugcagguuugauacauagguauacaugugccauguugguuugcugcacccaucaccucgucauuuacauuaggcauuucuccuaacgcuaucccucccccagccccucaugccccaacaggcccuggugugugauguuccucaccauguguccaagugaucuaauuguucaauucccaccugugaaugagaacaugcagugcuugguuuucuguccuugugauaguuugcugagaaugaugguuuccagcuucauccaugucccugcaaaggacaugaacucaucuuuuuuacggcugcauaguaucccacacuaacaucauucuuaaugaugaaagaugaagauggaaacaagaacauuuauucucacuacuucuauucagcaucauacugaagauucuagcuagugcaauaaggcaagaaaaaguaauucaagcacacauuuuggaaaggaagaaauaacaguccuuauucaccaaugacaugaucauguguauagaaaauccuauagacucuccaaaaacgguacaaaaacuaagugauuuuagcaagguuguaggaaacaagguaaguauacaaaaaccuaucauauguuagcaacaaccaauuggaaaucaaauuuuuaaaauaucauguucaauaguauuaaaaaauaggaaauaacuuaggaauaaaucugacagcuucuacacugaaagcuacuuaacauugagauaaauuaaagagauuuaaaugaagagauauugugcucauggaucagaagacccaauauugucaagguaacaauuuugauuuguauuuucaaugaaaucuaaaucucacuucuuacuggcauuuuuguggaaaguaaugauuuuuuucuaaaauucauaugaaaaggaaacagccaaaacaacuuuaauaaagaagaacaaauuuggaggaccuaaacuaccuggcuucaagucuuaaaagauauuauaguaaagauauuauuugucauauuuguauauagacaaauaaauugaugaaacagaauagaauccagagauggacuuccacauagaugaucuguugaauucugacaaaaugcaaaauaccuuccaugcagaaaggguagucuuuuuuuuacaaaugguaauggaaccauuugccuaaacaaaauaaacaucaaaccauaccauauacaaaaauuaacucaaaauggagcauauacuuaaauauagauccuaaaaagcuguaaggcuucuagaggaaaacaggaaaaaaaaaaucacugcaggcuuggaagauaggcaaaacauuuauuagauaugacacaaaaagcaugauguucucugucagauuugcucucaucaaaauuaauaacuucugcuguuuggaagccacuuuuaagugaaugagaagaccgagagggugaaaauauugcaaguaacauaucuaauaaaggaguuauauccaaaauuuauaaagagcucucuaaacuuaauaauagaaaauuaaucuauuuuuuaaaagaaugcacaaaaauuuuaaacaggugcuucacuaaggaaguuauauggauggaaaauaagcacgugaaaaagauucucaacauuuguauucauuagagaaaugcaaauucaaucacauugagauaccacaacacguuaauuagaauguuuaccuaugaaguuuuggcaaggauauggagcaacuagaaauuauuucuaguucuaagcucaagguagauacaucuuaaauuuugguugaaugauagauagauggacauuugaauuauguguaauguucauuuaauaaguuuuuuuuuuuuaaguuaaaaguuguuuaguucuugugggccaagcacuguguuaaggcuuuuauauacauuuaauuuauccuuacaaaaacccuaagagauaauaaauauuuuacucauuuuacagaugaccaguuuaagccucccucaaauuaauuuguaacagugauaguggagaaagauacaaauuucauacuuccucugguuuucucuaaagcccccacuuguaauacucauaucuaccucgauuuaguccucaauaauagcuaucucaucauucaaauaaaccgucaaaggauuaagaauaucacauuuagaauguucaaauuaauaugccaauuucuuagagguucucauagguuauaaucuaucaaauuaguacuaaauuaugauauauuaaaggaagauagaauggugagacaguguauuuacgugcaauugauuacucagcaauuuuaugaagcucuucuaaagaucuuucucuacagaaugcuuaaguugcugugcuuuuuuguacuuuuaauaaaacuguugcaguuaauaaaacuguugaacacguuuuaauacacaacaaauugaagaguagcuauuuggauucugaaaauugccagaaguauuuguaauaauaugaauuauauucaaacauuuacagcaagaagacaugcagauuaaauuguuucccuacccauuagagauuacacuaauauguauuaaguuggaguaauaaaagaagaacaaaauuaaugauuugaguuuacuuauaaccuauaaauaauagguacaauuuauguacugagacuuccuuaaucuaaacauguuuuaugaugucaugcaaauauuugagcauguuuuaugagcuuaaaguuaauauaaaacaaaguaaagagaguuuauauuuuuaagagauauaauaaaaaaauuguguaacauuuugauaccuaagacaauuaaaccuauugaucuagaaggucaggaaacuuacaagaauaauauuggauacuggaaaguguaaaauaaauguaagaauguuauuuacuaacuuggaacauacacuuugauauuauaacaaaauuaugauuauguuggguuuucaauauauucacagaggcuggcugugguggcucacaccuguaaucucaacacuuugggaggccaaggugggaggauugcuuaaagccagguguuugagaccauccuaggcaacaaagcaagaccccaucucuacaaaaaaaaauuuuuuuugauugguucggcacaguggcgggugcuuguaguuccagcuacuugggaggcugaggugggaggcucgcuucagcccaggaguuugaggcuacagugagccaucuaugauugugccacuguacuccagccugcaugacacagcaaaaccgaucuuaaaaaaaaaaaagauauuagcaauaauaugaauuucaaaaauguaagauaaaauuuccucgaagauuuuuuauguuuuuuuuuuaucuuuuaggauuuugaauuaugggaugauguaggauuaaacauuccaaaaccuccagacuuauugcaacucuaccgggauuuuggaaaucaucaaguaacuggaaaagaucuuguagauguggccaguggaguagaagaagaugaauuagaggcccuuacaccaauuauaagcaaccuuccuccaacucuugaaacuccccagccugcagaggugagagauagcaacuaauuagucaaguccacagaaaguauuuaaacuauguaaaagcguacagugagaucuugaguuucuguuuuucuccuguuuugauuuuagaacuccauguuaguacagaaauuagaagauaaaauuaguuuguuaaauagugagaaauggucauugauggagcaaaucagaagacuuaaaagguuaguacuugaucauuauuccuaaaaauccucuuaagguguuuaaaaguauuggcaaguuaugcaaauauaugaaacaauauuccaguugcaaggcauaauugcuucacauuuuaauacuucugaaagaaaguuuuguaauuguuuaauguauuuaaaauaguaauagguuuuuuuucccaaaacaaguuacuaaaucaauauggugaucuuacaaucaauuaugucuuggaacuaagaaauaagauauuuugauuucucccucauauuaguguuguacauauuuccuguucauuauuccauuuaguucuuguaauaauccuguggguuugaggaaguuaucccacuuugcaaaugaauaaaagaaauuuaagugccaaucaaaagcaggguuuuuaaggccauuuuuaugcuucauucuugaguuuauagcuacaguuuuagguauaugaagcaucagugaauauugcauaaaaaagauuuauuacuugccaaucauuugcuacuaauacuuuuaaauaugcuuuuaaaacauuaaacccauuaugagauuuaugcuaguuuucaaaaauacaguuguccucuggugauuucucuuaauuucucuuucuacagugaaauggacuuccucaaaaaugaacacuuugccaucccagcaguuugugacucuguucagccuccuuuggaucaguugccccacaaagacucugaggacaguggacagcauccagauguaaauaguucagacaagggaaaaaacacagacauccaucuuucaauaucagaugaagcugauuccacuauuccuaaagagaauuccccaaauucauuccccaggagagaaagagaaggaaugccaccuucuucucuaucaaguaaaaagacaguucauuuugauaaaccuaauagguuaguaugcauccuauauuuugaaaugcaucuuucagcuauuuaguacaugucaaacgggaagagcuacuguuuuuauuuaaaccgcuuuuuugcagaucaaauauauuaauuuuuauauuugacaugaacuuaacacauagcaaaguaguugucacaaaaaagucacaaaauuauuaguuacuaaauuaaauuaaaucaaaaaggaauuacccaucaaugagcuagguucuaucuuagcuaaguauuuaaacccauaacuaauauguuauuacuaugugcuguaaacacuuacccagugcuuuuuucucuauccuuuagucguuaucagacucagaggaauauuuugaugcugcguaguugccuauguuaaagaaggaauaauuuuugcuccuacuuuuuuuuuccugugucugcuuccauuacaaauauuacaucauuaguauucuguuaauucauauguuuaauuuauauugggugucagaacucgcagaugacaaaaaccauggucccugcacuuugugauuauguuuccuaguggaggggacaaaaauauaauuuuaaaacuuuuagauuaugauuaaaaaauacuuuuaagaaaggaauauuacugagcucuuuuuauaugucagacagaauccucaaugcuuuauguauacuaacucauuuaauucuuacaaauauccuauggugcauuuucagccacaaggucauacuucguuuccuauuaaauagagagauguuaugccuacuaugagcauauaauagaaaagcacaacuaauuugcuucagacuuauagguucccauuauuacuaagaaguauuggauuuuuauuuaaauaaagcuuuccacucaugaaccacagcuucuucuguguauaguaggggugugugugugugugugugugugugugugugugugucugucugucugucugucuguguuggucacagaacugaaacagacauggcccaaaccucaaaccuuauaguaugagagagacagacaagcaauaacacuaagguaugaaaaguaguauaauaaaauaaguccaacuugcuuugggaacauguaaucaaggcacuaaccuagucuucagagcaggaaaguuucauagaagugucauccaagacuugaagacuauguaagaguuaacaagcaaagagguaaaagaaagaguguucccacaugcacaaaugaaacagugcuuuaggggaacaaagaaggguuuagugaggcuuaagcaaauaaugcuagugaaaggaaggauagaagacaaaguuggagaaguaagcaaagucuaagaagucauguaagcuugcguuaauucauuuuagagguugggacaugaugguaucuaagcuuuagaaaggguccucugagcuagagguaauuggaagguagcaagacugggagcaaggaaacuauacggguauauguuggaagaacccaaguaagaaaugauggaggccuguucuauauucagacauugguaaugggaagggaaagaaguauauggaucugcaagauuauuagaaguuaaaagauugaauggauuuggggugaagauaaagggaaggaagccagggacgaugggaugugccucuaaucccagcuacucaggaggcugagauggaaggaucgcuugagcccaggaguucuagaccagcaugggcaauacagcaagaccccaucucaaaaaaaaggaucaagccugauuugagguuucugacuugggcaaguggaaggauuauggucccccucugagggaauaugagaggagcauaaaacagcaaaaggcucaagcuuugauacaguacucuauaaucauagaaauuacugagcuccauuuugugguguauacuaaauaagcuuuauuaucuaauuuuugguguuagccuuuucuuugcagauuuaagacauaaaguacaacucauagucauaauuuuaugaauaauacuacauagagacugguguuguuuuagaaauauaaauguuuuaaccuccuuuauuaaacauaaauaggcuaauauuuucaacugcaaacagaaacuuucuuuaaaauguaucaugaauauugaaugagcugugccuccguuuaucuuuagacuuauuguuugugguuuucuaauauucagauuuaucauuagcauuauauauaucugcaaagcuuuaauuccucucagcaauauaccaggucaaccuuuauccacuuuaccuuuguguuuaccuuucugggaccauagagaauugggguuggagaaaguccucauuucagauuuucaaaucauuucuauaggcauugaucuacuauaccacuuuagguuugauccacuaacuauaaaugccauuuuuucacauaacaucaaacuacugcaagaacaccaguuacuguugauuuuuuuucuccuaagugaccuguauaaguuucuccagugaaguguucuucaagucacugguggcucagaaaucugguuagcuuugugggguaggauuaaugcuggaauggaaguuauaauacauaacuuaaauuucuccuuaaaugucaaugguaauuauuugauauugucucuuuuucauacauuuucuucuaggaaauugucuccugcauuccaucaagcacuacucucuuuuugucgaaugucagcagauagucguuuaggauacgagguaaauuauaccaccuauuuccacaacuuuuuaaaaacauucuacuguuuuucuucuuuuuaaguuucucuucuacagaagcaucugugauaagacuguauuucaaaugcaaauccauuauguaaaauaaugcucuaagauauaguuccuaaaauuuuaaacuuuuaaggaaaguaguugauuauuucuguuuuuucuauuaacauuuuauuaacguuaaagugacauuuuauaaacucuauuuuuaauaguauguuuaaugacagcaucucuuagauauaauucagaaaaccaacuuaaguguacacuguuuauauauuaauuguuuauuuaaauuacucuauuauuuucauuucauuaggagugguuauguccaauaguugaguuuauuagcuugcauauuagauuuucucaacuauuuuguauuuauuuuugcagauuagucuugaggggguauuuuauuauuacuguuuuuucuuaccuguguacucacuccuccuuuucuugcuguucuguguuucauuucacuugacuugccaugggcuucuguuccacaaugucauugagaauaucacagagcuagauagaggaugguuuggaugcacucuggcaauccucauuauaagacuggaucaccuuccuuagccuaccccuuguauuuccaaguucuuuguacagauuaucacuguagcuaaugguaguagcuuugugagcaucucuucaaagacaaaaacgaacauugaggcugcccuacuccugugcuauuaccccuacuuguucccagaaaugaagccuauuaggccuccuuggcuucacccuugauuuuaaugguauuuuaaaucuguuucuagcccaaagaaauauggauguugauuggagcacuguugcuguuguugcugcugcugcugcuguuguuguuguuguuguuguuguuaucauaaguuaaaauauuggaauguguguuuagggcagagguaucagggccuaaagaaugaacuuuuccauauuauuaugcacagaaguucuccacuaucauuguuuauuaauucuuugguuuucuaggugucucguauugcagacagugaaaaaagcguuauguuaaugcugggacgcugccugccacacauuguucccaaugugcuauuggcaaagagagagguaagacacaugaaaguauuuucgucccaguaaucccaucauguuguccauuuuuugucauuuugaaguugaguguuauauuuuuauuuuguuaaagucuauuacuugcaaucauauucuuacuuuugugcaugcaucucugcuccuagagaaugguuuuacaccucugucaggugaguucaguaaaacugcaugguauucauguuuuuccaauuuugcuuaaagcauuguuagcuucugcagcacuaacuauuacuguagguccauuuaugugccaugaacacugucugguuuuuacauuaccaguuaacuaauuaucugugcucuugguaugauaugcuucauaugucaacagaaauggacacucuuuguauugaaaauuaacagggaugaauaauauaaaacuagucaggaggaauaauauaacacuagucauaaauguacuuguaguugccgauuauaaauguguuauuaugcuuguuuggcaauaaaucacauuucucuuauaauaggauaguuguaauauugacuacaacaacuuuuuaaaguaccuuuuuuauuuuucuugcaguuaaccgguuauugacagaugcuuuaaguauccaaaauacauuugcaaauauauuugacuccacauagccuauguuaugauccauaaacacuauaggaaguuaucuuuauuguuguuauuuauaaauuauuauuaaauauaguuauauuuagucaaaagauuaaugggaaguuauuuauaaucucauuuaaaugacaguggauguuugcagauaauuuaaauuauuuuauugaacucuuugagauaaaauuuuuagaucaaaaaaauuuuauaaagaauaaaugaagacaauuuuagagugugucauguaacuuucuauuguuaucuucuuaauauuuaccacugauucaaucauaauuucugggaccuacaguaugauagguacauaaugcauuggcaaaacccauuuaaagcuuauuuucaauuauccauuuagcacaagaaauuuguacugauccucaagaaaacauguagagcuuuaaaauuuuuuauccccauagguauuuuuaauaaaaacaauuaaaaagaugguuuuccacugauggcuuuauuuuuaccuaauuauuuuaaaauagucauaagauauuaauaaguauggaaagucuuauaugucuugaaggaucaguguccaauuucagauuguuuugcaguucugcuuggcagaaugguguuugagcuucuuuuccuuuuuuagcuuguaacauaauccauguaaugcauuaauguuugcaucccuuuuacuguauuuccuuaauaucaucuuuagaguguuacagaaaccuaauuauuaugaaauucaguuuuagcuuuuuuauuuuaauuuuucauauuaucauaaaagacuaccauuaaaaugauuguacugcaugaaauauuuauaaauuugcaucaucaguaaucagauacauuauacauacagauuaucuaccuauaugcacacauauaacuaauuugugguaugauguuuacuuuucuggcugauuuuaaauuuuuuauaauuaaaaaauauauauuucaugaaaaacugaucaucuaucuuuguucauuuaauuauuuguauguuuuaucagaaaaguugccauuuauaauaaaaugaaauuguauuuccucaaaauuaaauugguaaauaaugaauuaugucuuagagugauuuaaaaucaaucccugggcauaacagaacaaaacauuuuuucguuacaucucuugauauugaauuacuuuuuaauauuucacccguuucuuauuauaaaucuauacauaucucucccucuauggggagacagagagaguuguugguuuuuuguuuuguuuuguuuuuuggguuuuuuuuuuuauuugaggcagguucucacacugucacucaggcuggaguacaguggcacagucauggcucgcuacagccucaaacuccagggcuuaagcauuaaaucuacauuuuuauaaaacuccugugauugaaggauuaauauuuugacuucuuauuucucaaguuugauauauauucucuugucagcaaaagccuuuuuauugguauuuaaauaaaauuuaaauguucuuuaguaaacugaacuuaguaauaucuuagcugauuaaauaaagcauuggaaacaggguuuaauguuuugauuaauauguuuacaugguguaauuuuuuuaauguaaaaaaaauguacaaugaaaauuccuuuauuccuguccuugagcuucugucacaugcagucaguuuugcuagcuucuagaguauucuuucaaguccuuugaccauuuuuaaauuugauuguuuaucuucauguuuuugaguuguaagaguuuuuuuauauauucuggguaguaaacccuuaucauauauaugauuugcaaauauuuucuuucauccuguagguuuucuuuuuacacucuugaccauauccuuugaugggcaaauguuuuccauuuuuaugaaaucugauuuaucuauuuuuuuguuguguuguuugugcucuaaguaucaauuuuaagaaaccauugccaagucaaucaauguuauagaagauauauauaucuauauguauaugaauauauauaagagcuaaagcuaugaaacaauuagaagaaaacauuuguuauauauauuuaggucaacgauucauuuugaguuaauuuuuauauauggaguaaaacagcgucuaacuuuauucuuuucauauggcuauccaguuauccagaaacauuuguucaagauaaaaaaauuccucuuuugaauagucuugcuacuuuugucaaaaaucaguugggccuagauucuucggguuuauuucuggacuuucaguucuguuccauuggucuguaugucuagccauaugccacuaccacacuguuuugauaacuguuguuuguaguaaguuuugaaauugggauauaugaguccucuaacugcacaucacuauugucuguucagggucccuugcaguuccgcaugaauuugaugcucagccuuucacuucugcaaaacaggucauugaaauuuuuauagagauuacauuaaaucuguagaucucuuugggaguauugucauccuaacaacauuaaguuuuccaguucauggacauggaaugucuuuuuguuuuagaucuuuaauuucuuucaguaauauuuuguaauuuuuaguauacaauucuuucacuucuuuggcuaaauuuauuccuagguauuuuguucucuuggaugguauuguaaauggaauuguucuuuuaguuuucuuuucaagaagggaaagguuuauccugguuaucaaaacaacacuggucauuguguguugaucuuaaaucuugcaacuuugcugcauuugcuuauuaacucuaaucauuuuuuauggguucuaugagauuuucuacauauauagaaucaugucaucugcacguagagagauaguuuugcuucuucuuuacaauauagauggcuuuuauuuuuuccucuugcuuaauugcucuggcuaggauuuccaauacaauuuggaugguaauguuuugagaaagcaauauccuugccuuguuucugaucuuacaggaaagcuucaaucuuucaccauugacuaugauguuugcuauagaauuuuuauaaaugcccuuugucauauuaaagaaguuuccuuuuaucccuaguuugcuaaauauucuuaucauaaaauggcauugaauuugccacaugcuuuuucugcaucuguugagaugauaaugcgauuuuuccccuuucguucuacugucauaugccugcauuauuuauacauugccugauuuuauguuaaaccacccuugcauucaugagauacaucccauuuggccuugguuuauaaaccuucuaaugugcuuuuggaucugucguuaguauuuuguuaaguauuuuuuugucuauauucauaagggauacuguucugugguuuucuuaucuuguguuuugguauuugguauugguuuugguauugggcuaaggcuggcuugauaggguauaggaacucuucagucuguuuccuuguuauaagucuguugggauuuucuacuuaaucaguuuggugauuucuaugauucuaggaauuaguucauuucaucuugauuaucugauuuguugaugaacaguuguucauaguauuaacuuauaucuuuuaauuucuguaacaucgguacuaacauccuugcuuucauuucugauccuaguuauuugcaucuucucucuuuuucagucagucuagcuaaacguuugucaauuuuguuucucuuuucaaaaaccaacuuuuguuuuguuaauucucuuuauuguuuuucuagucuauguuucauuuaucucuguaaucuuuauuauuucuuuccuucugcuggccuuggguuuaguuugaucuuucuguaguuccauaagauauugaauuacugacuugagaucuuuuuuaauguagguauuuauagcuauaaauuucccucugaguacugcuuuugcuguaucucauuaguuuugguauguuguuuucauuuucauucaucucaauguuuucucauuaauucuugauuucuuccuugaccuauugcuuauuuaagagcauguuguuuaauagccacauauuugugaauguuccauuuuucuuguguuacugauucuuaauuucauucuguuguagucagagaaauauuuuauaugacuuugaucuuuuaaauuuacuaagaauuaccuaugccuaacuuauggucuguccuggagaacguucugugugcauuugagaagaauauauauucugcugauguuaaguggaguguucuguauaauuuuauuagauuuaguuguuuuauaaaguuuggguucucuauuuccuuauugaucuucugucuagaauuucuguacaguaugaaaguaggguauugaagacuccaacuauuauuguagaacugucuuauauuccuucggagauacuuugugcauguauaaauucaaauaugugaucuuuuccccaugauuuaaacaaaugauacuguauucuaugcacuacucucuacuuugcuguuuuuauacuuaacauuagauuuuacuuuuuauaucaugauauaaagaacuuucuauuaguguuuucaaacuuugacuacaccuucaguaaaaaagauguuuuacaucaugugccaguauguacuuacauauauaaaauuaaaaguuuuacaaaacauaaaguaaagacaagcaauaccaaacaugauuuuauaaauauuuuggaaaaauaaagaaaaaaauccuuaaguaagcaauuaaaaaagaaaaacaugcuguucaugacccauucaacugauuuugugacccacuguuuuaaagauaguaggauaaagguuuaaucagagcugucuaauaaauuaacuuuuuuaaauagaaagcacgaugaauauagauauuagcauuauuuguuuuucuuuaaaacaagaaaaagaaaaaaguaacaacuuuacucaaucuucagguuacaauuauaauauuuuuuaauucagugcaucuuauuuuaaaucuaagaugcaauugguuguaacaguuauguuucuuuaagaaagaaaaagaaucccaauugaauuauggcgugcuaucuaucauaagauacacccauauuucaaagauacuaaaaaguuuaacagaaauauguaccucuuagguucuuugaaauaaugguagucucuuuuuacuaacuuauauuuuaaagucaaauauuuaucucugcuguaaucuuuauuauuuccuuccuucuacuggccuuggguuuaguugauccuucuguaguuccuugccuguucauuuugggagagaaaaguaaaagauggacugauuuuuuauauguggcuuacauaguaguucauuuuaauggauugguucaggaaacuugaaucuuuugagccaaauuauagaaauaaauauauuugucauuugauaaauguauauaguaaauaagcuaaaguaguugguuuuucacaauuucugcuuugaccgcauuugaagaggaaauucuauaauuaaaaaauagaauuuuuuaaaagauuacuucaaguagcauuuuugguaaucauacaucaaaauguaacuuucaguuucauucugugccaaggaaauauguucuaucagcuagcuaaguuggaauaucaaaggagaaaucuggggcugagaugggaguggaaaugaggagagacuuaauggagaccagcuuuccuuuugggauauuggaagucuucuaaaauuauauuguaacaaugguuguacaacucugaaugugcuaaaaaccacugaauagacaauugaaauggauggacuuuaugaagaugaaacauaucucaauaaaaccgucauuaaaaaggcaaaggagaaaaccacuuaucucaguaaagcuguaacaaaaaaggcaaaggaaagaaccaauucccuaaaaguuuuuaaaguaguugguaccucuacagaccucccgucuuaugagaaacuagacuuugaucuuuuacauugccacucauguuuccuucauggaaaccuuacaaguaaugaucgccucagaggaucauaacucuaugagauguauacaguaguauaguggauaaguguaauaaaguagauaggaaguuuugacucccuucuuuaaaccuaugugauguuggcaugugugcauauuuaauuuugugaguacaucacauuucuuuagcaauagugagacuugagguaagguuauuuagguacuuuagguuuccuaaagauugagcccuggaaauuauagauauuuaauauuaauaauucuaagaaucgguauuuuuagcagcccuugaauuguaaaacuuuuacagaggugaguaaucuuuuuuuuuuuuucuuaugugagucuuuguaaugucuuucuuuauuggguuuccuuuuuauaugaacaggaacaagcugaaaaguuucaacugaaaaguuaaaucagagguuguacacuaucuacagaccaacaaaggcucacagauagguuuguuuggccuauucaguaaugguaaaaaugaugugcuaguuaucaaacuuuuaaaaacugauauuuuaccuaaaaauacaaaauuuuggcuuuuuuugaaaacuccuagucuggaguuuuccuccagucuaagagcacuagacuuacauuuccaaaugaucuuuucaauuggagcacaguuccggucuguccccuguaggugggacaugggaucucuaguuagccacaguugcugccauacuuuuuugccccuagucacuaaagccccguguuagugcuguuuaucaucauguuugcauuauuguuuuccuuauacccuuuguuuuacauguuuacguuaccuucuugacccuccuugucuuguacugauaagccuuuuguuuagguuccuccacgccuucugugcuauguauuaaauuuuauacacuuguaucuucgcuuaucaguacccuaauuuucacauuauauccaaauguaauauauauuuggauauaaauauauuuggauauaauguaaugugacaauuaggguacugauaagccaagauacaaguguaucuuguaucuugacacuaguaaguaaaauaaugucacauuauauuuggauauaaucuaaauaaaaauccaaauaaaauaauaaguaaauaugauaucacauuauauuuguauauaaucuugacaaguagaguacugauaagccaaggauaucuuagcugcuuuggaacagauauuuuuauauugcuuauugucuuuccuuccuucuucagucguuucuacuccauccccaauuguuuucagcauauguucuuuccuuuggauugugcaaaagaauuaucuugauuuauuuaaauauggauauuaaauauugaaauuuaaauuucaaaagauuaccauugacucaaagaaaaccauuuucuuuuuuuuuucuuuuucuuuuuuuuuuuggugacagggucucacucugucacccaggcuggaguacaguggcacaaucacagcucacugcagccuugaccuucuggccucaauagauccuccuaccucagccucccaagcaacugcgacuacaggugcacaccaccacgcccagcuaauuuuuguauuuuugguagagauaggguuucgccaucuugcccaggcugguuucgaaugcuaauccucuucuauuaaugaauucuaaaaguccuagaaauucugcaguaggauuauuauacugauuuuucucuuuaaugaucauagacacucuguuaaauauuucacuucaauacacauuacugaguacucucuagguugccaaaucauguuuuaaaauauuuuccuauugcuuaaaauauggcuauauuagcugggcacaguggcacauaguuccugcuacuaaggaggcugaggcaggaggaucuuguggaguucuaaauaaggagggggaguugggcuggcgagacugagggaaagcaaaaaaagaaaguggauaagcuguaagucugccuuucuuuaugguccaggacacauagcccuccugugcaaauaacucacaaucuuccugugcaaagcuaucaccagacaccucagcuaauagaaaaaugcaaguuagcuuacugcaaccuuagcuuuaucaguacugcacaaagcccucuucagcacacagcaugagcaccagcaacucuuugucuccuugcaguuagcuccucucuugcugaccugcccuuugcuuucuugcaauguauuuuccuacuuugucuaauaaaucugccuuucuuuacccacaacugucuuggcaaauuauuuuuaccacucagagcaacaccagccccagauagucacugcccacaacagaucucuugagcccaggaguuuggggcaguagugugcuaugaucacgccuguaaauagccaauugccuucaagccugggcaauauaacaagacccagucucuuaauaaaaagaaagaaaugcaaacacauaaguuuuauuaugugaagcaaaaaaaauaccucuuggaucuaauauuacccaagccauaguuauuuucuuaccauaguuauuauuuuaauauuacaugaaauguuaaaucuaauaugccuaaggauuuuuuuauugcucuauuauucugauuuacauuuagucuuucaaagauauuuuuagaacaccuugucuucugauggaaauuuaaucaccauuuuuuaaaugcuguauucagaauuauaaggaaaguuuuaagacuauacuuuuucagugugagagaugaugccaaagggagaauauugauucaagucuauuaacuuaugaauagucugaaaaugguaaauacagacuuaguaaauucugguguggauuuauuaguguuucagaggcuugaaagaugaauucacaauaaaugugaauaaauaacacaacagacauauacuuacagaaucuauuuuuuauuuuaauagcaauacaaauagaaguuauaaauaaauggauaauugagaaauuagcauauuugggggcagucucaaucuagcaauuauccuaaucguguuccuugcuggcucugucagaaacagaccacucucugcauuuuucuuccucacuuacuggaccucuucucagcucuguguugcuguaagaggaagaagccauccggcauccuuuaaacucugaguuguaacugccauagccauaauaugccaagguggaccacucuccuuggcauggaauagcaaccaaaaauuauuggcagugacuucccauauguuguuaauuugccagcaagaaauaaaagcugauggcaauaucaauuauuacugugauuaagaaaagugaaaaauauuuuuuucaaaguccuaaauucacagaaauuuaggguucaaggagacaaggacucacaaauacuuuccuucuaauaugucaguuugaauugauucauagcaacugcuguguugaaacggcuuuuuuaggccaucuuugcuuucagaaggaaaaauuagcagcaauagauaaauugcagaauguaugugaaguguuuuccauuugugcauuaaucuuaauuccuacguguuucacuugaagaaacugaaagagaaguuugugcuuuucuuuaguuuccuugguacuaagugguaaacuaagguaagaacucuuucagcuccugggccagaguucucaguuuggcacaucuguagccauauuucaguuaaaauauuguccauauuaauguaugacauaaacuuccuccuugauuaaggaucacuaagccucaugauaaaaaagcaaaagaaaguaaaauauaaggcguaaaggauaaagagcaacacaguuguuuuuguaugcuuguuuuugagauaaagaaguuaaagauuauacucuacauuuuaaguguguguguguguguuugcaauuauagcagcuaucuuaccuucauuucauaacuuuaaacaguaauaggcuaggaagaaaugggaaaaauaguaugagaaguauacauguagagaugaugggaaagcaggaagggagauuaggaggaaacaagaucugacaugaagacaaaguacaaauaaaauuauuagggcuuuucuugguuuucaggcauuagaauagcuucucacuuuuuuaaugcuuccagaauaacuacuuuucauccuuaagguucuacucucaauaguauacccugaugaugcaaugucuuagucgucucauuaguaucauugccucucagcagcccauauggaaucaacuaaggauuaggacaguccuugcuauuaaugaucuccuacccuaauauuguuaaauuuccagccagacagaauauuuacuauuuuguaaaagguuguuuauuuucuucuacagaaucaggacuaauccaucaagcauuauauuaagccucuagggaaaacauauaggaucuacacauaugcucugucucucauucccagugcaaaauuauuuuuccuaaucauuuuuuauuccuuuucaauuauucacuaagguaaaaccuacagagaugcccaaacaggaagacugaaaauggcagaauaaauguuucacauucuuuuuuucucagauauauucuuagcuccucuuaccuauaucuuuguaccuucaaauuuaagauuugcaauauauaaagacuuuagaaacaacggagagagacuucuagucauacauuuaagcuucaguuucaacucuucgaaaaaucaucucuuaggaagcaucuucaaagugugaaaauacuucaacaguguagacuuuuuaucaugcuuuucuucagguuacauuauuauuuuuguuagguuauauuauuauagacaguaauaaucaugcauuauuacaauagugaucaauuucuauuuuaaaucucuuaacaguuuucggugaguaucaagacagaugggaaagaaauggguguagucauucuucccuucuuaauuacaucauagugauuucuuuacuguauuuacaaaauauuguuuuuauaacuuagaggauuucucgcaaaaauauuuuauuacuuuuggaccauuauucuucuuggauuugaaaauccacucaaaugaaaaacauuaauguauuuugaauguacuuuaguguuaagaauuucaucuuaauuaaaauguaaaacaauguaauuaauuucaagugucucuuagaaauaaacuuuuagcucuuacuuuccuacaaaaugcugaauuuaccucugcauauugaaugugaagaaaacaaaauauuguuaaaauuuuguauuucaacaucaaauauuucuacugauacugagacaauucaacaucuaugaaaauggucuuuuuaguuaggcacugggucaagugcuaaggguacaaaauuguuagaucuaaucauaaggacauuauauuguccuuacagaagugggaaaaguggucuuuauuuuuuauuaucuuuuuaaguuuuaaauuauaguggacuucugcaacuuuuguuuaaaaacacuuuuagaauuaaaauuacggugucagcaugucacaugauggaauguuauuuaguguaaaagcuagugggcccuugggaaguacuagauuaaaaaccaaggcuaguugaaucuuaagcaacuuuuguuacauugugauuuacauuuccuccacaaccaacacauaaacguuuuaguguaaacaucucuugaauuaccaaccuuacaaaauuaaaauuuacccuuuuguuuacugagguuuauuucacuuuaaauguccauuuaagaauauuguggaggaaaaaagaauauucugcaauguguuuuuauuugaauuuuuccacccucguauuucuuuaggaguugaucccccucauauuguguacagcaugucuacauccugagccuaaagagcgagaucagcuucuccacauacuuuucaauuugaucaagaggccagaugaugagcaaagguggguaugauuacauaugugaaaaagaaauacaaugugacuuacugauuuuaacuaauuaggcaucaggauuagcauuugaaucuaaaaugccuucuuuccuuccaguaucuauuuuagcagcgcuggagcauucccccaucauggauucacuccuucaugguuucaaaaccuacgaaaaugcauuucaaacuauaaugucaucaucagguucccuuuccuccucaccuucucuuuuuaaagggaccuggaauuuacugcaacaaaaaaaacagauaauagggaaaucacucuaagaaauuuaccuuaugcauaauaaauaaaaccuaaaacaaaaauagcuuucuaaaauauguauaaauccuacuaagaccugauuacuuaucaccugcuauaauuacugacaagucucauuguuuaaaucuuugaaaaggaauucuauaccuucucaaaauguucaguuucggccaggcgccauggcucaugccuguaaucccaggacuuugggaggcggaggcaggcagaucaucugaggucaggaauucgugaccagccuggucaacauggugaaacucuaucucuucuaaaaauacgaaaaaaucagcugggcgugguggugggcgccuguaaucccagcuacucaggaggcugaggcaggagaaucgcuugaacccaagaggcagagguugcaaaugagccaagaacaugccauugcacuccagccugggagacaagagugaaaguccgucucaaaaaaaacaaaaaguuaaguuucucaagguugcuacacagauauagguacugaaggccauuaucuaaauuaucuuguauuuuugagggacuaauucaauuucuuguaaaaauguaaauguucucugaaaauugcaagauaguuacuuuugucugaaaaaaaucugccauuaauacacuuuucugcuuucuaguagacaagcaucuacuaguaauugaugauuagauuaugcccaaacccucuaguggaagggggagggagugaauguauucuagccaaaucaucuguugacuagaaaacggcucuucuccucugcucuccaagugcaacaaguuccagauagguagcauagcagcaaauuguacauaccuggugacccccucaggcauucuaauguucuccaaauagaaaccuaacuaaccuucaguaaggcagauuuuuuuaaaaaagcccaacuucaucugccuguauauguucucagugauauuuuuuaugaauccuaagaccuauaaaagcucaaaaugcagauuuugcaucaaaccauuuaucguaaaacauugaggugcaguuuuuauacacaaaacuuucuaucuuuuuaagaauucuguuuguauggcuuauugccuaauaauuuuugauauucauguaaucucaguaagcgucuuuucuuagaaauauguguauauauauucuauucuguuagauucugagcuacuuuuuaauguuuaccuuacagugagauucucccaacugaaagcaaguggaguuuauuuuuuucaaucuugauuguugagagagagaacuucugguuuaagguagugauagguugacauuucuugauauuuccuucccaaauuggaauuugcuauugaagacauuuaaaaaguauaaaaaacuaagauauaaacacuaaacauuugugaaaaacacaguuaacagucagccauuugaagggccugagaaaauuuucuguuacucuaauaucauuuaaugaagcucuauuaggaaggcccuuguaguuuucacuuugagaaaaguauguuucaguuggcuaacaaguaaguagaaugcacuaagucagacagccauuauuuuuaucuaaggcagucaguuauuucuguccucauucagucugcugucaguguuucucuuucuucauccauucagagauuauuauucccaguaaacaagaaauagagggagaugggcaaaugauaucuuuuauccuuaaauaugugguuuuaucacaaacaaagccagauaaagaccagaaauagcccuagaaguacacaguaaggguuaguuuuuuuauauacgauauuugucugaauuaaacuccagccuacuucaaauccuguauagcauaaauuaucaucauugucaagagaacugggcguugagaaaaggagaaaagcacaccuggauucagcagaacgacauuaaauuauuaugucuuuaauauaucugagauaucucagggagugaagccauuaacuguggcuccucccuuucucucaaaaugaacuggagcuggaucaauuucuucuuaucaaagauuagucuauagaaaccaaaauccacaugagccccauaaaaauugcacuuuacagugaaaauaacaguuacucuaaauucagaauaaaggcauaucuuagaaaaugauguauuacaagaaccaaagaaacauuuugaaacaucauuuaguggccuaaaaaagaggcaagaauuccuggcuauuauaaacaggagaauggagccaaaauaaauguaggcuuagaggaaaaagauugucuggaauaaggagagcuagcagaaugaaaaaaaaauuaaaauaugcaguguuuucaaauuuauguugaagacaaaguaauagauuugagacuauugaaaauugaauccauguuuauuauaagcgauuuuuuuuuuuuuuuccugagacagggucucacucugucucccaggcuggagugcagaggcacaaucauggcucacugcaaccuccaccuucccaggcucaggugauucucccaccucccaaguagccaaguagcugggaccacaggcaugcaucaccaugccuggcuaaugguuguauuuuuuguagagacaggguuucgucuuguugcccaggcuggucuugaacuccuggauucaagugaucugccugccuggacuuugccaggugcugggauuacaagcaugagccacugugccgagcugauaaauuucacauaucaauaaagcacgguauucacuggccauuugcaggauugaaggauuguuugcccaaacuuuugugguuucaauaauuuccagaaacucuucaaccauagcucauaauacauccugauggacaaaauguaaauguauauguuccugcaauaucaggcccugacuuuucuguaaaauguuuuggaaagcugccauuaccuuugugcaugguaugaauaguguuaaucaacagauugacagccuuaaaagcauuuuggcauuaauuacugcuucacucaauguaaguucacaaaaaugcauguauaaagcuccuguauauacauguuuauaaaaaugcauguauaaaguuuccuccguaaacuuugcugcaacccuuuaaacuuuuuccuuauaaaggcauugugaugaacuuagcaacacauuuuauuccagucauuuuguuuuaaaaugagcaaauuuguuaauaauccucagaaaguuggcuccaguaaacucccucaacaguuaaaucccaguuucucuuuaauuaugaaagucuuugaaguuugaaguuauguauuaauuaacagaggaaacguugcccaaauuuuuguaauaagcagagggaacacuggccucacccacaauguucugcaauauuuucauucuuacuauuccaauuacucauuuguuuuaguuaccuuuggacuucuaauucacauacugcuuugccuuuauaugccaugcuugauuucuccuaaacauuccccuuuuucccacagaugaacuagauacauuaugaucuuuuaaugguuaugcuuuauuaaaaaauguuuaugcuuuauaaaaaaauaaaauauuuaauauaugaauuugugcaucacuggguuaucaguaaaccauugcuguguggcuaaagagauacgguauguuauuuuggcuaguccugagucuaauacccacaaguaaagaugccugaguugagcaucuacucagagugaugaggagggccacagaucagggugacacaugagaagaaagcugaauggguuuugaucaagcaaugaugauagcuaucuaccucaaaucauaaaacauuuaaauauuaagugaagcuguacaaguagggacuugaacaaagcauccuggauggguggauagauggauuaagcaccaauuggauaaaauaaagcaguugaauguuuuccuauguuauaauuuuuaucuuaaugaaaaaaugauuuuugcuuauacuuugcaaaauaauagaauuguacuuaaugauuuuguagcuuuauguaauuucaguacuugcuuuucugacugauauaauuuuuccucuucugagaauguuggaaaaucauaaauaagaaugaacuaugaaagauaucaagcuuauauuuuaaaauacaaagaaccccucaacuaggagaauacaaacacuucuauagacuuugaaauucuauuacugaaacuucuuuucugcaauuaucaaaauauaccugaccaaguagagaaacuugcucuuuucaguauccagcuaagguuaauuuauaccagcagcccuaacaugcaagucaacuaggaauaagggaaauuaaaucacuauauuaguaccauucauugcaaacuaaaaauuucccaaggacaacuuggugguacuauaggaaaauuaguauuuuauuuuuuccuuuaaaaauaccauuuccuaucuugguaauuuaguuaauaauuaaauauaguuauuauuacauuuucauuuuuagauuuucaaggcaaaaaccuggucuuagagucuauuuucauaaaccuugcauguaaagcuaacagcugccaccugguggccaaaaguacuuacuagccuuacuucaggucaaggugcaucagggaucaacacucaaguccacgcuuuuuuuuuucuguaaggugaaagugaucuacuuucaccuuacacaaauauaaauuuacuaaaauagacuaauauauucauuauuagcuauguguuauauaauauaaauaacaugaaaaaagcaaaaacuuuagguuagcaaaauauauuugauauaaucaguuauuuuucuuaaugaaucucaggcugcuuugaucguaucccgagaaaagcuuaauuuuaugcucaauaaugaugcuuucaccaauucuuuucuagcaaccauaauugguaccauaugucuaccuguaucauuuacuaaugaaacaauccuuguacugugauuuuccacaaguaggaacaacauuuauuuuuacuaucauaguagccuauuuccaauguuguuaauaaccugugggccuucuaaucuuuucuguuuuggacuguauuucaaagccgucauauuuucuaaaauuuucaauauuaacucuucuaagaaguuuauuucaaggggccuaauguuuuuuccuauuaaaguuuguagucuuuaguauagugauggugacuuaugauuuauagucauuucaugugaagcucuauacaagugugcaccucuuguaaguguucaaaacgcuuuuuaagaaaauuuagcuauuacaauuaucaaacauguauggcuucucauuuuaauacacuaaugagggcaaaaacaaugaucagcuauuaggaaauguucauuaggagcaggcagcugaagugcuugcuaauaucuuuuuccauuuuccuuucauucacuuuauuugccuuccuaaaguagaaggaaauaggaaugcaaaagaaaaguugagaaguagaaacagaggguaaugauauaaaggggaaucagauagauaaaaacuacaaggauuguggugaauuagaagcugcuugcaauguacagugaagacacauuggcucaccguuucccccaguguuuccaaagagcuuuguuauucuucuuaacuuaagcaaacaauuaguaacuaaucugaccaaaccaaauagaaauuuaaagucauuuugcaguuaauuuaaauugacauauauugagauauaacaaugagcaaugccuagacguaaaguacugauuuuauaauuaaugugaauuacauaagcauucuauuuugguuuuccuugaaguuggcuacuuuaaaacaucuauuaaaaauauacuuuuuuucccaucagguuuuacuguuuuaaaguguuagacaaucaaaguggaagaacuuaaaauucugcauuuuaaagucauuuuagauggaacuucauucugaagagugcaaagucuuacuuagaauuuuauguuuuuuuuaguuacaaaucuaucaauucaaaugaagauaauguauuaguuauugguuaacuauuguuuuguaacaaaguaccccagaagaaagugguuuaaaacaucuuuuaucuuacaguuucugugggucaggaaucuggguccucugcuucagggucucuuacaaagcuguagucaaagguccguuggggcuauagucaucucagcuggagaagggauuuagcuggagaaggguuugcuuuuaaucuuaaucacacaguuggucauugucaagaaucaguuccucaaggauucuuagucugagggcuucaucuccucacugacugguggccagaagccaccuuuaauuccuucccaugugggucucuccaacauggcagcuugguuuaucuaagcaugccugcugagaaggcaguagaguccaacaagauggacaucacagacuuuuggaaccuaaucucaaaauugaccucuuaucacuuuggucauauucuauucauuagacacaagucacuaggcccagucugcacucaaagagaugcgaucauugagagucaugucagaaacuaccuaccauaguuaucuuagguauaauaccaaaaaaucugauucuuaaaauaccacuuuauuaauaugauacuguaguuuuuaauuauagaaacacugggagaauaaucacugguuguuuuagugucuagaaagugaaguuguguagaaacugaagcauugggcauauauaaucucagaauguaugugugggaagguaauuuggaagguuaugagauucagccucauaccuauacagaaaucccuucacaacaucugucacagaugguguugucacugcuggaguggcuaaucuuaaagaacuuagguucuugguggcagcuuaggccauuguuagcaagguauaauuuuuucuuuuuuucuuuuuuuucuugagacggagucucacucuguugccaggcuggggugcaguggcgcuaucuaggcucaccgcaaccuccgcuucccagguucaagugauuccccugccucagccucccgaguagcugggacuacagucgggugccaccacgcccggcuaauuuuuuuuuuuuuuuuuuaguagagacgggguuucaccauguuggccagggcggucucuaucuccugaccucaugaucugcccgccucagccucccaaagugcugggauuacaggcgugagcuacugcaccgggccaaaaggucuaauuuuucaaaaccagacugugcaacauggugaaacgccgucucuacaaaaaaacacagaaacuaucugggcaugguggugaacacuuauagucccagcuacucgagaggaugaggugggagggcugcuugagccugggagguggagguugcaguaagccaagauuaugccacugcacuccagccugggagacagccagacucuaucucaaaaaaaauaaauaaauaaaaagucuaauuugauuguauaaaaaucuuguacucuaugugaauuuauagagaugagacuuuuuuaacccuuaguccuaguugugcuuucucaugcaaauacaagccguuuuuuauauuauuuuucaggcaaaugauacugacagguuguguggcauuugcgcgucauguuggaccaacacguguagaagcugaacuuuuaccacaguguugggaacagguaaauaacuguauugaguuuucaccuagcuauuauagccugauuucuuaagaagauacauaguuuccuuuuuaaaggcguuuaagaaauaugugggauauaaauuaugcugauguuucuguagcccagcacagugauuuauuaguacuuacgaaugcucuggggugcuuuccuuuauucauucagucaacaaguacuuaugaaacacuaauuucagugccagguacugagguagucacuagggauacaguggugaacaaaagacaaagacauccuaaugggaaaaugaguaaacaaagaaauggucugcuauuuuguaguaauuuauauuaugaagaagaaaaauaaagcaggauaagggugagagagugauggggaaugcucuccuaugaaggguggucagagaaagaaucucugaggcaaugauguuuaggaaagaaucugaaugaacuaagaugcaacaagaacaaaggcccugaggugggaguauacuugaagaaacagcaagaagauuguguguguguguguguguguguguguguguguguguguguguguaaauagaaauauauauuguauacuuguauauauuacaaauauauaagguguaaaucuuugaugugggagguuuuuguauuuauacuugaacucauuauuuuacuaacaaugauuuugcuuuuacauugaauuuaaaauuccaguccucuguauaacucagaaucauugacuuucuagacuuaauguuuagaucauucagcaccuuauuuuuccaccuuaaaaagauguguuuccugcuuauggagacaaauuacauggcuuuauuuacaauagcacagucacuuauucuuaagaaaaauauuagucucuggaauaucacugaaguauuagucauuuauaguccuauucccaaguucuuugggcauucauuuuuuccaccaaaauaaaguagaaacccuagauucaauagacaaaguaaacauuacauauaauaauaacuaccugucacaaucccuuauaccaucuauaaauuacagugcauacuaauuuagggugagguucuaaucacuuggagucaaaauaacuuggguacaauauauccauauaacuuucaauuuacaauucuauacaguuaauugugcacauuuaauuuuuuauauuuuuuccauuuucuuuugucuuuuucuuuucaaguguacaauuuaaugguuucaguguugugcaagcuucacuacaaucaguuuuuaaacauuuuugcuaucccaaagacaaacccuaacugcuugaauucgguucuccucuuucaagauuauuuugacgguuccaggucccuugaauuuucuuaugaauuuuaggaucauuuuucaauuuuugcaaagaagccagcugggauuuucauaaacaaugcauugaaucuauagauuuaucuagagaguauugccauccuaauuuuauauauuaagucuuucauucuaugaauuuaggaugucuuuccaugcauugggucuuuuaaaauuucucucaacaguaauuuguauuuuuccgaguaguguacguuuugcccuuuuguuuuauuuauuucuaaguauuucaugcuuuuggaugcuauuguaaauagacuuuuuucuuaauuuuauuuuuaguuuguucauugcuaauauauagacauacaauugauuuuugcauuucaauuuugagacuuacugagcuaaagaaaagcaaacgaaaguuuaugcacagccauacguugacauucaaacauucuacuuuugagguaacuacaucuggauuaaauuuaauucaaagaugucaguuauaaacaucucuacugccaccucuucuguaaccugaguaaacuuggauaucggggaucuaucuagccgccuaccuccaguuuguugcccaguagauuauuauauaauuuuuuuucuuaauuuuaggcauccaauacauuaaugaauuaugucaccuuuucauaugggaauaugagaacaaauauacuccuuuuccagucaaagaaagauuuauauucuaugaagaagacauaugggaacaaaacccaguaugugucauuuuuuuuguuauuuuugguuaugguucaguguagucaucacaauagcaaaaccccaucauuuugcauuugcaaacagaggaauggauugaagucugcuuacuuuauaaauaaaagcauauuucuagcaaggguucuggucaaaucauugauuaacuuccuuccucaucccuuagguugaagaaagaagacuggcacauauuauagaccguaucuauaagauccagaagcugaguuuuccaaguuuaaaaauauucuacucuugcuagggaaagguccugguuucuccuguuacucuaaggaaggccuacucuuaggcaagcccauaaucucuagauaccuugccaaauuuucaucuugguuuucccuuuuuucuuuaacagaugaccccuguaaccucauauuuagguucucccucacucccucauucccgauccagguauagucaaacagggauucccagaaguggaaaaggaagaagcuuuauugcauucuuaacaggauuuguggugaaauguaauucucuuuugaaggaagggaggguaugcuguuuaugcuugauuuauuuauuuuuuuugcucuagauuaaucacaaauacccagaaagacgacugcuuguggcagaauccuguggagcacuggcaccuuaccuuccuguaagauugucuuuuuuuuuuucuuuaaacuauuuuuccaauaauagaaaaaccuuuuuuugagugucuuauagauuuuaauccaaaugucuccuagaugugcugucuuaauaaagaaaagagaugauccaaaaaagagacucacauuaguacaguauggcauugcagacacauagguacauuaccacugauuuuggaugaguauaaauauauuaaacuauaucagcaguucucauaguguggucugaggacccuggggguuuccuugagauccuuccaaaaagguccaugaggagaaaacuguuuucauaauaauaagacacuuuuugucucuuucacuguguugaaauuuguauuguuggugcaaaagcagggaugggcaaaaaugcugcugcauuagcacuaaucagggcaguggcacccaaauguacuauuauaauaaugauuguauucuuuacugccaugcuuuugcagaaaaagccaauuucaccuaaaaaggagcuugcugaaucaguaaaauuauuuauuuuacuaaauuuugaccugugaagcaugcaucuuuuuaauauucugugagacaaaauagaaaguacucauauaaaaacccuuugcugcauacugaaaaauuauagccauuugcaggaaaagcacuuaggcaguuguuugaguuaugagcucaacuagcugcuuuuuuuuuaaugggacaccaauuuuacuucacagaaacacuuacagucaaacugguuuuucagacuuggguauguggcagacauuuucaugaaauuggauggagugagaaugucacuucaaggaaaccaaguagacagcauucauugccaguggauuuauacuccuacuaacaguaccuuggaguuuuuauuuucccauaccuucaccaggaacuaggcacggugaaauuuuuuuaauguuuuucuaguggaagaaaaugccuuauuguugugauaaaucauacagauugaugcaaaugguuuugagcaucuuauuauuuauuguuccaagacagaugagcaucccuugcucucaaaggauaaauaggcuguucuacucugauccuagaauacuaagcaguauuaauaauagauacaauguuuccucagcggaucuauguuugccuucugcguaccccauugucacugauagcagcaaaaugucucuacauuggcaguuucucaguguguucaugacuuaaauagaguaaugccuccugaccaaugcucugguggggucccuguggcauacuaaaacugauugccacaguugacccuugccuaaaucagcauaaagcaaaugcccacuugaagcuuauuuuccucugucauauugccuuguguggauaccaaccaacaagucccuuuaaauaguuuaagauauuuuagggcaauuuuuagccuaaaaaguaaauaaaugaggcuguaccaaaagauguuauauauucaccaaccuaaauguguuuuaagauaugcuaaaauugcauguauuuuuguuucuaaaaagugaaaaccagacuuuuuaaaaaugucucucaagccuugcucuacauaccaaaucaugcuguaaauuuaugcaaauagccaugucaucugccuuuauuuuuauuuuaucguaguuauuguauguaaaaaggaccuaaacaaguuuauguuuuaagaauuuuauaaauugcaauauuaguacaaguaggagaggaggagcaugaauuuguauauugguagcucuuuauccuaaccucagccaugaagcuaaaacacucuuuaucauaacuggaaaauauucugugugaaaucaaggcacagcaguggguguacauuauauuaacuauuagcauaaaaaagagcaaugcaauuuuuaaguacuuuuaaaguucacucucuuauuuuauuauccuuuuuuucccacuucuucaaagaaauaggaaugccaggauuuuagguuuccucaccauaucccagacaaauuuucuaauugccagagagauuuuuguaguuccuccuguuaaaacucucagugcucuucucugagugaaacaaauagugacacgagagucauuguccauuuguaguagaguuuguaguagacuuuguugauuuguugaaagugccuccuagugugaacugcaaggauuugagagauuuuuacauauuuaguaaagauauaaaaaacaugcugagagaugauuaauaaauaccaaauucaaaguagauauuacugccucuagagaggaagggauuugggcaugagugauauuuuugcuguaucuguaauguuuuaugucuucaaaaaaaaaaggucugaagcaaaaucucuguacaucaacaguuagucagcauuuuuaauaaaaauguuaauaccuguuuaaucuggauuuugaccacacugauguuugucauauuauuuucuauacuucugugcuuagguguaaauaaauaguaaaaacauguuuauuuucagaaagaaauccguagcuccuugguucuuucaauguugcaacaaauguuaauggaagauaaggcagauuugguaagagaagcuguuaucaaaagccuugguaucauuaugggauacauugaugauccagacaaauaucaucagguauguuuuucagaaugaacugauuuuacuccauuauaaaauuccaaguauuauaauauuccaaaucucugauuuagauacuuuauaauguaucauaaggauggcagguaugucaacuuuagucaucuggggauggcugccugguuucaauuuugcagcucagaggagagaaugcuacacuucaguuauaguaucugccacagcuuucuggcaggaaauuggcaagagguauucuauguuuaccacucccucucuuugguuugcucaucaguggauacauggcaaggcuaggauuauggauggccuucuuucuugcuuaaaaauauguucuuaauuuauugaaauuuuuauuacuuuuuauuaaguguuuuauuuuaaguuuaucccuuuaaaaaucuacauuugccuuuuucucauugacaggguuuugaauuguugcugucagccuugggugaucccucagaaagaguaguuagugcuacacaucaaguauuuuuaccagcuuacgcugcguggacuacagaacuuggaaauuuacagucucaucuuauacuuacacuacugaacaagauugaaaaacuucucaggguaaguucuucuuuuguuuauauaguuuguagaaacuuaaaaggucuguccuaagccaucuuggaacaauguuagagaacagagacagaaagugcccuuagcuuaacauacuaauacauuaccaguuaaagaugcuguuggacuggagccaagaaagagauuugaggaaguuuugcuuugcugaagcuggaggaagagaaagggcaugaugugcauuuguuaacugaaaugcaccuucauggaaguaacuccuacauuauucagaaagccagcucuuucuugacccuucugaguacuuaaauauuuuacacaaaccaucaacucuaguuccagaaugcagagaaaaugagucucuaaagcuuucuuacauagugucaaaauugcuuuaacugugguuauuccacuccaguaguucauuucucauuuuuaaaaugaacuuuuaauuuuucccacauacaagaauuaaagaaauguugauggaacaauagaaacuucuugaucuaauuuuuguauuaaaaguuucuuuuagagacuagaagagaaauuauuauuuguguagugcauauuaugugccaaaucuauaaaaagagauaggaaguaggagaggggaaguauuauagcaugaaaugcugcuggguuagcguuugagcauuucuauaugccaacagugaauaagcuaaaaaaaaaaucaagaaagcaaucacauuuacaauaguuuuauaaaaaaugcuuaggaauauauauaaccaaagagaugaaggaucucugccaugaaaacuauaaaacacugaugaaagaaauugaagaggaaauguuaaaaaaaaaagauauccauauuuaguuguucauagaagaauuaauauuguuaaaaauguguauacuacccaaagugaucuacagauucauugcaaucccuaucaaaauauggaggacauucuuuaagauauagaaaaagcaaucugaaaauucauguggaaccacaaaagacccugaauaaccaaagcaagccugagcaaaaagaacaaaucuggaaaaagugcacuaucugacuucaaaauauacuucaaagcaguaguaaccaaacaucuugguauuggcauaaaacagacauauugaccaguguaauagaguagagaacccagaaauaaauucacacauuuacagccagcucauuuuugacaaaggcaccaagaacauauauugaggaaaggacaguuucuucaguaagucaacugaaaauggauuaaagacuuaaauguaagacaugaaacuacuaaaagaaaacauuguuucaguacguuggucugagcaaagauuuuugaagaaagaucucaaaagcauaggcaacaaagcaaaaauagacaaaugggauuauauuaaaguaaaaagcuuccgcgcagcaaaggaaucagcagagugaacaaacagccuacagaaugggagaaaauauuugcaaacucuccauccaacaagggauuaauaaccaaaauauguaaggauucaaacaacucaacagcaaaaaaaaaaaauccaauuaaggaaugggcaaaugaucugaauaaacacuucucaaaagaagacauauggccaaaaguuauaugaagaaguguuuaacaucacuaaucaucagguaaaugcaaaucuaaaccaaaaugaaguaucaugucaccccaguugaaaugacuauuauuaaaaagacaaaaaaaaaaaaaaagaugcuggucaagguguggagaaaggggaaccuucguacacuguugguaggaauguaaauuaguacagccacuauggaaaacaguguggaaguuccucacaaaacuaaaaacagaaauaccuguaauccaccaaucccaccacuggguauauaucuaaaagaaaggaagucaguauauugaaaagauauauacuuucaaggacuuacauguugaguuucaagcacucacauauuucuuacagcacuauucauaauagucaggauauagaaucaaccuaaguguccaucaguagaugaauagauaaagaaaauaugguauauauaaacaauggaauauuauucagccauuaaaaaaagaaugcuauccugucguuugcugcagcagguagccuagaggacauuauguuaagugaaauaaaccaggcacagaaagacaaauauugaauguucucacucacaugugggagcuuaaacaguugaucucaaggagguaaagaaugaaauggaccagaagcuggggucugggggaguaaugaacagaaaaauacaguuagauagaagaaauacauucuaguguuugauagcacaguagggugaccauaguuaacaauaauguguuauauauuugaaaaauagcuagaagagaaaauuuggaauguuccuaacacaaagaaaugauacacguucgaggugaugcauaucucaauaccuugauucaaucauuacacauuguaugccuguaucaaaauaucucaugguaccccguaauauguacaauuauuuauguaucaauucuaacaagaaaaaagauaaagugauuccugucccuuacuuuaauuucuuuacccugucuuauaaaauuucaaaagauaagaccuucucuaaugaaaaaguaaaauuacaaaaacuauucccuacaaauggaaaugacugauguuuacccuauaguuuuccauguaaaagauucuaccacucuagagugccuuacugcuuguuugaguccaacauaaagguccuuaaaucuuugauuugccacaguaaggaagaacaucauacauaaauccaauuagcaauguaacuucaaaagacuaaaauuagcuuccaccuccuuauguuucaggaaggagaacauggacuggaugaacacaaacuccacauguaucuuucugccuugcaguccuugaucccaucucucuuugcauuagugcuacagaaugcaccuuucuccagcaaagccaagcuucauggugaagugccacagauagaagguacugaacuuaaauucuggaagaaaaauguagaauauuagcagccuagcuucccaaagaauuguuuuuuauuaaaagucuaaaaaucacuuuauaugacagcauaauuuuuaaaauguauuauguguguagaaucucauggucauaagauuauacguaugguaaacaauauggcuucaucuuuuauggauaagccccauugucuuauuuuauaauacuuauacuuucuuguugcucuuaaucuauagccuuuuuauagccuuucuggggaggcugaaauaaauauuuccuuccguuaauagaucugagucaacaaaagauucuuuuaauaguuacuagugccaguauaugaagcuugucauuucugcuuucuuuauauuuucuuccccaacuuuuuaauuuuauuuuuaauagaggaagguaaauauaauuacuuuuuucuacuauguccuugauagaaagaaauauaaaagcaucuguggcagaauuuguguuuuuccaaagaagaaaugugacuuacuuucagaaguacauaaaauugacaggagaggccaguauuuucuuaucuuacucuccgaguagcuaguaaaugaccuuugaaacuugacaggcaauugauaacccuguugcaccuuaacguccaggacaaauggcuauagacaagcuauugcuauguaucaggcaccuuugcagccuuuucagaguugugaaauuauccaugucucuuacuggugucuaauggacaaagaauuauaacauugagaacaucaacagacaaucuucuugaauuucauuuuucauguaaacuguaggcuaccuauaauauuuggaguaugaugcaguguguccaaagauacaugaagccacaugauaaaaauaguguauacuauuuggaugucaguuuuauuuggaaaauugagaaugaaugguguggaguuaauuuaacauuuuuaaauugaggagaaugaaaauucagacuuuagauaagacuucauaaagcucucccagcuggccacuucagguucuaccccuuuacucuuacucauuuaggcauuucaucugccuagggauuuuccuaucuuucuaauucccuuuuucuuuuuagcuuucuguauucguuuacuauggcugccuuaacaaaggaccaccaacugaguggcuuaaacaacagaaauuuauuaucucacacuucugaauuuuagaagucugagaucaagguguuggcaggguagucuuagggaaacugcgagguaaaggcuguucugggcucuccccuggcuucuggugguuugcuggcacucuuuaguguuucuuggcuuuuagaugcaucaccccaaaccuugccuuuaucuucacguggcacacuuucugugugcuuguuucuguguccagauuuucccuucuuauaaggacaucgguuguguuggauaagcgacuacuucaguaugauuucaucuugucuaacuacaucuacagcaacccuauuuccaaauaagaucccauucugagauacuauagguuaggacuuaaacauaaaaauuugggcggggggcaguucaacucauaauacuuguuaucauucucucauuuauuuaacaaaugauucuuaaaugucaucuauugccaagcauaugcuggagauuagauagaacaguaucauccugaacauauccuucuaauacuuaugggauucccuucuaacauuuaugugaccuuuucuugugauuguccuuuauuuuucauucuuguugacuuaguuuaacuuucugacuuuuaacaguagcuauaaauguuaauguuacuauaccuucauuuagguuauaauguauuuauuauaaauaaggauuuauuauauccuuauuuaggguauauccauaugucuauauguccguuuauauauacacacacauaaaauuuggguuauaauuuguuaugaaugaagauuuguuuucucauaaaaaugguaacccacacaaauauuuuuaguaccaauuuauuacacaacaugaacaaauauuuaugucaggcauuguuuuagacacuuaggacacaaucaugaauaaaauagauaaaaauuucugcucauagagcuuacauucugcugugggaauaaaaucuuuugagauuuguuggauuuguucucauaucacaggaauuucuugauuuuccuaaaaaugacuuaauuaguguauuucaauuuuauauuuaaaauuuacaauaagaaaguaauuaaauaugaggagaaaggaccuuauuuuccuuucaacagaauaucuaaguucccaaaaugccaauuuccauaugauuuauuuugcuucuuuuauguguagugacuagguuuccucggccuaugucgccucuucaagauguguccacuauuaucggaagucgugagcaauuggcagugcugcugcaacuuuaugacuaccagcuagaacaagaggguacaacaggcugggagaguuuacuguggguugucaaucaauuguaaguuaccaccuccauauuaauuugaauagaugauaacucuuauauuuagccuuggcccuaagaacaaaauauaacaaaacuuuuaaaauguaacucggcaucauuuuugguaaacaccuuuaggacacagaggauucacaccauuggauauguaauuuaucugagaagaagauguugcuguauuuuauccgaaugaucuaucugccaucuuguuuguccaaucguggugauggauuuuaaacuacaucuagacuucucauuuuugaggcuaaaaugaugccauguaaagccaagcucuugugugaagcaucagauccauagauuugagucacauuaacucuguacucggaauucuaccauuaagguuucauauauuuucuggcaaacaguuaaaauuuacuuuuuuaagucuauacaguauaauguaaucuuacaaccuauucagagggucccagacaaugccuuuccuuucaaagaacgaaauagaacagguuauuagauuugcauuguuucagaaauuggcaaggaaacaguaauuuauauguauccccugccuauuuuucuuuccuuucauauucagguugccacaacuuauagaaauaguuggcaaaauuaauguuacuucaacugccuguguccaugaauucuccagauuuuucuggcgccuuugccggacauuuggcaaaauuuuuacaaacacuaagguaaaaacuuguauuccauguuuucuuauaugaaaaagacauagaaauguaauguguuaacacuguaacaggguaaauaaaagcaugaaccauucuuuuaucuaauucgcuucuuuaauauccuagaauacuaugauaguaaaaaaaaguucuaguugguaauauucuuaucuuuacugauuuucagaagaugauuuagccuaagcuuaguucauauccagacuuggauauaagcuuuacucauuguagauauccucaaagauuuucaauauaggaagugucagcuagggaacucaaccacaauccuuugaaugugcugcugguacuuacugucuaucacagguucaggaagcagcuguuugcucagcacacuuugguaaaaaccucaagcgauuauggaaccacagcaacuuauauauaaaacuugcugcgaagaugccaccucuuagaauagcauggacacuggagauaaauucuacauguuucagucauuaccaaaaguaucauuugucacauuugccuauccagguuauuuuguaguuucaaauauuaacauuggaaugucauuagauccuaauuuauucauuaauccuauuaauccauuugucuucauaacauuuuguuaagccaguacuuuagagagcuaauaaaaacauaaaaagguguaguuucuauaaucaaauguuaauaaacacauuuaaaagguaagcauuuuaauuauuaaauuuaauuuaguguagcucuuuacuauuaaaucuauaguugaaacauuuaaaguaaauaguaugcuauaaggaacuggacaaaauucagaagacuuggguuaugguccuauuaucuguugacuaauguuuaugaucuuuacuauuuaaguuaaauuaugugggcuuagucuuuucaugugugaaaugaagaauuugcuucagugucuuuuaauucucuuagcgcaauucaguacaugaaccuuuuaacauuggccuuucucucaguuuaagcuaaauauauaaauuaaugugccucaccuacagagaggagggcaaaaaccagaccuugauguuauuguaggaaaaagaaaauuaaaauuauuuuguauuuuucacuagcauucaguuguuaaacaaauauaauuugauuuuccuguuaucaauauuggcaaaaauuguuugauaucuccaaaacaaguagcuauuuuuuuuuuuagaaaagcaaguaggaaucuacuuauguacuuaacaguaagugguugucuucaguggccugaaaucugugauaauuuuaauaauaaaaaauuuaaacaaaccucuguucuaacuuaacauauuaaaguuaaauucuguauuucauauuucaauuugaaaaguuguaauaaaagaugaacauaaauaucacaggaugaauauguuacuuacuaaacaccugaagugacuggaauuuccuuuucguuuuuuaaaaauacaggcaaaugcuuuuuucgauaauucuaaccauguaauaucuaccuaaauaauccuucuauaaccaaguucaguuuuagaaggcaguaauuucaaccacuuaaaaucauauuggaaauuauuuuaauuuaauaaaagaaaccagaggccauucacuuguugacuugaguugauuuuuucaaaaauuuauccuuaaaguuuuuauuuucauuaauuugacucuucuauccuaagccucaugauuaagaauuauuacauuucugaccacuuaacuuagucaucuauaaagcuaaauaaauaaaugaauaguaguagcaacaguaguaaacauuucauuuaaucaauuugcccauugaaccugagacuuuuugaaucuucucuuuggguugcuuagguaaaaccucaguuccaggagauuuuaagacuaucugaagaaaacauuggugaguuuguucauuauuacuuuuaaaaacaauugcauuucuuuaugcaggaaaaauacuauauucuccauauauguaaauuguauaaaugaacuagcaacuacaauugaaaaggaaaacuuauauuauggaguucuugguuuuauaacugugucacaucuaauauccuucccauuaguggcagugagauuaaucccugucaaucugauugugaauauauaccuucauuguaaccaaauugauauaaggcugagcuuuacaaccuggguacucaaccuuuagaggucugaaguaguauauucaagagacugacaauuauaaaauaagcugcaucuaauuccuaauuaguucuauaauacuuuuaaaaauuaaacauaguggaaaagaacgguauauaagcauauauguuuucaaaaugaaacaugagagaaacuacagacuugaauggguagcuccagcuacuucauugauaguuuucacucaucuacuuuaacgagucuaguuaugguaccauuggccuaaggacuuguuuauguauggaucuugugucccuauguauuuuucuaguuucuaggaauaaacuguggaacauguguagcacccccacccccauuuuuaauuugguugauuuugaauauauaucucucuauauauagaauauauauauagucuagguauauauguauguguguguguguguguguguauagaauauauauauagucuagguauauauguguguguguguguguguguguguguguguguguauacauauauauauauacacacaccuuagugguuugaguugaauggucuagaaaacaccauuuuuggcaguccucagaaguagucagaaaaugaauaaauuaauucuuuuaagccugaagacauugaagagauuuggggugugggggcgguggacaaauaacuccuaauguuuauuuuuaaugucuuuuuaaaggauugauuuuauaaugccuaaauuguugguaauauauguuuauuauuaauucuugugauaaauuagugaagaaaaaagguaaauauuuuaaaaacugacagcuuuuggaauuauuaguuagccaugaauguuuagcuguugaaauaaauaggaagugauuaucaaccccuguaauaaucuaugaauauacuuuaagcuuauguucuaacauuaacauccacacucccuccccaaaaaagguacucucaccaagagaauaaacaaaccucaaauacuaauuaaugugaaaauggaacugucuuuuuugcaaaauuucuucagggcaguuaaauaaaucuuuucaacucaauuucuuuauguaguacccucagaaaauaauuuaaagccauauaaaaaauaaguauaguauaguaaaaaacuauucuugggaauauaacagcaaacuaaagcacuuaaaacagugccucaugaucaguaaauaaaagcuguuggugcugugaaugauaauuguccucucacaacuuuucuuuugaaauuguccacagaggguguauaagaaaaucucuuacaaagcaguuacagggcacagaacuaugguugcauacuuuccccuuuuucucugcuuuacuuagcaugauuccuucccccuccaugaaaauaaucagggcucugucuggcugaaaacccuacugaggaugcaggaggggcucaggaacucaggcuaguacugaaaacuaccucauaucuagaaauagaucaaauaacauauaucuaugugcuuuuaggugaguguguuuacauuuuaguaaacugcaaauugaaagcauaaaaauuuuggacaaccugccuauagggacgcuuagaagacuuucaagaagaaaguucugauuuccaauuauggaaaucaagaguauaccaucucauuuggguuauuaaaauucuuugccauuuaucagaaauguuuaugcuaguggcucuucaggaaacacuaaguuguauuuuacaaccaccaauaaacauauguuuuccaaaguaaugauaauacuuacuuguaaccuaguaaacaguuguaauuuuaaauauaaucgcauuaugauuuuuuucuuuacacuuaaaauauacuuauguuuuuuuaaauuauuuuaauaauuuuagauuccucagcaggaaaugggguccucacuaaagcuacaguccccauuuaugcaacaggaguccuuacguguuauauucagguaagggaaaaauucuuacucucuaguaaaaggcuuuccauuuagaaaaaugccuaguauugugucuucuuaauguaagugacauugcuaccaauaaagaaaaacaauuuacuuauuuuauucaauaaauaauuuauaauggauagcauauuugaauaauaagggccugaguaaaaccucaguugaacaaauaaauuuagagauuaugagcuuuuugauauuuuguuagaaguguuagauuguacuuacuuagcagaguuucuuuguguuccaugauaaguuuuucauagauaaaugauaagcagaacacauacguuaggugaacuaagcuacaaagcacuguagaacacuauaccuuaucaacauuuuuagcuaaguacuuuuuaauaaggcagguugaguaucccuuaucucaaaugcuuaggaugaaaguguuuucagauuuuggauuuuuuuuuucagauaaaggaguauuugcauauacauaaugagauaucuugggaaugggacccaagucuaaacacaaaauguguuucauauacacauuauacacauagccugaagguaauuuuauacaauauuuuaaauaauuuugugcaugaaacaguuuguguacauugaaccaucagaaagcaaaggaguugcugucucagccaccuauguggacaaucugguugguuggcaucacgaucaucauuccugacuuugcauuuauaugcuaccaauaagcaaucauuuucuuauacuuuuucacauguaaguacuuaacaauaagaaaauaugacauaucaucaauacagcgaaaaaauaaugugcucaggguaacaaagcacaguagcaucaccagaauaccuguaucaucuguugaacaacagccacagcaaaugaugacaggcuuucacacacaguaucaguuugguacucacaaaguuucaaauuuuagagcauucuggauuuucagauuagggaugcuuaaccuguacuuuauuuuucuuaauuguuacugcauaacaaacuaccccaaaacauaauggucuauuauaacuguuucauuugcucaugauucugcaaucugggccucacucagcuuucuccucuucugcuguuuuugcugguggucacuucuguugcugcaguaaguggguuagcugaagaggucucuacauaagucucaggaccucucucugucuccacauggcuucugaagcagcagagccagacuuaucacauaguggcuaacgccucccaagaaugaaaaggcagaaucugcuaggcuaaggcuuaggccuggaauuagcacaacaugguuucuacugcagucccuugcuaaauaagucacaggcacagcucagauucaagcaaaaguagggaaguaagccagggugugaaccaggaggugugguucagugguggccaccaauguaacaggcugccacacucuacuuaacauuguuuuaaguaaauaacauaugaugugucucaaagcauaguaguaauuuuuaaguaugaggcagucccaccaguaagguggaaauacugacucgggauaaagcacuuuuagaaguuagaauguaagaaugaagaagaaacaccuuuuccaaugguuuccugaauuuuuacccacuacuaacuuauuuauuuugcucuuuaaauucaaaguacagcaauucauauuuauuguacucuucuuucuuuuuuuuauuuuuauuauuauacuuuaaguucuaggguacaugugcacaacguucaaguucguuacaucgguauacaugugccauguugguuugcugcaccccuuaacuugucauuuacauuagguauuucuccuaaagcuguuccucccccugccccccaccccacaacaggccucggggugugauguuccccgccuuguguccaaguguucucauuguucaauucccaccuaugagugagaacaugugguguuugguuuucuguccuugugauaguuugcucagaaugaugguuuccagcugcauccaugguguauaugugccacauuuucuuaauccaaucuaucauugauggacauuuggguugguuccaagucuuugcuauugugaauagugccgcaauaaacauacgugugcaugugucuuuauaguaguaugauuuauaauccuuuggguauauacccaguaaugggaucguugggucaaaugguauuucuaguucuagauccuugaggaauugccacacugucuuccacaaugguugaacuaguuuacagacccaccaacaguguaaaagcguuccuauuuuuccacauccucuccagcaccuguuguuuccugacuuuuuaaugauugccauucuaacuggugugagaugguaucucauugugguuuugauuugcacuucucugauggccagugaugaugagcauuuuucaugugucuguuggcugcauaaaugucuucuuuugagaagugucuguucauaugcuucacacacuuuuugaugggguuguuuuuuucuuguaaauuuguuugaguucuuuguagauucuggauaauagcccuuugucagaugaguagauugcaaaaauuuuaucccauucuguagguugccuguucacucugaugguaguuucuuuugcugugcagaagcuuuuuaguuuaauuagaucccauuugucuauuuuggcuuuuguugucacugcuuuugguguuuuagucaugaaguccuugcccaugccuauguccugaauaguauugccuagguuuucuucuaggguuuuuaugguuuuaggucuaacguuuaaguguuuaaugcaucuugacuuaauuuuuguauaagguguaaggaagggauccaguuuccacuuucuacacauggcuagccaguuuucccagcaccauuuauuaaauagggaauccuuuccccauuucuuguuuuugucagguuugucaaagaucagaugguuguagaugugugguguuauuucugaggccucuguucugucccauuggucuauauaucuguuuugguggcaguuauuauacucuucuuucaagacaaauuugaaucauccuguaguauuaaaauacaguuauacaguaucacauauuaccuugcaauagaaguuacagcucuguuaaaguggcacaguauccuuuuaaauuuuucuuuucuacacuaguuucuaauacuacccugauauggauacuuuucuguuuguaaaagauuuuaagucauguauguuaauaaauugucucuauuguucauaaauuuguggagaucaaagauauuaaguccuaacagugcuagacgcaacaguaugccuaccauucucuaacuuuggaaaguguccuuguauaaugugcgaugucaguauuuuauucucucucuuuuuuacccucuugaaguuuuguuaauauuuuuauuuugaccauaaauaacauuuuaaaucauaauaauuaaaugccaagaacaagguuuggcucauaauaggcccucagaauagaucuguugaauaaaugaauaaggggcauuucuuuugagucauuaugaagucuaaauauguuauucauaucuguaaagagauaagaacuuuucagcuuauuacaaaauaaauagcauauugagguagcaaucacagauugccaguguuucuuauuuuaggaagcacauaccagcaguuaauguuuaucucacuaaacaaaaauuuuuguuaggguaaauuacauuaaacaaaaauuaucuugaaucaaauacauaagcaguauuacuuguuuugagaguccaaaaaugauaaauaagauuauaguaaauuuuuaaaaaucgaaagaauucauacuuauuuagaagucuuauuuuauagcucuuauuucacauuuagguuuuucucagauuuucagcuuguuuuccaaaguuaugucuauuuuauauuugaaauaguaggcaacuaaaaaugggugaaaucaccauuccagcguuguccugaugcugauuugucaguuaaauuguguguccuaaaacuguuauauucacccuuuuuucauguuaaccauuacuuuugucaauccuuaucucuacuucauucuuaacuaaccugauuauguagcaaaaaaaaaaaaggauaggugguaauccagucuuccucaugaucuauugauacauucagaagcuauuuacuguugaccuucugugucccuaauguugacuugacuuuauuauguauuuauuuucugacagacuaucagauucccuucccauauacauuuagguuaauuuaacauaaaacauuauuuuuuuuacucucuuaauuuagcggguuuucuuuuucuaacauauuuucugauuaugaaaguaauaauaguucguugaaaaaaguuugaaaaacacagauuauuuuuuaaucaaggugugcaucuguuucuuaaaagaacacaguagucuauauuuuacuaagugugcaguuuucaccacuaggauauugcaaagauaauuucuuagaaaucaauuuucuacuauuuuuucuacaacgggguaacuauucuaguaguuuguauuauauagagccaaaauuuaugggaacaaaaauucguaagguaaauuuuaauaaaagauuauacuuuuuaauguucuaaaucaggaccaaacauccaaacuuuuacagugacggaaauaauuuacagcugaguuguccaaucagcuaggcacuugccacgugugucuauuaagccuuugcacuguacccaguuugacugaggaacugaaucuuucacuuuacauaauuucuuauuuaaauuuaaauauaaguagccacauguggcuaguggcuacuacuauauuagaccacaggucuaaauuaaaguaucaagauagucugucuucauaccauucugaugauagauaugcuuaauaaauaucuuuuaauuaaaauagcuuccaaauuuggauauuuuccccuuauuugguaacauuuucuaauuauagauagguaaauaugguauuuaguucuacuugauuguuuggaaauucaguaucaguauuuuuccucuguaggaagaagaccgaaaacuguuaguuggauucuuagaagauguaaugacgcugcuuucauuaucucaugcuccucuugauagccugaaggcuucuuuuguggaauugggguaagaaauaacagcuuauaguuugcuaaaaggcauauaaaguuuuuagauuggauuuauagaguacauauuuuaagucuaaaagaguugacaugcacaccaauucucuugguuuugaaacuuaaggguuuuuuuguguauuuuaguuuguuucuugguuuugcuuauuuguucauucuuaauauuuuauaaucaauacauuguaauuuaaaaaguaggggaaagggugcagacauauguuuucuuugaagcaguuggagaaauaaaaugaaguacagauuugaagaaaauuuaguuucccagaacugaaaaaggagccccaagugaaagccagcuuguuuggcuccuguuuucacuguuugauuugcuuaguccugcucaucaucacaucaucuggcugcuaaaauaauuuuaucucagucuuuacugaaaacacacucaugcauuuguuaauaauaccaccuuucauuugcauaggcuucacagccaacauacccuuccguauagaugguuugaguugauuuuauuugauucuacaacaaccaugugacauacauaggacauguacugcuuccccaauuuuuauagaugcagaaaccaagacccacagaaguuguaauuuacccacuugacucuuaguccagugaucuuuccuuuuuccucauggagaaauuuguuucuucauaauuuuaacuugcaugcuauuaaaaagaguggaauuaucugucacaauugugaauucuuagagaaguuacaagugugauuucugaauaugcuaaaagauugugguuguauaaggaaggugacaucuuuuuuggagaaucuuaguuguuuguuucuauguuuuuugagacggagucucgcucugucaccaggcuagagugcaguggugcgaucucagcucacugcaaccucugccuccugcguucaagcaauucuccugccucagccuccugaguagcugggacuacaggugcgcaucaccaugcccagcuaauuuuuguguuuuuaguagagacaggguuucaccauguuggccaggauggucucgaucucuugaccucgugaucugcccaccuuauccucucaaagugcugggauuacaggcgugagccacugcgccuagccgagaaucuuaguuguaaccuauguaaccaaacaaaguaauuccauauguucugcaaauauuauuaucauuaauauuccuuauaaauaucguguuuuucaguucacuaguaagggacuguggcucucaauuuuaacacuguuuuuuuuuuuuucuucuagugcaaacccagccuaccaugaguuacuauuaacuguuuugugguaugguguuguccauacuucagcacucgugagguguacugcugcuagaauguuugagguaugucaacacaugccucuguugguuucaauuauaaugauuuuuuuuuuuuugcgaagaagaagggaauuuuuuuuaauaaaaaggcuuugcauaucauguuauguugauauauauuuuauggcuuugaacagugucugguuguguacugugugauggggcagaaauuuagcuuuaacauauuuaaaaauguuuucucagcuuacugguuccuugaauguuauucaauuaucacuuuuauuucucaaacuaucuuuuaaaucuuauuuuaauuucuaacuuauauaacucuuucugacuauacuuuuugauuuacugagguaaauaaacugaaacaacauaggauaucuuucaaguuguaaaauauaguugaauuuaucaguagcauuagaaaaucaauuauugaaauuauggaaauguuuauuuuauugguuacuccuacgucacuauucccuaacauuucauauguagaauaacaucccaauacauuaacugcccauagaguugcaaaagagaggagaccagguaauuuaccuaaauuguacuaaauugcuaccuacccaaguuaaguaugaaauugaaauaacuauguuuuguacccaucauauagcaaauuaugucauagcccuaguauguguguagguggggagcagugagguugagguuuagaacuuuauuugagcacuaaaauugguuuacuguuucuuauugauuuccagucuugcaauaaaucuaggcugccuugguucaguuuccaucucugcuaccuagugacuuuguaaauuacuuggacaagguugagccucucuguaccuuaguuuccucauguacaaaagaaaguugauaacaaaaaguaucugucucaaaguaucagucucaaaggauuuuuguuaauauuaaacuaauuaaugcuuguaaagcccuuaaaacagucucuggaacauaauaagugcuuauauguuuacugucauuaucauuauuuuuuccauccaugcuauuacuucacaaaauauaugauaguaauagggaacauauacuuauccaaacuaaaauugccccaauauucauguguuucuuaaaauaccuaaacauuuauuucuauaaaaagaauugguuaauucaaaucuugccgaauaucagaauuucuccacaauuuaagauaaauugcaauuggagaugggguacugauauauuuaaaauauaugcuuucuaaaauuuucaaauacguaaauuagauuugugaauuccagaaaauuccauuguuaucaggaaguugaaaauucuccauccauguuauucccucaguuaucauacagaagcaacuuuuaaaaagccguaaucagguuuuuugugaugaugaaugccaaagccacuauuugguuuuaugucuaguacaaguuccuucuggauauaaaucguuuugauuauucgauaugcugaaaagggggcauuaccaugaaagaaaagucauucaucagucucuccucuccccaaaaagaaaaaaguaucuuuuuaaaugaagagcuauuucuuuaauauacucucuuccuaugauuuuauucuaagcucauaaaagcuauuucuuuuucuuaaaucuuucaucucuaaaaugugagugugcacuggugaaucaaaccauguaaaugaaaauaaguaaauagaaugaauccucccuuuucacuuguuuugagguuuuuugcuuguuuuguuugguuuucugccuuauuauacguggcuuaugucugguuuugguuucucuguuugcugucagugcuggucuggaaacuauaucuaucuaugcuuaagcaguuuucaguguccucucagguuguugaugaacuucuggaucuuguuugagagacuauuucaauguuuuucaaauucauuaaugauacauuucaaugagcaugucaguaaaaguuaucaguaagagaaauuaaaguuccuuuuuugucagugguucuuauuugaacaaaauuguguuaaaagaauaaugggucauaagauuuauuuugauacugaugcuuuauaauuuagaauuaugccugcuuacccuaaaaaaguuaauucaaaauaaaaacauaaaaaaaacacauucuuuuuuuaaaagguaagaccagaaagaaaagaaaaugagaaaugagaagaaaaugaggcauacauauaccaggaaccuaauaggguauggucacugaaauucacuaauaaauugaguuuaauuuuuagacagcaggacaaaaagagggaacccaaucaaucauauuauucccauuguuaaauaagggaauauaaauuacuuuuugaaguagcaaauuaauaaaauuauuuuauaagaggaauuuaucauguuauaauaaauuucccaaaagaugcagaaaagagcuucauauauauuuuaaucauaaggaaauugaacauguaacauuagagcacaacucaaagaggucauggacuuuaagucagaugggacagaguuccuuugcaggcccugcaacuuagacuuggacaaguuacuuuccgaagccucaguuucuucaucuguuaaaauauugaugauauuuguacuuacuucaucaagugaaaagaucaaaugauauauuguguuaaaguguauaacaauugauagcucuuaaauguacuuugugauuuucuagcuuaauaaagaaauugaacuuaaaaacccuacaccaaugaaaaauuaauuuguccucuacauuaccucuuuuuuaaugcuuuugacagacucaagauagcagaaauuucaagaugcugauucaaaucuaagcaaucuuacuuauaaaaugauacagagaagaaaguuuuauuuaacaauauuugaacuuccuuguccuauuucuuucuauccaauaucuguaauguuuaagauauuaaaaguucuuugucauuuuauuccugguuaauuaucuguuuuuuuauaaaaauuauuucagaauauugaaguagauucuaaaaugaaucaauugguaaauggugaaaaaucauugcaaaauuaagaaucuucacauaaagugaguuacuuucucugauguguuauauaggaggaauaccuucacauauguacacaaugguagauuuuuguuacaaaaaauucugugacaucuuugaucuucugugaggacuaaguacuagcuacuagguaaacagauuggugagcauuuaggauuaauaugugcuuacauucugaaauugagaaggggauugcccuucucgguugaacucauaaaauucaguaauauuuaucaaacaaaauguauacggcucaguauuguucucuuguauugcaauuuagcauugguugcuaaaugaauuguuuugugauuagauuauagagaucuaguucuacucaucuuuuuuauuuuacauuuuauuugaauuuauaagaaaucuaaaacaaagaccuauuuagauauuaacugaaguuuuuuaaauuagaucauuucuuccaaacauauuacaaaucauauauucuugcaguaaucaaaauaauuaaacucucauuucuugaaugccuguuugucaggcacaguauuuagguauguuauuugcaaauucauagcacaacagcccuuugagguagauaauaauaucaccauuuucagaugagaaaacuugcguuucaagagguuauggaaaauacuauguaucuaagaccacauggcuuauauguggagaacugacgucugaacccagaucugauucccaaguguaauacuuuccaauaggcagccuuauaucucuguaccucaaaagagaaggcuauauuauuuaaaagauuaggaauuguccuauaugguuuuaaaauacacuugcuauagcacaauaauaagugguuuaguggugacugcuacuccugugaguuugguuuaaaaacagcccaguuuguacccuguuggucaugauaaaagcauaccacccuuacuuugagaauuuuaaccauagagcacaauaugugucaaacaagcuaaaaaaguauucuuuucaguugcauuuugauggacauugaaauugcuuagacucuuugaccaaaaguacaaacugcuguuaaacuggugacaaaaucuguuuucauggacgcuaggcuacuuaagcuuuauuuuccuccuaagcauucucugccuuuguaaagcacucuagcagcaguauuugcuuagcuucuaauuuugguuuugcuuuuguguuuucucucuuucucuugguuguuccuuccuucuucccguggcgcacuguguuugcucuuuccgugcaucaccugugaauacccccugugcugaccaaucagcuguuggugaagggggugaaugaaacucugguagcucagaggguuguuccugcucucauuacucucuccagugacccugaaauguaagugucaucccugccuuuuauauucggcaucccuuucaaaaugugccugucaagaaauaaccaucagcucuuaaauuuauugaagaaucucuuuaaauuaauaauacuggauuaugcuuauuugauuuuaaacuuuaucacauuauucuuuauauaucaugguucuuuuuaaaucaacccucaccauaaguguaauuuggaggccacguauugaaaaaauauauuaguaacauuagugcucaauaaauacuuccagaaccuaaaauaugcugauggacuguuucuuucaagccaagaagggaugcucuccuaaucucacuaacagguuguuaccaguaaguguaguagcaugaaccaauggccuaacauuuuaaugucucguguggaugacuaaaccaagaaaggccaaugagucugccugcccauccucagucacagcuaacccaguucuuauuccaguuuaccaaaccauuuuuuauugcauguugacugguuuacagcugacucuucgaggcaugagugaagcguuaguugacaagcggguugcuccggcccuuguuaccuuguccagugauccugaauugugaguuucacagacugcgaccuuaaguuauccugucugucuuuuugagcauucuucuuggucugcuuuuuuuaaauuuauuuaauuugucauugcuagagacuaauacaguauauuuaccuuguacuuacuuuaauauacauuuuaauaauacucguuguucaucucaaaucuucaguuucuuucuguuuuaauucuaacagcucugucaggauugccacaauuccagccuuuggcacuauuauggaaacaguaauucaaagagagguaggaauaauugaaauuuauuuaugucuguguaauauugauguggucaugauacauguaucuggugguaggcugcagggagcaucuuaccuuuuauuuugugcccuaguuaguuacaggccagaggaggaucucacugugaaaacaugguagccuaaccaagguauauuuccauauccuaaggaaaucucuagucuuuccucucagucagaacauuaaguauaggccaagcuuucagggauguccaagggagagaauauagucauggguucuuaguuucucuuucugauugggccaguaaagccccuuccucuucccucuuuucuacuuaucacuagagacagaaacuaaaaaccccggcuucaggcugcuaaaagccuuaaacaaaacaaaacagaacaacaacaaaauaagguguauuggacaagcuugcuagauguucuauuguaagcugagcuggauguugcaguuuugaauaauccuucaaaucaggucuaguuccaaagccuucuauuacccgguaggcuucuggccaaucuacauaaauucuugauugccaguguugcacagauuugaggacuguuuucccagauaacaucauuaggaacacaaauguaucucaguuauaaaugaaggcaagagggcacuuguauucugauaacugugucauugguaugaagcuguaaaagugauuuaguagacugguauccucuuguugcagaguagaucucugggcagacccucugucaugccuguuucaggagaccaccaaggucuuccuucuuaaagguguauuuuaauucugaaacuaauuucaaguuuuuuagauucuauuugcaacacuaacuauaagacacuucucaaaauugauaucagauuuuuauuucuuuguuauuauauuggauauguccuuauacaaaugaaaaaacccuguagauuagcacauauauuauuuguggacauauuacccaaaagaaaaaaguuuuaauaaaacuccuuugucauauagauuuuucaugacaaaaacuaaaguuuuguuaguuacagaaagaauauuuuccauuuuuucacuuauauauuucacuggugaagccacagaggaaaagcacaucauucugcaaagcuugcagucuuggcagaauuucaacauguucucaaaaccuaaaauaaaaaugucuuuuagggaaaugugaguaagauguaagucauuaaugacucauugcuuucagaaggugaauaauuggguaacuuacagugugauuuguuuuaagaauuauaauuuagauacaaaauaaucauaaaguuaccuacuuuucccuaaauacggugggauuuuuuuucuuuuguuguuauaauuuguucaggaauauuuguauuuuuuaauuaagaauuuguaagcauaagcaaaaguaggaaaccuucucugagccaaaagauuaaauaacuauuuauuuaauuccaaauuucuacugucauuggacuauagguugcuuuaauccacugcuuuaagucauguuuaaugugugucuuucacuuuaacaacacuacucaguuuucaauauucuaugaaaugacuguacaauauccaauuuuaaguugcuggaaagagugaaaaugcaguuggcuucuuuccuggaagauccucaguaucaagaccaacauucuuugcauacagagaucauaaaaacauuugguagaguuggcccuaacgcagaacccagguuccgagaugaguguaaguugcauuuuucuaccuuuuuccugaauuguaauguaagaucaaagcuagacacuccucugaggccuugucauguauuaaaauuuuggugcauuugucauguguuaaagccuuguguacugaaagccuuguguacucuuguguacugaaagcuaaacaugaaacaaguuaguuauugugaauuaaucaguauugauauuaguggaugguuuuguauuauuuuguuuugagacagagucucgcucugucacccaagcuggagugcaauggcaugaucucagcucacugcaaccucugccuccuggguacaagugauucuccugccucagccucccaaguaguugggauuacaggugcccaccaccaugcccggcuaauuuuuguauuuuucguagagacgggguuuugccauguuggccaggcuggucuccagcuccugaucucaggugaucugccugccucagccucccaaaguguugggauuacaggcgugaaccaccgcacccgcccuaguggauggucuuauacuguauaaguauacagauggucuuauacuguauacugauugcuguaagacauaugaagaguaacucaaacuuaauuucaaguuauuuuagaaauauuucuuaauaacugcuaauugcuaaauacugugcugccuuagaguuuauuuuuuauuuuuaaggaaauuuuuguguguuucuagacauguucuuaugaaaaacagacauuucuuccacuuagcaugccauucagcacgauacauaacuuuguuuuaauucauagcuuguugaucugcuacaugaucuuccacaauugucugccuuuuuucucuagauuuuacagagucucuuuuacugugggccucaacauuuauggccacaauuucuuuggauagcaucaaagcauuaagaacuuaugacuccaaaagcauaucaguuaucauagcucuuuuauuuuuagcaauuugacaugcucuagagagggccacaaguugggucacuuaaaucaguuuaguuucuaguacauuauuuuauucuccggcagacuguuacauauccaggcuggcauaugacucuuuaagauaagagucaucaacaaaaaauacuaagucaggauuuggacugcaguguccaaaaaaucgauugaaggcaugcacacugaucaaacuauagaaacacagucaugacauuuuuuuucacuagguaagugucuuuauaauuagccaacuaacagaagaaaguugauauuuuaguuagcacuagggauaguuccacauguugcagugucaaauuuacaggugauucuagguaggaacucugaaggugcuuugacuuuucgaggcuguaguugcucugaggcaaggagaccaacucuuggcugcuggauuaaaggauaggcucaacaggcaaugggucuuuggugugugccauguugucaaguuaaauggguauuugauauguugucauguuaaacgggucuuuggugugugcaguguuguugcauuaaauggguccuugcugugugccgugucauauaguuaaaacuuuucuagagcaugauuugaccuuucuauguauauucaaaagaaagacucaugauaaucugggaagaauccaucuggauucuuauaggaucugcuccaauuauuuuguugauucuucggaaucuuuuuucaguaauucugggacuauaguuauuuuucaaauuaaacauagugucaauaucuuaauuucucuuucuagaauuuucaagaauaucuaaaaauaacccuuccauuuuauuugacaguuuuauuguagaauagauaccuaccuaucaaauuuguaggaguuguucaagaggaaaaaaugaauuuucuucucauaauggcccccaaauaacaauuaaagguuguuuugggaacagauugaggugagaaauucccacugcuugaauaguucuaguaaaccauuauccuuaaagccuccugcaacuuacuguguacccacaaguaugucuuauacagucuucuuucacauuuugguacaaccagauuuuuuuaagauaaaaauuagccuuuuuuuccaccuuuguacuuacuucccagucaaguggcuucucuuuugcuuuagaacuuacccugaggaauuuaguacucuauauuaauaagauaaauauugaaguagaaccuguaugaagaaugcgauaguguuauuccuaaguauuuauagacaauuggcuuugggaguuuggaggauggacagagaauuucugggugguaacgucucccuuggaguggcauuuuggguauuuagguauuugccccucuauuucuuggcuaauagaggacauuaguucuuucaguggcccuuguucuuucccaauuguuaguuaucacaggaccuuuggucuuguuuuuauuuuuaggaaccaguuguuuuaucuggaacaccguagaguuguuuuuuguuuucagcuauuuuacuuaguaagacucucugaaaauguucagucguacauuggagauuuucugaaguggcaauuuuccauuucugauuuuuuccccuaaguuucuuguuugaggucugggcccauuuauucaaacaaacaaacaaaaauaggacaagauucccuuuaugacuauuggaucuaccccagaauauuuuugaacguuuucugauauacaguuuuuuguuuguuuguuuguuuguuuguuuguuguuucugaggcagagucuugcucugucacccaggcuggaguacagugaugccaucucagcucacugcaaccugcgccucccugguucaagugauucuccugccucagccucccgaguagcugggauuacaggcaugcaccaccacauccggcuaauuuucugcgaaauacgguuuuauaaaaucuccuauuauccuuuuuucauuuacaauuuuaaauccuuguucaaucugcccuaaagaaaaaggcuucugcagugacuuuauguuauguauuuccucuuuuucuuucccacugaaggucaguuuuagaauuagccugucuaagucaggcauggugccacgugucuauagucccaccuacucagaagcugaggugggaggaucacuugaggccaggaguucaacaccagccugagcaacacagcaagauaagucccuacaaaagauguuuaaaaauuagcuaggcaugguggcacguaucuguaguccaucaacucgggaggccaaggcaggaagaucacuugaguccaaguguuugaggcuguggugcacuaugauugcaccugugaauagucauugcauuccagcccaagcaacagagcaagaccccaucucuuaauaaaaaagaaagaaugauauccaucuggguuauuauuaaaucaucuccugguccuucaucuccuacugcuuuuaaccaucugucuacaucugagggguuaacuguuaagugaauuaauuaauacauaugugguaccccaggacaauauguguguagugaaaucugaauucuauaguaaaguucugucugucuuccugagaauuaggaagauccuuaauuagaggcuuuaacuuccuugagacuacaguuuaaaugaacuucuauagauuucuucuagucaagcaauuuuaaggggauauuaugcagugugauuguugcauuucugagaaaaaccuuguaaaaaggucagagacucaggagaagaugaaauaaaggaaccauauaugaauagauaaagugaaagaaugauaaguuucugaauguuugggcagaaaugaacuagugagucuuugagagagacuuagagucacuauuuuguugaggccucagcgugccaauuaaugaagcuuucaacugaauguuuggaguuuuuguuuccuaauuuguucuagagcuccucauaaauauacuguuauuaauuuugacaagucaaaagguccccuaaaaaugaucauuguuauucugaguuuuugugggguuuuacuaagcuaagcaugaaaguugugauuauugccccagcuuauuuaggaugcaggaguuuuuccaguagaagauuaugacuuuauauacacaaacucagugcaaacaagaaaggggucacuacaguuggucagcaguugaugcuuauggguggcguuuugugauccucaaccaagcagagacuagaaagggguugugugauuggucuugugauuaacaauuuaacaaucacugacccugaagccauuucuucaaagagcccugguuuuagugggaaaugguacccagaaaacacaaucuuaggcucuagaggugcucauugcuacugaauugguuuuuguuucuuggaccauugcuuuuauuuagcaguagguugaaauuuuauguuacucuuugaggguauuaaacucauugaauaacuugaaaacucagccgccagugcuguuugacauuggucuuugcuaagaauuugagaaacuaaagcugauaauaguauucugaaggagugaaauaauagguuguugaaaaagaauauacucuuuugauuucauagcaaugguaauauuuuauuuuuauggagaaacuuaacugcaaguauaaauaauacaagagguauguuguuuauaauuauuugggcuucauuuuucaaacugggaaacugaauuacagugaggccaaauaaucuauauacauccucauaauuagguaauagugacaguacuaaaauuuguuucccccaaaugccagaucacuuuuuauuuugaaaaacuacuuucuucccuaguuaagaaaaagcaaguauaagauauggguaaucuuuugaagucauucagaauuaaaaugaaauuucauaaauuaaagugauaaauuauuguuaaagugugucaggguuuuguaugcauguuuuggguaaaaauuuaacccuuuuuuuucuguuuucaguuguuauaccacauuugcauaaguuagccuuggugaacaacuuacagauuguggauucuaaaagacuggacauugcuacgcaucuuuuugaagccuacagugcacuuuccuguuguuguauccuuguuuuauuaagguguaucuacauuuauguaaccaaucuuagaguggaacuugguugguaaagauugaaaaguagaacuucuuuucuucaacuuacauuaagcguuguagaaaauugaagauuugauuugucucacuccacuccuucuucuagccaucucauaauuuuaaaagauaaguuuaaguccucugugcuuuuauguucuauaguuuugagaauuuugaugaaguucuuaaccugaaguuuuuauuuauauuaguuagcuacauaacugagcaagaaauaaagggcagaaagaauuacagcugagacuucuguuaaucaaaaggaagccuuguauauaugacuuggcauuuagguuuuucagugaauguuuaacucucaguauccaguggaauauuaugaguaucucuuagagagauaucacacauuggacaaguacagggccaacaaagcuaaugaucuccagugauuguagaacugggagaaaacuuagagaucauguagguccaugucagugacuguaaaugauuaaacuaaggcuuaaagacaugaaugccuucuguuuuuuauaguuaaaagcaaaacugugacuggaacaaagaacuuuagccauucuguuaaauguucuguuuacuauccuaugccuauaaaauaaaacuaagaaggaaguaaagauaacgaugggcaaagugaacucccaacuuuuaggcucuuuuauuuaaaaggcagaaggguugaagaaaggggaaaugagagauugaaaaaagagugaaaggcuaaaugcuaaaguacaugcuaaacaaaaaacagagaacaaaggaagaguuucaggauuauuauaugugguucacauuguuauauaccagucugaugaguuugauguaauaagcaacaugaacagguaauuuuaaaugagauaaauaugccauaaaauauuacuaacagucauugacacuggauucuggacuagaauguaccaauaagaaguuauuuuuguucagaauaaaccaaauagagaaaguagaaaaguagagcuaucugugaaguagcuaugugucuuuggaaauacuaaaacugaaaguuggaugcaugguucagagcaguuuauguuggaaaucuauuacaaauggccuaaucgugaggaggauaugagccauguuuuuuaaaauauagauggcaccauauuuuaauaauuuaauaauuuuguaaccucaacuauucaugucuucuauaaguuuaguuccacuaaaagcagaacuuaucauucuugauuucuuguuggcauuuucaauuuagggaagauagaggaagcaaaaagaggaacugauauucugaauuagcaaguaagaauucuuuaguauuggagaagugauaggacccuugcaagaaagcaacaguggugcaucgcagaguuuguaucucaaagaaagaaaacauugguguguuuaauuggacuuugugaaaauaauauuuaaaacuuacacaaaacguuauguauaaucuuauauagcagagaguuucuaaaggaauaugccucaaggaaaaugggaaaguuaaaagauccaaauguuuggcucuguaaaaccaaauuuuccaaguagggaaggcagugguuuccaaagggcauagaaaucuauauaaaaggaauauuauuguguguuuagacaugcauagaauaucacuagaguaaauacaguaaaaaggcgacauaccaauaugguaaggggaagaaccaucuuaacaacagucccuguucaaguacuaaaaguguuaguucuacaugagucagaacuuguacuugagucaacagugcuguggccccuaauaaaaucacauuguucuaaucuguucuguuccauuguauucuaagcugaucagaagagugcuccuuuuagccuaccaucauguuuuaauacagacauuagaaaaacuauaguguauaacauuuuggcauaauaauaagucgagaagucauguuuaaggaaaguuugaaggaauuuaggaauguuuaaccuggagaagagauggcuuggggaugaaaagauauuuuaaagguuuuuagguagaaggaugaugaggcacacugugcagcuaagguacagagcuaauacuaacaagcagagauaacagaggcugauuucuuuuauaagaaaaacuuccuaauugagcuaucuaaaaugcagugaucucccuuaauaaacuaagaaucuucuuucauuguuagcagucagaggcuaaccaucauucaccagugagguaaagguguuuccuaauaucugauggaacuaauuaccuuuaacuuucgaauccuugagaaagauugauccauagggaaaagguaggcccccaacagagaguagaaagaggaaaagaaaagugacuucccucuucuaaguagggccauauucagcuucucauuccaugcccauauuucucuagaucagacucuuaaacuacuaauucaaaggucauucacaguuauauuuuggugccacuuauccccauaucuagaaagcaagacuacauaaucauuagguuguagcccucuauaugucuauagggauuugguuugaccaaaugauguuuauauuuuuaauaccuguuaaauuuauaaaucacucauuauaggauccaugucugugaacaauuuuuauuuauaacuguauuuucaaagcaguaguuacacugauuuuuuucuuagugaaauucauuuuuucaacuaagucaucuuuauaagggaacucauuuaagucaucuaauuuaaucaucuuuauggccgggcacgguggcucacgccuguaaucccagcacuuugggaggccaaggcgggcagaucaccugaggucagggguucgagaccagccgaacauggugaaaccccaucucuacuaaaaauauaaaaaauuagcuggauguggugccgugcaccuguaaucccagcuacuugggaggcugaggcaggagaaucacuugaacccaggaggcggagguugcagugagccaagauugugccacugcacuccagccugcgugagaagagcaaaaaauucuguuaaaaaaaaauaucuuuauaagggaacucacuuacuggcuuuuuuguggugugauauuaaauaggagcuagcuuuacaggcuagaauaaagggagaauguaucagaauugacgggaaugaacaagaugaauuguuuucuggagaaaguuuuccugauaccuuuuaaugucaagauaaucaacuaaaacucaaagaugacugagaacuacaaguaauccuaaacuuaacaaaugcucuuauuacaguaaaagcucuguuauccaacucaaucaggaccuauaguaggucaguuuaacaggaugguuaaagcaagaaaucaggaaaaugguaucuaccuuagauaacuuauuuuaacuuaaaauguauauauguuauuuucuuuuaccggucuuuugauauaggcaucucuuuugugugaaucuguugauuauaguuaaacaucuucuuucucagguaaaucacaucuguaaugcaguugucuaugauuugcagguuaaaguucuuuaaagaggauccagaaauauuucugauaugcacuauagaguuuuucuagauuuuuauauuuuucucaaucguuuacaauugucuuauacguaauaguuaaacagcaauguuuuaagcaauuugcauuuaucaguuuuucccaaaacuuucaacuuaguugucauggaaaacuuacuuuuuauacuuuuuucauauucauugaaacaucugauuggguuacaugacuuaauuguuacgcucacuuuauacauuuccaugacauucuguaauuuaaaugaugaauaccacugacauaaauagcuuugugugaauaaacacaauugacuccugauaaauaacuuacucugcaaaugaggauucaugcuugaggggagccuguuuacccugagugaucacuaugccauagguaugauauaagaaggcuucucuuuuauauguaguaacucgguuguucuguuggacauaccaauuugguuuuguuuaauucccuuaacuaccuugucccaagucauuucagaggauuuaaugguuaaucacuuuuuaccuggucucagauguuuacggacugacauggaacaucucucuccagagcaugaggugagccacugugauuaccagugccauauucauguuuuaauaccucauauauagacuugcagucuucucuaugugaggcuuaugauaugcuguaauuuuuuuaaaucuagcucaaugucauuuuaucgauuuauuuacuagaugcgauaucuucagcaacuccuuucacaucuuuaagccucucuuuaauugucuacaguagggauaauacacucuccuucacuuaauauaaugagacuuuaauaagauaauguaugugaaaauuuuuaacuauaaaauauuaguucucucugaccaucaacuuucuuaagugcaguuucuauuuuccaucuucauuucuucauaacuauuuuauuucauucuauuugucuccuguuuccccucguuuccuccaaaucccuguuuaucauuuauuuucuauucuguaucuucaaccuauuuuuccaucagcuuuuccuuuuacgauguuugacucuccacuccuaaauagcaaaaccuuccuuucaucccucuccaagucucuuauucuuccugaucauccacauuuacucucucaacuuuuacagugucuauugguacaucauauucccugcaucacacuaauccauugaaacugccaucuuuaagaucacucaugaccaagcugccacccugauaggacuuuuuuuuaguucuuauagcuucacgucucucugcagcauuuucugauucaaaacuccuguggcuccugggacuccacuucuauuccuguuuuuuucuuacuucucuagucaguucuucccaaucuccccuccuuucuuaccucaccuuuucauucauuagaauuacucuccaugaacaaguucauccauacucaucaucuaacuugccuuuacuauauguuaauaucacacaaguuucaucuucugcucuaaccccaugcuggagccauagaacuucauggcucacugccaucugucuauuccaccugcauguccuacaggcaucauuuaaaauucagcauggccaauccccucaaccagaauuacugucugucucccacuuuggcuaaugccauacugcuuucuccccaagucauauaucugauaguuaacauagaguauguccaauuaguucuuuaauuucauaaugucuuucuaaucucuuccguuucuuuauaccugugccacccuguuaguugaaucucauucaaugagauuauuguuaucucauugaaaccauuguagaauauccuaauuuuucuccaaucuuagcucucuacuguuguuucucacuacagccaaaguacuuuuccuaaaguauaaaucucuucguguuauucuccuauuaaaaacccuuuacaaguuucuuacauacaaggccuuuuaucaucugacaccuguucaucuugauaguuucauccugcgcccuuucuccuccaucacacacucugccccagccaugccaaacuaauucaucuccaccauauaacaucgucuuuucuuccaugccuuugccuauucucuucccucugucaaaagaaugccauuucauaaugcaaaguguagaauauacacucaaaggcuauauuacauaucuguuuguauuagucaggguucuccagagaagcaaaaccaaaaugauauauuaagagauuuauuuuaaggaauuggcuuaugcaguugagggggcuggcaaguccaaaauauguaggagagaccauaaggcagaacacucaggcaggaauugauguuucaggcuucaguccaaaauacggagggcaggcugauaacucaagcaguauuugaggcagauuccuucuucaggaaaccucacuuuuugcucauaaagccuucaacugcuugggugagaccuacccauauuuuuuagggcaauaaucuccuuuacuuagaauuaauuuauugugauguucaucacaucuacagaauaccuucacagcaaugccugggucacuguuugauuaaauaacugggugcuauauccuagccaaauugacacaaaagacuaugacuaucagucuuguuuaagaaacaguuauacugucacaaaguugaugggggaaaaaagaaggaaaaauuuuuaaaauaauaauaauuaaacuaacacccauguaauuacuaccuagcuuaagaaauagaaaauuaccaguaucuuaaaaguuccauauaugccccucccuaaucaugucccucucaugugcuccuccaaguuuaacacuugcccagaauuuuauauuuucauacuuuguuuuucuuauuguuuuaccacauauuuauuuaucccuaaacaacauauuguuuaauuuugcauauuucuccuauccuguauauauggaaucuccuguauguauucuuauaugauuugcuuuuuucacucauuuuguuuauaaauuucauucuuauugauauuugcaaaaguaguuauuuuauuguccuuacugaauaguauuccuuuguaugauuaugccauaguuuauccauucuucuuucugggaaaauaggugauauuuccaguauuuuguuauuauaaacagaauuacaagcaucuuaugaugcacauguacaaaaguuugucugugagauacaaacugggaguagaaucaacagauuguacaguguauacacuuucaguuuugccagcuaaugcuaaauuguuuuccaaaaugcuaacaauuuauaccccuauaggcaguguaugggaguacucuuuuaguucuuauguuugccaacacuugguauuguuaaacuuucuaauuuaguggauauaaaauuaccauuauguuucugauuugcauuucucuaauuacugucaaguuugagcauccuuugguaugcuuauugaugaguuguguucuucuauuaaagucuauuuagguuuucugccuauuuuucauuuaggcugucuuaaccguuacuuuuuggaaguucauuauauaucuggaauauaccaauacuuagucaauuuuauguuuuaugaauaucuguuuccaauuuaugacaugucuuuucauauuuuuggcaucuucgaacacugauucuuaauuuuuuaauagucagauuuauugaucauuuauaaaagacauuauuuccuauacuucugaaauuuuuuuaaauugacuuuauacaauaaaauuauuaauuuuacuagaauugguuuuuauguaugaugugagcuagcauuccaauuauauuucuuuuccuauauggacaaucuguuauuucaguauguuuuuugaaccguucauccuuuuugcacugauuggcaaugcugccucugucauacaugaaguuccaguguauguacgugccuguuauuggggaacauucuuucucacugguuucuuugucaauuauuauaaaaaugauauguugucuucauuacaguugucuuguuuaaaaguccagaaauucaguaggacaaguccagcauccuguccuuuuuuagaaauguuuugacuguucaugacccuuaccuuccucauauaaaguuuaguauuauauugacaaguuccaagaaggaucuuauuuagauucugauugaaauugaauugacucuguaaauuaauuuggggauucuucucuaugauugagucuugcuauauagaacaugcuauaucuuauauuuauuuagaucuccuuucaacacgcugggacuacaggcgugagccaccauccccagccugguguguuuuuuuuuuuuuuuucucuuucuuuuaaaguuaguuuugaauagggauuuaucaguuucauuaaucucaaauauugcacuuuuagcuguguugauuuuucccuacugcuuuuuuuuucuguuuuacuuauaucuguuuucaucuguauuuccuuuuauuuuguuuagguuuguuuuucuauuuuucuaacuucuugaggaggaagcuuagguuauuuuuaaacuuuucuucuuuucugauauaugaauuuaaggguuuuggcuuuuuguuuguuuuuuugagacagggucucacugucacccaugcuggaguacaguggugcuauuuuggcucacugcaaccucugccucccagugauccccccaccucagccuccugaguagcugggacuacaggcaugcaccaccaugccaagcuaauuuuuuguauuuuuaguagagacaggguuuugccacgcugcccaggcuggucucaaacucuuggguucaagcgauccacccaccuuggccucccacagugcugggauuacaggcuugagccaccaugcucagcuaugaauuuaagguuuuaaguauuguuuuagcuguaucccaugcauuugcuauauuuuaucuuuauuaucauuuaguucaaauuagaguuuuauuuccaguauuucauaacugacccaugggguuuguuuaauuggggggcagggggaauuaucuugugauauuuuuguuacugauuucuaucuuaacuacagucagagaacagucugauuucaguccuuugaaauuuguuacaguuauccuaaugacccagaauaugaucaauguggcauuugaaaagaauauacauucugucauuauuagguauauuguuuuauauauuucaauaaaauaagguuaguuaauuuuaugguuccauucuaucuuuguaucaguuuuuuugugaccugcuuguuucaucagcuguugaaagacgcguugaaaguuacaauuggcagccaggcgugguggcccacgccuguaaucccagcacuuugggaggcugaggcaggcagauaccugaggucaggaguucgagaccagccugaccaacauggagaaacccugucucuacuaaaaauacaaaauuagccaggugugguggugcaugcuuguaauuccagcuacuugggaggcugaggcaggagaaucauuugaacccaggagguggagguugcagugagccaagaucacgccauugcacuccagccugggcaacaagagcgaaacuccaucucaaaaaaaaaaaaguuaugauuggggauugucuacuuccccuuuuaguucuuuucaguuuugcuuuguauguuucuuagaugcccuuuaucagguugaggaaguuuccuucuauuccuaguuuuugaauguuuuuauuaugaagggauguuagauauugucaaauguuuucuucugcaucaauugagaugaucaugagguuguuuuuucuucuguugauacaguguauuacauuaauuuaucuuggaguacuaaaccaaccaugcauuccugggauaaaucccacuugguuauguugaauacuuccuuuuauauguagcuggauuaaguuugcuaguauuuuguugaggauccuugcuuccaggauaaaugcuaaaucuaaguccuuaggacagaacuuagaagaagcaagccuguuucaccgcaaauuucccuaccuccauuaggguauggugggacugaauaagaggaauaauuuaaagacuuuaaaaggaucagauucccagauucccuuugcaaccuugaagagagacuggagcuuuacucuguagacuugagauaucgggcauagcugaaaaccauacugaaaagagggaaaauaagugacagcuaguuaaugaugggacaccucauuacccuucaaaugcuggcugucagguuuauaccuacaggagaaaaaagaucaacagaaaguuagguuuuugccagauuuaacuuaaagugaagucuacugaugcauaaagagauucuaauccacauuuuggugcuccagucauuaguagacaucccaagauuaccagucauuuagaaaagccuagaauaccaaagauagagaugaaaauauagaagaaagaaggauacuggaggaaacagagacaaugcaaggaggauaaaaaaaaauacaaaaaauuccccuuaaaaaccaaaaagcaaaaaacuagccaaacaaacagaugcuauaaccugugagacaagagaguggggaagcagagaauacauucaaaaaagcguaaccuagaguuucccacaugaugcaugauaaaaguuucauucucucagaauaauccccaaaguccuuaucauaaucucaaggcacuauaggaucuggcccucucuucuaguacaucuaagacuucaucuucuauccugucucccuugcucacccugcaccaacucugucuucuuuccuuaggacauggcaggucuagucacaccucacagccuuugagcagccucuuccuagcaucugcagcauuuauuccuccaucuccuucauguuuuuacuuaaacauuaucaucuccaugaagccuacccugaacacuuccaugugaauuguaccguucuccacuuuggccuuccuaguaccccuuaucuuacucaauguuuuuucuaaaacccuuaucacuuucuaauacacuacauaauuuaccugcuuuuuguguaucugucucucuuacuagaacauaagcuccacaaguagggaauauugucuguuuuauuugcuuuauccccccccgucuaaaaagauaccuagcccguaguagguagacaauaaauauuuuuuuagggaccuccaugcccaaacaugggccaagaauauucagaagagccauucauuuucuggugugguugccagauauuagagcagcaguuuaguucucucuaaccuuucuaucacucacucagucucccugcaggaaucguguuaacuuuuacacacccagcauaucccucauuauauuuuaauagccauggugcuguaccuagucucagcucuagacauuaaaauaagggaucuugcuuuuugcaaccuggagaaagcaaaggggcguagaacaggacagcuuuuacugggaaaauaugugugugaccauaguguguguguauguuaaauauauagauguauauaaauuuuacuuuuaacauuagaagauggugaguaagcuaagggagaauagaaaacauuuagaaagaagacuagugaaaaucaaaauaaauuauuguuauaugauugagauuuuuuaaagcuacuucugaaccuagucuagcaaucuaauaugaauuccuuuaacaaaguaacugccaaaacuaaauuuuuaauuaacauauuagcuuauaggaauauuaaaaauuaaaacauuagauuaaaccauaguauuuuacuauguaaacuguauuucacuaagguaaauuuuuuuaaucagguuauuuuaaguuccaugauaaaagaaugugaacaaaaaguugaaaacaagaccguccaagagccucaaggguaagacauuaauucuuuuuuuaaggcuacauguuaacuuuaauuuuucuaucuaaauuugcugucaaucaguguaaugugucauuuuguguuacguuauaguccuuuguuuggaagacaagaaaaugauuuaagucauugguucucaaauccugguccauaaacuaucucaucagaauuaucuggggaauuuaaaauucaggucuccaccccaugcccugcgccuucucucaauauucucagucagccuagggaucugcauguuuaaaagcuuccaacaaaauucuuuuauguagcuggguuguucacucaccagucaaaagaaugucuagaaacuugugacaggaguuguaagaugaacaacguacugcauaaaggacuaucaacuugggaauguucuagucacaugcuucuaaucaaacuaauuggaauccaaggauucaguaaaauuaaaauauaagcauagacgugaaagaguauuauaacguuggaguuucaggagugggaguuauuuacaaaugagcuguacguacucuuacugaaauaaccuugagcaucuuaaguggacucuauuagacauaaaaagcucaaaaguacuuuuuuuaaggcuaacuacugggaauaaguguuucauccuaucagucuagaaacacacacacacucacgcauacgcuccucccuauuccccaugugcaacacgcauauaucuuugauguguuagaacccuuacuuuauaaagccucuuagaauggaagcagucuucuccauauauauccauuuuaaccacagaggauuaaaacaauagacacauucacaucuucuauauuauuagugguuuuuuauagagguuuuuuacagguuuuucuaacaaacacaaaaauaaacugaaaauauaaugaauuucuauacauguuauaacuguaacccagcuucaauuucauccauaccugaccuacuucucccucccauucucugauauguaucuuuuaaagauaaguauuauuuaaaaaaacauaaacacaauaucauuaucacaccaacauaacaauaacaacuuaauaucaucaacugucuggcuuuuguucaaauuucuccuuguuucauaaaugucagugauuuguuguuugucuuccuuaguuuguuucuuugagucaggguccaaaugaguucuguacauuguaguugguugcuauguugucuccuucaauccauagauagaaugucacccuuuuauuccuuuuuucuccauacaauuuacuuauugaagaaacugagucauuuguccuauagaguuucccacagucugaauuuuggugauugcauuucucuucugucuuuuaacauguucuucucuauuucuuguauauuugguagcugggucuagaucuagagacuuaaucagauucacggcaagcuucuguucuccucagguuuuuacacauaugauuccgucugccaggaguauucuuacucugccuggcuaguuccuacucauccuucaggacagagcuuagauguugccucuucagggaagccuuccuugaccccacccuuccucugaagucuauuguagaucaaaagcacaagaggaaaguauuuuacuugaagcagugaaaggaacugcuucuaagauggaaggaaaagcaagagugggugcagauaaagauaucuguaucugugaagagcucugccuuuuguuguggggaauacaaagauguugcauauauggauuucaccuucaaagagccugugguuaaaagcaguauuuuucaaacugcagaucauugacguuaguacauuguuuaauuaauucaauugguugugacacguauuucaucccgagaaauagaaucaaauggagaguacaucccaagugguaaagaugagucuuucuuaugaaacaucaguuaccuguguaaguacuacaagucaucauguaaaauguggcacuuacuauggaucugugucagaaaaguuugaaaagcacugaucugcaggcagaaaauguaugcauaacuauuuugguacccuucuuauauucauucagcaguaaguaaaauucagagugcuuaccaugggcuguucacaaagaugagcuugagcaagucauagucucuucccucgggguauucacagcugaaagugggaaaaagaagcaguuaaaaauaaagauaaacacuaaaacaaugccugcaaaugguuccaaggauaaaggaauacaggagucuucagauaugaauggcugacuagggaggaaaaaaggaagagcaaaagaggauuacaugcagaaaaaucagcacugugcaaaaugacaaaaguuacagaggagcguguuugggaacuguaaguaaagcuagaguacagaguacaugugggagaaugguagagauaaguauauaaagguaggcaggcaccagacaauaaagaauucugugugccacacugggagauuuggacuuuauguuauaggccaggugguggcaaacuuuuuuguagagauaguaaauauuauuuuaaacuuuggagaccauacaaucucugucacagcuacugagcuagacucugcuauuguagcaggaaagcagccuuuggcaauauguaaauaaaugugcaugguuguguuucaguaaaacuuuauuuauaaaaacagcaggcuagauuuggccugcuaccuguagccaauacuuaggaacuuugguugucuagcguuaguguccaucagaaucaccuggaaauugcugaguaccauccccagaguuuuugauucagaagauuggaguggagucugagaauuuguauugguaacaaguucccagguggugcuaaugcugcaggucuaggaaccacaccuugagaaucacugcuuuaggaaccagacucuagugaauagagaaguggguggaagagaugagaaagcuguuacaggaacccaugauaagaugaaguguggucuuggaugggaaaguaacaauaaguaaugcuuaugaaccagauaccauucuaaacauuuuucauauauuugcuaauaauugucauacuaagccuacaaaguagauacuuuuacuauucucauuuuacagaugacagagaggcagguaaguugcucagaggccaccuagcuacuaaguggaggaaccagaacccaggcauuacgguccuugagaccgugacuugaaccaccauguuauaaugccaguguauggcagugaauaugagaagauggauuugagauccguauuucagaugugaacucaauuuaacuuggcagcugauuaagagugaaggagaacagaaucaaaagauuccuacauuucugaucugaacauuuaaacggaugaugauaaaauacaacaaaauggaacuauaggaagaacuauucugaagaggaauauuuaaaaugugaggcacagguagagaaacacuauaggcaguucauugagauuuaagaaccauuagcagcauaugggugguaauuaaaggcuuaugguuggagcagugguagauaaaugauaucacuugaaaagggggcucugauggggagaaggugaccaggcauggaauuagacaccaacauuucagaugcauauggaagaacuuaacugagaaauagaaggcaaaccagaaugguguuagaaaucaaguggagauuuuauuuuuguuuuuguuuuuguuuuuuucaagauagagucucacucugucucccaggcuggagugcaguggcaccaucucggcucacugcaaccuccgccucccagguuuaagcaauucuccugccuuagccucccucccgaguagcugggauuacaggcgugcaccaucaugcccagcuaauuaauguauuuuuacuagagaggggguuucaccaugucggccaggcuggucucaaacuccugaccucaagugaucuacccgucuugaccucccaaagugcugggauuacagcugugagccgcugugccuggcccaaauggagauuuuaaagagaagaaaagagauaaguaauauaggacaugaauaguuuuaaagaagauagggauauuaguugcaaagaaaagaucugagauuugcuugaaaacuuccagugaggauacacauuacaagguagcccauuucauuuuaauaacucuuuuuaaaaaauuaucuuuuccuggauuaaaaucucccuuuccaaaaugccuaggcccucuaaaacaagucuuuaucaucugguagaggggugggagaguguuacaaaccccuuuauaaaacugauaaaaauuuacacugugucuuggggugggggcggaauugcuguaaugcaaugauuuuuuuuuuuuaacugaaaagcuuuguaguauagaccugggccuccuaccucagauggaaagaaucagaaguacuggauuaggccuagggaucugcauuuucagaaguuuuccaggugacuaugauguguaucaguagaccuacgcagauauauacaccccugcagauauacauuauauauccaguuuuucacauaugauguaugcagguauugguuaagucaccuaaaucuucuucaagccaaauauucuucauuccuuucauuuuuaccucuuauaguuuccagacuccuuaacaucaugguuggccuccucuuagaauaucauuaaaacuugguaucucaacuauggucugacccauacauccccuuuuucuagauguaaauuuaaaucauacuuaucuuuugacuuacacugaguuuucuaaagaaaggaagagcacugaaaagcuagaauguuaaggaaaggcaccauaggacuucagcugggcuuugaaagauggguaggcaguggauagaaagauuugagagugguugaacaauagacuggacaaaccugacugaagggggucaaagagacagucagugacagugguauggaaaaacaagaaauagauugcuacauuuccugaaugcaaagcacauuucaucuuguaggugguauguaagcauuaaagauuuuugagcuaagaugugauaucaagaagugacuuuuagaaguuaaucugguaauuaaagauggaagacuguuggaaucacugaguugugaaguauuagccauggaaguaaaaagaaacaguagaggagaugcuucaaagaauaaggucacaggacuugugauugguuugaaauagaaguagaaggagcuauuaaauucacuguuagaaagagaggaaaauaguagaaccacuggcaaaaagaggggggaguuaaaauggagaguuauuucuaaaguuagggcgugaacagaagcuugagauguuggcuuuaucuagcaaauaauaguaaugugggacugacccucaggaaaagggaugcgauucaauuugaaacuuggagaguaaguuuuauaauugaagaaucaagagccaaauacugaaccuuagggaagauuacuuugugggaagagaagcagcaggaaagagaacccacuguuguacugucagaagagcaauguggagaagcuuuucaaggugggaguucugguuugguuuuuaacuugaguaauucacagugcacacccuuauagacuacauagacccaggugugcuccguggcagcacacaccucaugcaguagauucaacagacauguugagcaccugcagcuugccacacguugucuuugacauguucaaacacauuaucuuacuuaauccucagaauauuuuacaacagaaauugcaagcuguguuuuacagaugaggaaacugagucagagagagcuaaagcauguuggccaaaggcacaaggcaauaaacuagauuccaagucuauuacaggacaguugucaggucauugaaaaauugugcuugaucaguauucuguuucuguucaguacuaugauaaauuagcaaucuuuagaggucauuuagauuguguuuauucccuacagagcagguuggugaaaaagaaagaagaaauggacucgaaacuguugauugaaaucaaugcaacuggcaauucaggacaucccccaaaaaaggaauaucccccuaaaaaggaauauaccauaggauuauuaucagcacagcacaaaacuucauugcaauuuaauuuacucauuugugaaaauacugauaauauuuaucuuccaggauugcuguaagaauuaaaugaagugauaaagaauaacuacuaacaauuacaucaugcuauuaugugccuagcacuauacugagcacuuuacaguuguguuaauauaauccuaauaacccuaggaggcaaauacuagaaucauccucguuuuacagaugagauuaaauaauuuacccgagcugguaaacagagccaagauucaguccagucccagacuuguuccuaaccacuacacauacugcuuccuuuacuauagauaaugaacaugaaagcuccuaaccuaguauggcauauacaaacuacccuccauaaauauuaguuucccuuuugugacgccaauucagaguguguucguuaaugauaugcuacuaaauaaaugaaaaauuuuuauuuuuuuaauugcuuuacaugaauuuuaaauuuucuuuccuagcucaaugucaauugcugcaagcuuagugagugaagauacaaagaccaaguuuuugaacaaaaugggccaguugacaacaucaggugccauguuggccaauguauuucagagaaagaaguagaagcaggaaagaagcccccaguaaacacuaagauggaccucaagccgacugguuccuuguacuugaaguacuugccuuuuuuguuuccucaguuuuauguucuugcauuauaauuuuauccuaaccuccaaagauauuugcacugcuuuuaauuacugcuguauauuuguugauuuuggaguuacaacuguggugauagaaaauugaguugauggucuguaccaagucccuugucuauguucuugucuuucagaauaauuuuuauauaaauauauauauagugaagaaguuuuuuuuaauuuuuggaugggauauucgcaaauaucuguauuauacacuaagcuauuacaaugguacuuaaaauaauguaaauuugaagucauuguuauaaaauaauaaaguggagauuacuuaaguauuuaaauuaugaaagaauaaugcagacuuuuuauuguuucuuaacugacuagaaagagccaccagcauuacucugugccuuuuggacaucaguuuguguguucuguaggaauugugugcauuccauucacacaguauuucuuuaggaugcugugaugauuugaauuacaaauccuacagucaauagcuaaagacgaaaccuucauuucagaacucucaugaauauucuuuaagugcuauuuaaaccuccccagcacuuagaugcauauaauggacuuaccugaggaaagacagcacauaggcauggggagagguaaccaaggugaauuuuacaaacugguguauaguagauuuaaaugcucaaaaauaaauguaacugagaagaguuaauaauugugagauuuuucccaaauugagauacagaagaaaauauaguuugaaucugaaauuuaacacuuauuuauguaaaacacuuuauuuaagauauuuucuaaugauuuuaauuuuagagaguaccuuuucauucuguguguuacagagaaguacugaaaaguuaaggacacuugggggcuacuuuuuucccucuaaacuaaaaaagacauuggcugaauuauaacuaguuaguuaucaccucgucccuuaaagucagugaccuccuguguuugauguauauuacauagagucuuaagucaguguacaguuccacuggaauuugacaguugucucuacagucaugcaacucgaaguagaaaagagugcuggacauaggaagggggugcuugguuugagggguuaaugugaggccuuuuugaaaaaugaauauuuugauaaaaagaauucuuguuuuagcacaguugaugcacauaagugauucucauauuuguuguauaaacugguuuaauacauuuggaacauaguuggauuacauucauuuccugggaaagcuagcuuaccauacauucaaguuuauaaaacaauuugccauaggcaaagccauuuaaaaaguucauucugaaauuauuucauuuaccuacagugaaauaauugugaacuaaguagucuuucugaaaacuguuggguucuaggcauuccugagaaauugaaaguggcuaccuuucaugucaaaaauguugaucuauuauaaauaaaauguuuuugcauauguuuuugauuugguuugggcuaugcauuuuacuuucguuuugaaacacuauacuuucuauuaagcaaaaaaaugagaaaagccuauauucaugagaauauacuaaua

SEQ ID NO: 12824 - RNA, 37644 nt, Homo sapiens
ggugacugggugcgcgugcugaugacgaaaucggaagugcccggagcagaggcgggaccagaaccuagagggccucgggauugcggaaguuugguggggagggucggagcucugguggagagaguguugucuaaaacaaguuccggaagggaggcugcccuucgcgguccgagaaccaccggccuccccaguuugagggcuguuaccccgugcgcgcuucgacguugcugcuguuggcucuccucgccccucguucccuugggaaccgccugggaacuccgccaugucauccacuucgcccaaccuccagguaucauugcucaucucccgucccccuagggagcugggaucgaggggaggcgcgagaagcggguggggggcggggagaagggaggaagcggccgcgccuguggucgaggcgcaggagggcggguccggggaccugcagcaggugggagaggggcccguuuuccaacggaaaggucguuucuggcccgcucuuggggucucccgagcuacuggcuuugugagacucuucacuuuuguugacacuucccgcuuccaaaccagccaagaucugggcagguuucuccaaucaggguuaacggagaaagaaagaacguaauuuuugcaaagcccuauucuggaccaguugaagauaggguggucauaguucggucuuaguuucucaagcugacagcagaccccuucauucugagcugucaggugaguagagauaugggaacagaccaagaaucugagauuacagccagccugcaugcaaucuccgugaagucauugaauuuaugugcacacuccuguggcucccagaugguaguguguaagaucgaggaguauucuuaaaccucuguguggcuccacuuccccuccucuaccgcaaugagcacaguguuuuguacacaaaucauggaaucuuaagauuuuaggcuuaaucguuaguccucuguggaauggaauucguucagaaaagaaauuucuuaauguaauggugucucccauccccagaauggaucuagggcuucaguggcguuuagaauguaauguggcuuaauguagaggacucccaguccaguaagucaauaaggcacaaaagaguagccuaaaauacuuguauugaguccccgucguggacuuccgguaguuuguugaacaagcaguuauuggagugccugacagaggcaucaaagguaauggaagaacuccuuaacccaugauaauugauucugaagaaagaccacucaaaguagacccacuuaaacagagauuaaaauuucacacacacauacacaaaaagagugggaaaggaggcuugcuugggacuuucaucuugaaaaucgaccuagaagauuauuaaaauaauuguuaucuuucacaaaauauuauaauuguauaauugcaacaaugacucauuuuguggaauaagucaaguguugauuugucuguguuuuuuuccuuuucuuuucuuucuuuuuuuuuuuuuuuuugagacggagucuugcacggucgcccaggcuugagugcaguggcgugauuucagcucacuacaaccuccaccucccagguucaagcgauucucuugccucagccuccugaguaccugggacuacaggcacccaccaccacgcccagcuaauuuuuguauuuuuaguaguagagaugagguuucaccauguuggcccaggcuggccucuugaccucaggugauccgccuaccucagccucccaaagugcugggauuacaggcgugagucaccgugcccggaugacuaucuuuuucaccaagguuguauuaaacuaagauucagcaaucuucacuugaguuuuuuguagcuuuuuguaguccuauuuggaaagguucuuuuugguaaacguauuuggaaaaagcguuggucauuugguaaaaguauuuuucccuugaguauuaaaggugacucuucugaagugcccaucuugucaucguuggcuuuuuaacaauuuuuauuccaccagcuuuucauuugucagagacuuugcaugugauuucgauacucuacaacauaaucuucaucauuugcagguuuuuguuguuguuguuuugagacagucuugcucuguugcccagacuggagugcaguggcgugaucuuggcgcacugcaaccuccaccucccagguucaagugauucuugugccucagccucccgaguagcugggauuacaggugccugccaccacgccuggcuaauuuuuucuauuuuuaguagagacaggguuucaccauguuggccacgcuggucuugaacuccugaccucaagugauccgcccgccuuagccucccaaagugcuggguuacaggugugagccaccgugcccggccccagaaugcaucauacuugaauuggacuguuggcuguucuucagugaaucagccagagacugaccaacaugaaaggcauaauuguuacucuuaagcaggaaggaucuugaauuguaauuuuguuagugguagguucacaugugugcuuucucauucaaccuuuucaaccuucuaaccuaggaaauuuggauuaauauucauguagugauuaacuuccugcugaacaaggcaaaaaucucuguggccagaugcuuauaaucuaaugagggaaugcagauaacuaaaaaucaaaauuauauaauguaauaaagcugcacaguauucuccacuucccugugguuuuacuuuccacaguuucaauaacccgaaguuaaccuggguccaaaaauuuuaaaugaaauauucuagaauaaauaguucauaauuuugaaacacuaugucacaaugccugugucauucacuucaguucauaucaugacguaggcauuuuauuauuucacauaaucacaagaagguugagaacagugcaauaagauguugagagagagaaaccacauucacaucacuuuuauuacaguauauuguaauaaaauguacugggcaaggaggcaaggucugugggaugggaggcgguaaggggccaaauuaguagaguauccauucaaaugaaguggaaaggauugaucaaaggagaaaaauugaagauggagaagagucaagcuuguaucugcauuuauuuuuuuuuuuuugagacagagucucacucuauugcccaggcaggagugcaguggcaugaucucggcuuaugguaaccuccaucucccagguucaagcgauuccccugcaucagccccccauguagcagcugggauuacaggcaugcaccaacacacccagcuaauuuuuguagagacggggauucgcuguguuggccaggccagucucaaaguccugaacucaggugauccacccccguuggccucccaaagugguagaauuacaggcgugagccacugcucccugcuguaucugcauuuuaaaagugagggaggaggaagagucugaguuuucucccagauuucuggguuggguaucugaguacccaacucagguagggauugguucugggaauacaaaaggagagcuauuuggggccagggcaagggagcaaaauaauuugguucuaaacuugucgaguuugagaugcuuguggagacaaucaaauggaaauguccggugaauauuugcauacauauguguagaaguagggagaguggacuaggcuggaaauaaggauuuauuagcguacaggugguagcagagguuguaggcauacagagucacauccuggagaguuuacagaauaaggcaaaacaaagaccacguuagaaauucuauggauuagcgacaguuaaggagagagaaaugggagccuggaaaagaauuaugaaucaaaaguaaaaccaggccaggcgcaguggcucaugccuguaaucccaguguuuugggaggccgaggcagcagaucgcuucagcuuaggacuucgagaccagucugggcaacauggugaaaaccccucucuacaaaaauuagccaggugugguggugcaugccuguagucccagcuacuccagaggcugaggugggagaauggcuugagcccaggagguggagguaacacugaggcgugaucacacccguguacuccagccugggugacacagugagacccugucuaaaaaaaaaaaaauacuaaaacuagaagaaaauggugucaugacagccaggcaaggagacacugucaggguauuuguuguguguguuaaaugcugcggagagggagugagauaagcauaugauuuggcuaucaggaggcagaaagcauugcugugggagaaauaggagaucaggaaacugggaugaacauggguauucuuugggauuuugcuguggaggcaaagagaugagugagauguagggagaggagaaccgaggagcugaggagugaugguguguaguuuguguucugcagaugugagucugagauaggacaacacauuuuucugcugagggaaaaaaggaaagguuggagagaacaguugauaggcaugucauugauggaguaaaugucagcagaggaagguggggaucagcuccacagcagaggagaaagaauuggucucaacagacagggccugggacaccucuucugagguagguaauuguagaauuuaccccauuucucaggguuuucuaagguggaugugucugggacuccuaaguggaacaggacaauuccacauguucccaaccuuuauacuuccguauggauaacuggauccugacugauccuggggugacacagucauucagucuugugucagccacugugcuagacucugggaauauaaagaagugaagacaacagacagaacugcucuucuccuggagcuuacauucuaauagaagagagaggccaauaaauuaaaaaaaaacaaaaaaaacauaugcaugcucagacacacacaugcacacacaaagaucaucagccuuaagucacugauguagggggggaggaaacagagagaaaugagucccagcccacaccugaugaauauacuucauugucacauaagagaggaagaaucaaugaaggacgcugagaaggaggagccagaauggugggaggaaaaccagcaaaguggugguugggggcucagcagaggacaguguccaagaaggaggaaauaaucaacuuuguaaaaugucagaagaucaagaagacagagcugguguuuggaucuagcaugcuagagagccuugauaugagccguuuuauuaugugauacaggaaagagaauagaggccacucuggugagauuuuuggcucuaaaagguagcagagaaacagaacuaacaccgaacaguguuuugucaaauaagacuuuuuaaaggagggcuguuuguaugucgauggaaauaucuaguggagagaaauuguuaagaaugacagaagugaaguaaccaaaaggaagaagauacugaaaaaggaguagggaauuuuuuuuuucauucguuaaacaauuucgaguaccuguuguaugccggcaccauucuaggcauggguagcucaaggugaaguccuguccucauggaaccuaccucccuaaaggagacagccagugggugagcauacagguaaauacaaugacagugaugggaugagagagugcagugggggcagauagcaaagagaaggaaugaggugcagccuuugcuauagcaaauuagggaggccucucuaaggacuugccaucugaacuaggacugaaaaggagacaucaugcaucugucuggggaaaggagggaagagcauucuagguggaaggguucaacugcuugggcugccugagugcaggaggauucuaggguucggggagaaccacacguagcuagggcccagguuauuucagaccuuguagaucagcucuagcaucaggauuuuauuguuuuuaaugggagaccaucaagguuaccuuuuauguuuugagguagcaagggugggaacagacugaccacucacgaggcuggguaguaguuuugacauauaugauagcagcuugaacuaggguguuagcaagggagauggugaggauuauauucagaaagaaaauuagcucuggcugaaaagggaagauaauguuugauggaccagagcagauggagcuggaagaggggaagacaggcaacagacucugccaguauuaucugucugagacugaagaacuccagucaguagugaaugauaacagccaggaccuccagaggcugcaggcauaaaugaaugaacucaaugcaaaaguucaccuauugcaggaggagcuacagcugcugcaggaacagggcuccuguauaagggaaguaguccgggccaugaauaaggagaaaguguuagucaagguguaucccaagggcaaguuugucuuagauguggacagaaacagcaacaucaaugacaugagacccaauugccaggggggcgcuaagaaaugauagcgacacacugcacaauaucauacccagcaaaguagacccacuggugucaccagugaugguggagaaggugccaaccuugauuuaagagaugauugguggacuggacaagcagauuaaggacaucacagaagugaucgagcagccuguuaagcauuccaagcucuuugaagcacuggguaucacacaacccagggugguacugcuguacggaccucuaggcacugggaagacacuguuugccuaggcuguggcucaccauacagacuguaccuuuguucauaucccuggcucugaauuuguauagaaauucaucggggaagggccaagaauggugagggagcuguuugucauggcaugaggaccugccaucugucaucagcuccaucagcuccucgcagcuggagggggguucuggaggggacagugaagugcugcacaucgugcuggaacugcucaaccaacuggacagcuuugaggcccccaagaagaucaagguuaucauggaccacugcuucacucagggcacaucaacagaaaaauugaauuccagcuggacauuuugaagauccauucucugaaaaggaaccugacccaggggaucaaccagagaaaaauugccaagcuuaugccaggagcaucaggggcugaagugaaagucauauacagagaaagcagcauauaugcccugagggaacggcgagugcaugucacccaggaggacuuugagauagcaguagccagcgucaugcagaaggauagagaguaaaacauguccaucaagaaacuauggaagugcggggauguccuuuguauggaucccuccgguaaagcuuucuggaaugaaaaaauaaaauaauuagcucuccagaauuaaccauagaagacaugguuaauuuuauuucaaaugaaaaaugcuaacagacaugguuaauuuuauuucagaugaaaaauguuaacagaaauaagguugaaaugguauucaucagcagaaaaaaaacagaugcauauccucuuaauucaucgucuucgauuaaagguuuaacgugugccacccaguacaguggcugcauguggcuauuuuaauuacauaaacucacuccucagucacacuagccacauuucaagugcucagaagccauauacagacauucucaucaucagggaaaggcugguuuaauuagcacuauguuuggagcuagaugcuuaaauaauacccacugcaguauaagagauuuaacuuaauaaaaaucaguguggugccucagugaggccugacugaaugagaggaacaaguggcugaagaggugaguggcacagcauuucaaaaucaccugagaagaaaauuauaguuaggauaagaaagagcuuauuucuaggccaggcacgguggcucacgccuguuaucccagcacuuugggaggcugaggcagguguaucaccugaggucaggaguuugagaccagccuggccaacauggugaaaucccaucucuacuaaaaauacaaaaauuagccaggcaugguggugggugccuguaaucccagccacuggggaggcugaggcaggagaaucacaugaaccugggaggcagagauugcagugagccaagauggcgccauugcacuccagucugggcgacaagagugagacuccaucucaaaagaaaaaagaaaaaggauuuauuucugcuauguggcuuaaccacugaggcuuugagaugcauuuuuuuuuuucuuuuuugagacagagucuugcucugucacccaggcuagagugcaguggcaugaucucggcucacugcaaccucugucucccggauucaagcgauucuccugacucagccucccaaguagcugggauuacaggcgccuggcuaauauuuuuuguauuuuuagagaugggguuucauuauauuggccaggcuggucucgaacuccugaccucaagugauccgcccuccucggccucccauacugcugggauuacaggcgugagccacugugcuuggccucacucugucacccaggcuggagugcaguggcacaaucuuggcuguggugcauuuuuauaugaccagucugaccuaaccaccacuugacugugugacuccauguuuuauguucauauacuagcugauaaaacuugaaaauuuagcuuugaauuuaggcuacuugaccugugagauacguaacuauuacauuuuaucaauucugaaguaaaccauuuauuuuucuucccugcuacaauagaggaagcauggucuuccagcgggagaccuguuccucccauuuacagaucucagcccaguuauauccaauccaugcucaacugccccaaaauguaauauucuuacacauaauugguuuuugcauuguuugaaugauuuuuugcuuauguuauauacuuacuuuuuaauaucucuaacaacugucaauuuucauuuuuuuuuacuggcaccuauuucuguugaauaguuuuacuaccuaaauuaacccaguuggaauguuuuaauaagucauguuugcccuuuauuuguauguaucugugcauaauuuuuuuuuuuuuuuuuuugagguggagucucacucuguugcccaggcuggagugcaguggcaugaucuuggcucacugcaaccaccgccucccggguucaagcaauucuccugccucagucucccaaguagcugggacuauaggcgcaugccgcuacgccuggucaauuuuuuguguuuuaguagagacgggguuucacuguguugcccacgcuggucgcaaacuccugagcucaggagaauuuuaguuugagauaauuguagauucacacgcaguuguaagaaauacugagaauccagcauucccuuuauccaguugucugcaguggcagcaucuuguagaacugggacaauaucacaaccaggauauugauauugauacauuccaccacucuuacucauauuuucccaguuuuacuuguccuuauguguuuuuaugugugugggugugguuguuugugcaguuuuaucacauguagauauguguuacauuuugagaguucuuuauguauucucgauacuaguucuuuguuagauauguuuugcaaauauuucucccagucuauagauuguccuuucauccuuuuaacaaaaucuuccagagagcaaaaguuuugucauaagauccaguuaccuuuuuuuuucuuuuauauaguaugcuuuugaugucaaaucuaagaacucugcgcauccccagauccuaaguuuuccauguuuuuucuaaaaguuuuagcugggugcggugguguggacuugugauccugcuauuuggggaggcugaugcaggaugaucaccugagcccaggaguuugaggcuagcuuggucgacauagugagauggagccccgucucaacaaauaaauaagaaucaaaguuuuguaguuuuacauuuaauucuaugauccauuuuugaguuaauuuuuguaggaaguauuaaguuuaagucagaauucuuuuagguguaugcuuauggaugucuaguuccucuagcaccacuucuuaaaaagccugacucggugccauugacuggcuuuuugcaucauuuucaaaaaucucuuggcuuuauuaguauggauuuauuucugggacuuuuuaaaaaaaugccacaaaaguaguccauguuccuuauggacauuuuuuagaagaugugaaaaaguagaaaaugaaaaauauauguuuuaucaaagauaaacucuguuuaacaauuuccuucccaucuuuuuccugugcugcuuuuuucugcuguuguuucaaauaaauuccugcuacauauaaaaaguuguguccugcuuuuuaaaaaugcccauuauuaacacuuuccauauuauuacaaauauuucuuaauguuauuuuagugauccuuugguguucuguuuuguggcauccuuuaugauuuaaguuuccagguuuuguuuuuguuauuuaaaagaccucucugauaauaucugugcucaguaaaccuuuuaguuaauuacuggauugaaauauaugaguauuuuucagauucuugauauuucauugccccauugcuucugaagagguuucaccccauuuacauuuccacuauuguuauaucuuuuagauuaaagcagcauuuaauuuuugagaauuucucuaaaugcuuguuuaguuugaauuuucacauucuauuauuucuuauuagcccuaaauuuaacuuuagcuaagugaaaauuacauguaaauguuagcgauugguacuaaaguaacauucaguagcauuuauuccuauaacauguaauuugcaucuuuucaacuuguaauuuauaauaaaauacaguugugaguuagaaaaaaaugauuuuuuaguuacuguuuauuuuuuacuuauuuuuguuuucuuucacagcccagcaagcugagaagcuuuaaaaaaaaaaaaaacuuucaguaugauuauuuacuucaaauuuauguuuaugcuuugauuuaaauguuguuauuuugccucccucaaacagaaagcgauagaucuggcuagcaaagcagcgcaagaagacaaggcugggaacuacgaagaagcccuucagcucuaucagcaugcugugcaguauuuucuucaugucguuaaaugugaggccauagguuauauuuuauuuaaaaacacgaaaaggaaaauuuauucuguuucauuucuaaaaaauugaaauauaaugccagacaauucuaaacgauccauuuguuaaaaaaaaaaaauacuccacuuucuuucuagugauuuuuaaguauugagauguagcuagcaaaugugacagccaucauaguuauuacuuuguauauguaaacaucuuaaaauguagucuagucaguggaaaauagguuaggagacauucuauuugugucuuuacagauauguauugcguguguaccacguggcaggcacuggggauacaauggaaagaaaugguuaagaccccugcccucauagcucuuaaauggaaugcaguuagaugauugaagauguucuuuugagcuucucccauuuaguucugagguuuuauguuaaagugagacuaagaaugagucauaaccuguaagcuauguggggcucaucccaucuauugcacguguugccaaaguucacuuugaaaacagcucugacagaggccuuuguguaguaaaauuuacgauguugguauuacacagaauauaugggauuuccaucacuuuacucuucugaaauaaagcuuuuguagacauucauagaaaugauuaauacugcuuuccuucuauuugucuuuuuuauaauuggguuugucuaagacaagcaacuuugaacuaucugcaaaaauguaagggaaaaauaugaaagcuucagaauauuaaauaauuuccuguuaguuaacauuaacuuaauauacccugcugucuugcuuagguuguuucugauucagacccacuguuggucuccaacccugcuggaggaagggguagaaaagaggugauaaucauuggcuaugaugaguuagagaugaucuucccuccuucuuccaacauagaauuuccuugucugaaaaaauacauauuuaagaguucaaaccuuucuacauagaauacuaauggaaaaaaaucucucucauuucccuuuaauagaugaagcacagggugauaaagccaagcaaaguaucagggcaaaguguacagaauaucuugauagagcagaaaaacuaaaggaguaccugaaaaauaaagagaaaaaagcacagaagccagugaaagaaggacagccgaguccagcagaugagaagggguacguguuuaaaauuguucaauuuuauuguggcuuuuugcuuucgauuugugaaauuucuuuugauuaaaacaggugucagcaaacuauggcucaugggccaaagcugcccagcugccuguuuuuggaauaagcuuuaucagaacacagccgugcccauucuuuuacauauuguugucuagggcugcuuucgugccguaacaacaaaguugugugguuguguggagaccguauggcccacgaaaccuaaaauauuuacuuguuugguccuuuacaaaaaaaaguuugcugaccccuaguuugccaaguugaauggauaauauuccucaaacaacccuuccugacugccugcuaguaggaggagagaaugcuuguaggaauaguacucaguuacucucuggccauuagcuaauauggaagcuuaagguuauaggagugaccagagaguuaaaccuuugaccacauggaaaaaaugaaaaguaacuccaacaauguaaauuuuuuuuggauaucuuaugcaaaauuuuuugaugugaauuuguguuagauuugcuuuauguugucauuguaaagaaaacaacacagcauaacuuauaaacguugaaacugauuuuuggcaugucuuccuagaugggggauguaucacuucuagaugcagaauuuguuuauucaguacaugacauaugcgugccaaguuugugcucagcacugggaacauauucuaaccacauccucucuggcuguccuauuaauugaugccaguaguuccagguaacacacccuuaagaaaaugagacucugggauggaguuaucuggccugcuuggguuugaaaacagcgagauucugcucagcuuuagaggaugugguucucauuguucaugguaugcaguggcgcagguuauuuagacaauacccuguggucacaaggaaugaagugccuuuuaggcagugcuuuggggcuucguggcugcuaccacagaccauuuggaaguacaugaggaauauaagaaccaguguugacuuggcugcuucaaacuauguggcagaguuugaaggaaaugauaagcuuaagcucaagguuuuauauucucuguucaagaugugaucggggaaccagggaguuucugugacacccuaagaacauguuaucuucuucaucgauagcacugacuuaacaaaaaucagaugauagucugaucuuacaaauuacugaauuccaacuuaggguuucuuauaugaaagugaggacauuugguauaaaacagggacuccaaacaugaagugaaaauauugggaagaauuuaguugaccuugacugcccaggaccuccagcugucacugagacucccuugacagcagaagcuucucuucccuuguccauagaagcucuucucucuugcuugaaaacccuguaaggaucucuucugagaugauuaccugacaaggcgaugccaguuuuucuuuuguacugaacagcaaucuucguuuacaguaggacccacuuuggcuaauuuaagcaaaaagggauauauuauaggguauuaccuuacagaauaguggggccagggaaucaggagaaauggccaacaguaccaggguuguucaaguagggaucccacuguugccaacuccucugcuaagcacugauggugcuugggagcagguaguaaauccucugcgcagcucccucagcaaaaccagugccuucgccugaagauucugucuccuugugagcagcccccaccuucuuggaagaauuuaggucucauguggaacccuagcuacaagggagaugagaaacggcaggguuuuuuuuguuuguuuguuuuuaauaaggacagccuuuauaguacuggacagcaugauagaaagagguuggagugagugucaugugaaucuuuugcagugucuaccucacccacagccccaccguccuaugauaaccaaggcaauuccauuuuggcauaaaacaugucaugcuuuuaucucccuuuauauguuauuguuuuaaaaaugauauaaugccuuauuuuuggcuuuaucacuuuuauacuuaacauuguaucaggaauaucuuuccaauaaacuauuucuacaucacguuuaaauguugcaauguauccugucauaugcuagucccuauaauaugaguuacuuuuuccccuuuugcaaacagugugggugugauuauccuuauggucaaaugcuugaacuugucuaaaauuauuuccucaagauaaaucccuagauaugaaugaaaugccuugaucgaccuacuuguucuuuggguguaguucauugucaucaggaagcuuccucuguccuuuggaauccccagacuaaggguuguagaccuuuguaccuuaguguuccagauuuuuuuccuccuaauaugaccucuuguucuaauuuauaucuugcccaguccugauguuuuuacuguuguuguuugcagcucuccugugauucaucuugaauccuucauggagugauguguggggcaugcauuuaugaauuaauacauaccuaaauaugucaugggaauuuggagcuaguuccugacuucauucuggucuuuuugucccuuucuuuuacaugauucucuauugaugauaacgugacugcuucuuauuuacuacauucuuuaaaauaaguaagcauaacuuuuaauguaaaugucugauuuugccacugaaauuacaaauauuucagguuaauuuuuccuucauuuuugccuuauuugauagcaaugagugaucauuugaauauauuaaauucuuuuuauuaggaaugacagugauggggaaggagaaucugaugauccugaaaaaaagaaacuacagaaucaacuucaagguugcuuuagauuucauuuuuaaauuuacuauccuauuaaaaagacucaaagugaauugucuauuugaauuguuuuuguucucccucuauauuuaaaugaaguuuaagaacuggcuuugguucccaauagucaugugcuggcuuuguuuagaguguuuucuuaggguuugcccucuaggaucaugguuuggucuuuuuuauguaauaguuuuguuggcuucacaucugccuuuaaaaggcucucagucaacuugcucuuucuuuuuguuuauuugccgccuuuuagagaagguaacacuuauacuauuagcacacugcaaaauuugaugguauuaaaauuuacuacugugggagaaguuaggacuuacacguggcuuuuauugccguugcuguagcucacuuauugaugguuuauuuuguuucuuaacugcucuucaucugcuuuucaguguuccuguuuacauuuaauuguuuaagcuuucuguguuuaccauccacaccuguaaagcccuuucauucuguucuacuauagcacaguggcauaacagaggggacauagguuuuuggcuccauucagaucuugauucuguucaagggucugccacuuagaacuuucuaauugugggcaagugacugaaucucucagaaccagcgucccccaucucuaaaauagaaaugagcaauagcuuccuuucagggcuuuuaagauuaaugacaguguaaaaacuaccucauauaucugacgaagucuagggacucaauaaaugguagcacuguuuaucuaaaaaggcaucuauuuguuggcuggcuuuguuaaucacugagauuugauuauucuucgaaauaaauuaucuaacaauuuuucagauugaauuuuuugcucacccauugguaguauguauuuuguucauuugaaucuuaccaaauagaaugcauaacugggaaggauuuccauuuuauagguucagccuugguuacugaauagugaaaauacuuaccugagccaaacuuuuagccuugcuauacuagugucuucguuuugguaguauuuuugucuugccuacccuacugggaugucuaggaaaacacuguaaggauaauguguugacaacagaccagguaaugaauagagaacaucuuuagaugccaagaacuucagugguagauauaguccaagggcaaaaucuugaguuuacacucaagcguagugguguccccaccaccugaaacuacuggcacacacugcgcacucaguuggcauuuauuggguaacccagugggucugugccaaguggccuuauuccaguuguaaagcaagacacuuuuuuugucugcucuauuggauuugguuuuguuucccucucccuacccugccccagguaaaaaucaguugcauaucuuuaauuuucgaaaagauacauuuuuuuuuucuuuuuuguuuuuuugagacaagggugucgcuguguugcccaggcuggagugcaguggcgcaaucacggcuuacugcagccucgaacuccuggguuccagggauucuccugccucagccuccugaguagcugggaacacaggcacacaccaccaugcccggcuaaguuuuuuuuuuuguuuguuuguuuguuuguuuguuuguuuuuguagaggugggguuuggccauguugcccaggcugcucucgaacuccugagcucaagugauuugcccacuucagccucccaaagagcugggauuacaauugugagccaccgcacuuggccgauacaaccaguuuuuaauagggauuucucuaaauucccuaucacuuacaauaaaggccagaaauguaaaacaaacaaauaaaagagaaaaaaaaccaaauacuuaaaacauuuaaaugaggaaauguauuugaaauuucaggaugaaauagaauaugaaaggaguccuagccuuuuauauuugaauauccuuuuuuuucuacuuuuuaaugguuugcugcuggauuucauacuauuguaucuuuuuugaauuuuuccuuguuuuuugaacaguauuuuaaaucuuuuacuucuguuuuagauuaugauauuaaguguauauuuguuaaaauuaaaaaucgguuugugauuugaguuuucuguuagcuaauuuuauucagugaauuuuuugugauuaaguaauauacuaguaaauaguauagucaaagaccggauaaauuuauaucauuggaaguacauuccauuuguuagcauuuuucauaaucccauccccccuuuuuaauuuugcaaaccaugucuaguaugagauuguuuaucaguaaacauuccaaagucaccuuuuaacuuagaaguauuauauaugaaaacaaaucaugacacauuuuuaaaauuuauagcagaaaucuugagucagacgguauacauauauaaaauaaaguuuauuuuuguuuaacugacaugaaauccuaggauuacuaaucuuaaugaaacauaaaaaagacgaaaugaauuuacuuuuuucuuacuuuauaguagucugaacuuuuggaauacaaaaugcuuaugguuucauguaauuuuaaucuaguagcuaaagauuuucauaauuuagggaaguaaguugcuaguaacuagucuuagaguaacagauuaucuuuccuaacaagaagaaacaaucaguagcagugauuucauaaaguaauagauuguauaaguggugguguucuguuacacuuaaaacaacuaacuacaugucaucuuagaacaggcugcuucauaguuuauaguggaacaguuuccauauucuagaaaauuagaaaagcuuuugauaaaagagaacuagaaaauuugucaguaggcuauauuaaaagacauccuucuuggacucuuacugcaauaauugcuuuggcuuuugaauauacugcauucagaagcuaaaucuucccuguaaguuaacuuuguuaauuaacaaaaguuguaaauagaucuauuuagcagccaaauagaaacuugggcaaaucuuaggaaaguauugcaaaucugcagggguaucuuuucucgguuucccaucaucugcuuccauuccuuccuuuccucucuccuuuuccuucucccuucugucugucugccuaucuugaguuaaauuuguuaagcauauuuuuuuuuucagugguugaggagaggauuagaucaccuuuucuuuugguuaacaggagaaaugguagaacaaguacuuuugauacuccaaaaucaauguauucaaauauaaccaccuuauggaacguuuggugcuuuuccaaacacucuaauauucauuaugucauuugauuuucgcaccaaccuaucuaaguaguuugggcagaugguauuauuuucauuucacaagugaggaagcugaaacagaaggguaaaguaacaugccccagguugucuagucauccaccugguuccuaguccuauugacuacucccuaacaccugcuuccugcucacgcuauuucaaaaagguuguuaguacauaaaacuuucccaauuuuauaaugcguuucuuuaacaucauuauuucauguugucuucuaacuuuggugaaauagucuuucuuaauuuaaagauaacguaauuuuuugcaggugccauuguuauagaacgaccaaaugugaaauggagugacguugcuggacuugaaggagccaaagaagcacugaaagaggcugugauacugccuauuaaauuuccucaucuuuuuacaggugacauaacuuuuaaauaauuuuauuucaugaguuuguaaaaguucauugaugacugaggugaagcauugucauucuugucacuaaugaauuaucuuaaauaaauugugacuguuaaaagguggugauauaucuuuauacaagauguuuuauuucuuauacauauccauauuugcaguguauauauauugcaaaacaaccuaaaugucaaccaguaggguaauucaccaacaugcaguggaauacuaugcacucaguaaaauagaguguacaucuacauuaauaaauugaaaucugcauuguauuuuauugaagaauguccacaucuauugcaaagaucaaaaagcaguuauaaacugaauaguaugauuccauguuugcuaaauguguaugcugagaaguaaguauaguuagauucacauagaaauauuaauauaugccuaggggauaagauuauaggagauuuuuacuuuugacuuucaucugaauuuuugcaaugguuaugauuuuuaaagaguauuucuuaaaaagaggaguaagaaucacuuaacaguuucagaggaagugcauaaccucuaguagcaaaaggacauuucauuaucacugugaagagaauauugcugaccuaccaucuggggaaacuuacaaguucuaguuccagcaguaagugauaugucugugcuaaaccauuccuuuauauuauccuucuugugacugauagccuugacuguaauauggccacacccacagucugacagucagagguuuuuccuuuugcaaacauguugguuuaugucaacagcaaaucugcaauguuggccucagacugaagaguccagacagucguaucguauagagcagugaugaagagcaaaaagccuguaggccacgcacuguccgccuagcuucaaggugcaguuuacuacccaacuucaggaguaugaaacuuaacagcauaaaaguugacaucauaauccuauaaaagcacaaaaauaugguugaacucauuuuaugguauauuacuuauaccacuuuuucucaaacaugagucauugauguaucaucuucaugaauuuuuccauguauguguaccauuacuaauuuuuaauauuuuucuuugcuuauuuuuuagaacaacauuuuuacuagaguauagcauaaauauacagagacauacaggagccccuggguguugggcuuccuuaauugucacaaagcaagcaugccagugucaucaaccagauccagaaauaacagcauugccagggaccuggcaggagccuucugccucauuccucccgagaggucaucucucucucucgacuucuaacgccagagauuauuuugccuguauuugaacuuuaaaucaucucacauauuuuuacuuaguaacguuauugaaaagacugcuuugugccuuuauaaguggaaaaaaaaguguuuuuccaauacacauuaaaaaauuauuuaaaguauauaccaccuaaaaguacuucauguuauaccagugguauauguaccauacucagacacugacuuguaaauguauacauguaaaauaggaaaaugaaauucaaguaacaguugcuuucauaacaguuaagugaaacaguguuauucaucugcauaucauucuuuugcagauacuguguacacauccauaguuugcaccuagcaguuuuuuuuguuuuguuuuguuuuguuucuuuuuuugagacagaguuucacucuugucacccaggcuggaaugcaauggcguggucucguuucacugcaaccuccaccucccgaguucaagcaauucuccugccucagccucccgaguauuugggauuacaggcaucugccaccacacccagcuaauuuuuguauuuuuacuagagucaggguuucaccauguuggccacaguugucccgagcuccugaccucaggugauccgcccaucucagccucucaaagugcugggauuacauacaugagccaccaugcccagccauaguuuuuuaaauguauguuugauaguuuacugccagcuguaacccaccuguuuuauuuuaggcaggauuauaauugcucauuagcaaaauugaggcucgaagaguugauguauucacugguuauauuuuggcaaaacuaggauuuaaaguaguaucaccuuuuuguuacccaaccaugaaagucugcuaccuagcuggaggcugaggugggcagaucaccugaggucagaagaucgagaccagccugaccaacaugguaaaaccccgucucuacuaaaauacaaaaacuagccaggcguaauggcgggcaccuauaaucucagcuaccugggaggcugaggcgggagaauugcuugaaaccaggaggcagagguugcagugagccgagaucgcaccacugcccuccagccugggcaacaagagugagacucugucucaaaaaaaauaaaauaaaagaaagucugcuaccuauaacacuaaccugugcuuuccuguggaaucaagaauucagcagaaacucacaagucauccaaacuuuguuagguucacuuuuccaaagagcauaaauauucaaagaaaaucucuuccagcugcccauuuuuuauggauauaauuuuuguacaauauucugguaucaagcaguguacacaguagaugaucagaaaguaccuuuuaacugaacucuuuuccccuacuagacuccacgcagggcagaaauccuuuugccugugcacauguuacgguuuugauacauauugguugaaugaaugagcaaacaaauguacuuccuguuagaaggcuuauguuaugcaagucucuuuuugauaaaguagucucuagaagaaacaaaauauauuuaagacauaccuuagauugauuuauuuuuaaaauauuguuuugauccuuagagguuuagagugaaaaucuuuccagaguauuccucaguauagaugauacaauuaaguguuaaaauucucaugacauuuuucuaaaucuaaauuuuaggcaagagaacaccuuggaggggaauccuauuauuugggccgccuggaacaggaaaguccuacuuagccaaagcuguagcaacagaagccaacaacucaacauuuuuuucaauaucuuccucugaucuuguuucuaaguggcuaggugaaagugaaaaguaaguaguaaaucaauuuuuuaaaguuuuuucuuugccuguaauuacuguaucacuccuuaauagauuucuuacaucacuuauagauauucagagaagucauguaauacagguacucacuucucugucaaaucagucucuaaucuagaauuucuuuugugggaaaagauagcauauaucuacaaccuagugaaucauaaagugaauuauccaguuguagcauucuuauuuucuguaccugaaacaugauuaggcuuuuuaaucuacagaguucuuguaauauugauauauuacuuuguuuuaaucuuuuacuauuuuuuagagacuuaaaaguuuucauuuauuuuuagacugguuaagaauuuauuccaacuugccagagagaacaagcccuccauuaucuucauugaugaaauugauucucucugugguucaagaagugaaaaugaaagugaagccgcacguagaauuaagacggaguuccuagugcaaaugcaagguaguguuacuaauuuuuuuuuucuuuuugagacggagucucacucugucgcccaggcuggagugcaguggcgcgaucucagcucacuacaaccuccaccucccagguucaagcaauucucaugccucagccuccugaguagcugggauuacaggcgcgcaccaccaugcccggcuaauuuaauguuacugauuuuuaaagucguuuuuguuuauuuuauaacaauuuuuauaacaguaaugaaaaauucaagcagaauuucuccauucuaacaaacuguuucauuuugccauguuucauuccaauugucuuccauaugcauacauaauuuuuacucaauuguaauuaucuuguaggacucacugacauaaauagaaaagagauuuaauguauucauuuauaauguaccaggaacaacuucaguaaaaguaauauguagacuucgaaugaaauuuuucaagaaauauuuugaaacgaauguuaauaguauuuuccacaaucugggagauuugauucauauauuugcaucauauugcaucauaguguauuuggaucauauugccguaaggugauauuugauuaaauacaguucuuuuccaaagacagacucucaagaugaagcacuuuaaugguaaagcaccacauuucuuaacagaauauauggaagaaguuuaaagaacaccaaaaugacaaauuaauuaaagcauuaccuauuuuaaugcagggguugguguagacaaugauggaauuuugguucugggagcuacaaauauacccuggguucuggauucugccauuaggcgaagguaggauaauauaguaaauaucuuauuucucacugcagauguaacaaguagaugauaauucucuuuuugucuugucaggaagcauucuaacaacuuuucaaaagauuuguaaugugcucuaacccuguugcuccccugccuugagugggagaaggguggucauuugcuuguuuguuucccuaguuuaucaaauauacaagauuuccacacacuucugucuuucauauuagaaaauauauuaccuaaugcuuaccuuucauucugauuaaguuuggugggcacugaugcuucaaaaauuuauaaacauaguuugacaauucaguaaaaaccauuuauauaaaauuuuagcaaaauggcaauucuauaagucaaaauaagauaaccagguaagauuuuuuuuuuuuuuuugagucggagucucacucuguugccaggcuggagugcgguggugcgaucucggcucacugcauccuccaccucccggguucaagugauucuccugccucagccucccaaguagcugggacuacagguaugcaccaccacgcccagcuaauuuguauauuuuuaguagagacgagauuucaucauguggccaggauggucucgaucucuugaccucaugauccacccgccucagccuccgagagugcuggaauuacagaugugagccaccgugcccagccaagauuuuuuuuuuuuuuaguaaaaacuauaugucaggccgggugugguggcucaugccuguaaucccagcacuuugggaaaccaagguaggcagauugccugagcucaggaguucaaaaccacccugggcaacguggugaaacccugucucuacuaaaauccaaaaaaauuaccuggccaugguggcgcacaccugucuguagucccagcuacucgggaagcugaggugggagaaucgcuugagcccaggaggcggagguugcagugagccaagauugugccacugcacuccagcuugggcaacagagugagacuccaucucaaaaaaaaauauauauauauauauauauguguguguguguguauauauguauauguguauauguauauauguauacacacacacaucuaucuaucuaauuuuuaaguugaaaaugaaacuucaguucuaggaaagguauacggacucuucacuuuucacucuucacaguucuguauuacauucauuuauuuuguaugguaaaaauuagcacuucaguuuuugccacuuuuaucccauucacuugaugauuugcgccagcauucuagcuuaccauccaguaccaagaaaggaaaugugcaggguauuuuugaaaaauugccuuauucugcacccaucucuagaggcaacggaaacuuuaaauucuuuucauugucacagagaguuaccuggagaaaaaacagucugcucagaccacuuaaauuaucccucaucguugcuucucugucuccaaauaccgaaauucuaagaaagcaagcaaaauuauuguuaaugaaacauaguguuuauucuuuauaauauaggauuguucuggauguauucauuaaaguggacauuuuguguaauauauauccuauaagauugugagguaauucuguuuugaauguagagaauuacugugucaucucuacuccuguuuuauauuguuaaucauuagucccuugaucaagaguucagaguacaauuuugugggaaacuguaacccuguaggaccucuuuuuauuucaugaauuccagacauaggaacacuguggccaaaauaacccaaaaaugcacgaaagauucagccacuucaaacuggcucccaggcuauuuugauuuuauuuguuuguuuuuaauguguucuggauauuaucccuuuaaccuaaauauauauguuuaaccuuggcacauacaggcccacuuaacuuaguaucuguuucuucuuggaaauauccuaauuuucaauuaaauauauucuugauguaauuucucuuuuaagauuugagaaacgaauuuauauucccuugccggaaccccaugcccgagcagcaauguuuaaacugcaccuagggaccacucagaacagucucacggaagcagacuuucgggaacuugggaggaaaacagaugguuauucaggggcagauauaaguaucauuguacgugaugcccuuaugcagccuguuaggaaaguacagucagcuacucauuuuaaaaagguaagucauuuuuaucuauccuuuccuaucuuuuuuuuuuuuuuuugagacagucucacucuguugcccaggcuggagugcaguggcacuaucugggcuugcugcaaccuccgccucccggguucaagcaauucucaugccuuagccuccugaguagcuggaauuacaggcgugugccaccacgccuggcuaauuuuuuguauuuuuaguagagacaggauuucaccauguuggccaggcuggucucgaacuccugacuccaggugauccacccaccucggccucccaaaggcgugagccacugcgccuggcccuuuuccuguauuuuuaaaaucaaguuucaagaccgucauugguuugucuucaaagaauuugggaggauuucaguguuguauaauaauaccauaaguggguuuacauaauagacauauuucugugucacugaaacaaguucuuuaauaaaguuuauuuauuggccauuuuuggcugggugcagugccccauaccuguaaucccagcacuuuaggaggccgaggugggcagaucucuugagcucaggagagaccagccucaggcaacauggcaaaaccccaucucuguaaaaaauacaaaaauuagcuggaugugguggcacacuccuguagucccagcuacuugggaggcugaagugggagaaucucuugagcccaggagguggagguugcagugagccgagauugcaccaguguacuccagccugggugacacagugagacccugucuuaaaaaaagaaaaggccuuauuaaucauccuaauguguuuuaaauuuuccuaugaaaugauuuuugaaguauuuguguauuauuuugauauaaguauagaaacuuaaauguacagauguaaggcugcuucugacacaucuagaauauuuuugaguagaaucuggugcauuuauaccucauaaaguaaaaauaauaauagcuaauaucuuuuaaauauucacaugccuggcacuguguucugucuuuuaucuuacuauuucauuuggucuucacaaaaaucagcaagagagguacauguagccagccaccuaauggugguuagucuuggacguaggugcuaacacaguagcuagagugggacagacaugugauuugccuggaggugagguguguuuccaaaucugaaaucucagccauucugcuauccugccccuccuguguucuguuuugucugcaagaacaaguuaagcaucuguggcugagauaaaguuuuauaagaaggcuguggucuugagauacccaguuugaguaacaaugaacuagguaaucuggaccaacccuuuugcugugaacaacaguauccaguauuacucaugaacauacaugugaaaaacuauuagcaaaccuaaucucauaauguaugucaagacuaauaugacuaagucacauacguauauuuaucauguaccauaauaagauuuuuuuaaguuaacaagcuugaauuaaaaucugaauuugaagccuggcaccauuuacuuguuauaccuuuuugagcaaauucuauuacuucuuuaaagcucauuuuuaucauuucuaaaauggggaugugauaaugcuauuuugaaguccuuuccaauaaugaagugauauaauacucauaaaacaccagucgugguacuucagaugcguagggaauguuacucauccacccuucuucagccauuucauuacugaaguacuguuaaguuuaugccacagccauuauguuuuuucuuaaauucucuuugccauuuagaaacuauaaaugcauaggaacucaguccuuuccuacugagaguuugucacucaauucugcauauuacugccagggugagcucacaugacgcugaagccagguccuuguuagugggaugaaggugacacagccagaugaguuuuaucucugcagcuggggaucaccagcugcagcagaccucucagcggcuccauccuuuacuucuuuuaaagcugauuauuucaguuaacaagaagaagauucccuguuuauuuuuugcauuuacuaguauuuuauuucuaaaauacuaaucugggaccggugguagaucagaaaguagagcagucaaaaaagacaaaaaucccugaccucaugcagcuaaaauauuagugaguaaagacaguaaaauacacauaauaaggugagagcauguauuucuucacaucuacacuaauacugagauaauauuuaaagucgauuauugugaaacagaugugaaagugcccccaaguuggcugggcgcgguggcucacgccuguaaucccagcacuuugggaggccaaggugggcggaucacaaggucagggguucgagaccagccuggccaucaugauaaaaccccaucucuacuaaaaauacaaaaauuagcucggcgucagggcgggcgccuauaaucccagcuacucgggaggcugaggcaggagaauugcuugaacccuggagguggaaguugcagugagcugacaucgcaccacugcccuccagccugggcuacaaagcgagacuccgucucaaaaaaaaaaaaaaagaagugccuccaaguugaugcagacuauugccaucuaaauguuuacaugugacuaugucacaaagauucuuuuucuggauauuguuaaaacuuauaaauaaguuguacaugauaaaauggcauugauacugcauuuagcauacaauuuugcacuuagauuugagagcauuuuuguugaaagagauucaguaguuucauacuaaaguuccaaauauuacagaaguuucucagcuauagagcaacuucugagaauuuuuuaauauaucuguuuuuggucuuuaagauuacuaccacuuauuaagcacuagaggggaaaaagagaaagccacagguaacuauuuuuuuuuuaacucaucuucuaugugugaucauacaagcaauuuauuguaggaaauuucaaaauauagaaagcaucaagaaaaaaacuaaaagcagcugggugcagucgcucacaccuguaaucccagcacuuugggaggccgaggcuggcggaucacaaggucaggagaucaagaccaucuuggccaacauggugaaaccccgucucuccuaaaaauaaaaaaaaauuagcugggugugguggcacaugccuguaauccuagcuacucgggaggcugagggaugagaaucccuugaacccaggagguggagguugcagugagcugacaucgugccacuucacuccagccuggugacagagcaagacgcccuuucaaaaaaaaaacuaaaagcaaccaaaaucuaucccauuacccaggggauaacuacuuuuuguuguauauucuuaauuuuuuuuccaaaaguaaacauucuaauaaaacauacaaaacuauuauacauuuuaacuuuccugguaauggauuaagucuuaauguucaauuuuguuucaaauacauauuucagauuacuguuuauuucagguucgcggaccuucccgagcugauccuaaccaucuuguagaugaucugcuaacaccuugcucuccaggugacccuggugccauugaaaugacauggauggaugucccuggagauaaacuuuuggagccaguuguuuccaugguuugaaauuuuguuuguuuuuaagaaaauauuuuaaaacauuauacuucauaauuuucaguuauauaagauuugcuggaaaaucuuaguauaaacagguguauuuuacuuaauauuguugacucauuaaaaauuaugaaguuaauugaacuuaaaauauaaaaagucauuauuuuuaaacuauuuucuuggguuuagaggaaccuuuaagugaaaaagcuauuuuuuaaagcacaagauucugacuuuacaggucuuauagcuagaauaucuccaaaaugcucauauauaguauaauuauuguaaagaccuaacuaaaaaauaggguuggugaaauauuuuuuuuccccugcaucucagauuuuuuaaaauaaccagaagucaccuguaaucccagcacuuugggaggccaaggcgggcagaccacuugaggccaggaguuugaaacuggccuggccaacauggugaaaugccaucucuccuaaaaauacaaaaauuagccaggcaguguggugcacaccugcaauccagcuacucagcugaggcaggagaaucacgugaaccagggaggcagagguugcagugagccgagauugcacaaccgcaccccagccugggcaacagagcgagacucugucuccaaaaaaaaaacaaaaaauagggccagguacgguggcucaugccuguaaucccaacacuuugggaggccgaggcggguggaucaugaggucaggagaucgagaccauccuggccaacacggugaaaccccaucucuacuaaaaauacaaaaaguuagccagacgugguggcacgugcguguagucccagcuacuugggaggcugaggcaggagaauagcuugaacccaggaggcggagguugcagugagccgagaucauaccacugcacuccagccugggcaacagagcgagacucugucucaaaaaacaacaacaacaaaaacaaaaaccagaaauacuaaugcuuguaucauuguuuuuauaguguuuucuauuucacuucucaaagcuccauagaaaguuuaaauauuguaguucuauuuuuauuuuuaaaaauuacaguuaauauaguuuauauuggaagaauuaaaauaaucuacaagacuuacuuugcaaggcauguuauuuuuagggaacuuagggugauugaaaaguuguuuacuuacagaagaacauucucaguuuucaaaauuuucugucaguuucagaucuucaaagaccuuuaauggcagguuuaauaguaacuuccagaggagaaacuuuuacacgguacauagauauacauguaaauguguauacacccauauauuugugugugaacuaaccauaaugcuuaucugagaaguuacucagaaaccccuuuguuuuaauccuugguguauuauuuuuuauuuuuuguacuuuguucagcuuugaagaauuuuuaguaacuuagagugguccuuuucauuauuuuucauauccuuuuacaggagucuaggcuuagaaguuaguuuuuuaaugaaucucugauauuagcauauuuuucuaaccauuucgaucuuaauuguaacuaauuauuuuaaaauucugguuaguagauuuuucauagaaugguauucugcuucacuuaaguguaagugaaugauauuuuccuuuugaauuauacugacuuggaaaauugaucucguuuaagaaaaagagauaaggccagaaauuagaucaugaacauacuuuggaggccuugauccucagacuaaggggauuguccuucugauaaguauuggggagccauuugaucaguucaggggaagaaaguauacguuucuacacaaaggaauaacaugaucaaagaucaugaaagaucugugaaagaauaggggccgggugcaggggcccacgccuguaaucccagcacuucgcaaggcagaggcaggcggaucaccugaggucagggguucgagaccagccugaccaacaaaacgaaaccccaucucuacuaaaaauacaaaaauuagccaggugugguuucaggugccuguaaucccagcuacuugggaggcugaggcaggagaaucucuugaaccugggaggcagagguugcaaugagccaagaucacgccacugcgcuccagccugagccaacagagugagacuccaacucaaaaaaaaaaaaaaagaauagggaguuuaucguuaguaucuuauggcagacugcaaauauucauauuuaaacuuagguuaaaguucauagcaauaaugauaauaugacgguuuuuuauuuuguuaacucuauuauuaauauccucccuacccuucuuuuucccugacagucggauauguugcggucacuaucuaacacaaaaccuacagucaaugaacaugacuuguugaaauuaaagaaguuuacagaagauuuuggucaagaaggcuaagccaaagacaaggaagaugcuuaccauauguauucuuucuuucauagauauuuuugucuauuuggaucgcauuaauuguuuccaguaaaacucuuuuaccacagggaaauacacaucucacuucagaguuccauuagguuuuauauuguacuuuuccuccauuacuuauuaaauacuccuauuaacaaaagguacaaaauaacagguuaugaggaaaugagcgauauaugaacggcauaaaaacagaaauuacccaguaaaaaggaugucagaaauugacauacaaauauuuacaauuuuuaugaaugguggucuuugcaaagagcauuuauauuuucuuuuuuuuuuacuaaaaugauauaggguuuauuuuauauuuucaaaaaaauuguuaaacaucauucuuaucaauguaaaauuuacguuauuaaaaaauuacaaaugauagaaucuuuacucagggaugggcaauaaaacagcaaagagcuuugugauuggguuugaaagauuuugaauuauagacagugcucuuaauaguuuuuaauaaguugauauuuuuuucuguguagauuuaaauaauuucuuuaaaagcguaagcuuuggcugggcaugguggcuuaugccuguaaucccagcacuuugggaggcuacgauggguggaucaccugaggucaggaguucaagaccagucuggccaacauggugaaaugccgucucuacuaaaaauacaaaaauuagcugggcaugauggcgagugucuguaaucccagcuacucaggaggcugaggcgggagaaucacuugaaccugggaggcagagguugcagugagcugagaucgcgcuacugcauuccagccugggcgccgagauagcgccauugcacuccagccugggcgacugaauaaaacucugucucaaaaaaaaacaaaaacgguaagcuuuuauauuuaauuaacugauaccuuucacugugcaaucucaagaggaagauuuucuaaauuagacauugucuuuaccuuaaagaagaaaauugucuauuucagugucuuuuuuagcaagauugaccaaaacaggugguagguguguaauuuuuaacugucaugaaauacuguaaugcgcaccuuugcuaauaaggaaauggucucccuuugaauuaugggaaguuucuugucugugauauggggugucuguguacauauauguauauuuccuuuuuuaauacaggauaauaauauggggucuuguccuucaccuuuuaaguucagggaacaguuuguccugaccacacauauguuaucaguguaaugcuuuaugaagcuuuagaaaugagcucaugacucauuaaaaaauaauaaacgaugcuauuuuaauauuuucaaauaaauaaucugaggauguguuucauacuuuagcaucaacgcugaguugugccuuguagaauugcauugucuauacaugcaaaagacuauuaaguuaggaugaacuagauucccuaauuacagugaaauucuaucuugcaaaugcuauagaauaacuugcauuuuaaaguguauuugcacauuuuacauaugcuaugugguugccuuuggguuuucuguacagauuguuuuuguuauuaaauggaaaaggccugaauuaugcucuuaugugaaguaaauugauauaaccuauugacuguauucuguguauuauucuuuauuuugggaccuucuguguaaaagaaaauauuaccuaaauugguuagauacaaagaaaucauuaaaauuauuaauguauauaugaaaauucuguuuuucaaugacuuuuaugugaggauugagaacuaacuuaguaaacuaacacugaauucuuuguggauaagauaauuuauacaucuuaccuguuuaucagccucagaauuauacaguacugcuguguguucuuuauggacagauacucaaaggaauccgaaugggcauguucuauuucucuggcucuugaccaguaauuauaaaguuuagguagacauuuucugagccagcaaguagaucauaguuguuaagcaucucuaugacuuacacccuggauauuugaaagcauuuugucucacccugagaaaucuauaaggacucuauaauuauaaaacaugucaauagagaauugacuucugaguccacugucaacuacaugcagaaaaacagaaugaguguacuugauuagugccacagaagcaccauuuagccacuuucagaguugauaaagaggcauaccuaccugauggugcuguauguugcaagugaagcaacacagugcccauuguugacacuaauguuauuuuaaguuugugaguuuucacaggugcccuuuucuuuccuacuuucaucccuucauuuguauccuccucuuauuuuaauaugguaucuuucuuuuuuuugcuaguccacaucacguauuuccauuaaaaccuaaugaugaugaaccauguaaccucuugcaggaagaccacccaaacuacccccacccuacuuuuggguuucuuuagcaguuaaauugcugcugcugcuguguuaagauuuuucucuggagcauguucuauugaucauguuuagaucauuuagauuguaaguucugagaguuacauuuuccccagcaauuaauauaguguugagugcuuuuagguacuuaguaaagacuuggggaaaaaaaaagggaguuauauuuuuauuuugaucuaccucauggauuaugugagagacuuauaaaauagguaaguuuauaaaguggcuuuguucuuacuggucuagugaaguuaugauaaauuucugucucggugauugagaacuacacaaucaaaaauguauucaaacuagcucacccuggcccaccaaaaccgauaguacaucuuucccagcugcgaguucagugaccucauacuaguaauuuaaagucugcucugaugggaauauuuauaccauagaaaccagcaagaguucaguuagccguaaaaaaucaaggacugccuguaacuuaaaauaggaagauuaauacuauuuacugcauuuauggaaauaaaggagacaaguucuuuauagaugcauaaaaagcaauacaauucagcacuugcuuuuuuuuuaacugcacaaacuaggaauagaagggaacuucuuaauagaagaaguucuacaaaaaaaaccuagagccaacauauuuaauugugaauuuuugaaaagcguauuccuccagagaucaggaaaaaggcaaaggugcccacuaucaccacuuuuucucaacuuuguacagauucuagccagugcaagcaaaagaaaugaaaggcuuacagauaagaaauaaaauugucauucacagaugacaugauuguagaaaauugauauaaacguagaaauaaugugaauuuaacaagguugcaggauacaaagucaaaauuaucuuagcaacaauuagaaauugaaauuaugagaguggugugugccuauagucccaacuauuggggaauugaagugggaggaucacuugagcccaggaguucgaggcugcagugagcuauuaccacaccacugcacuccagccugggugagggaacgagacccugucucaaaaaaaaaaaaaaaaaaaggaaaauacuaauuacaauaguaucagagagcaucaaaugccucaaaauaaaucugcucaaagauuggugagacugacuuguagaaaaccauggaacguuaccaaaagacacuaaggaagaccuaaauaagaggagggaucgacccuguuuaugagauagaugacuuaaaaaaacaaagucaauuuaaccaaaucaauuuauagauuuaaugcaauuccaaaucuggaucugggugguugauacaaagggugugugugugugugugugugugugugugugugugugugugaaaacucauaugcuuuacgcugugcauuuauauccagauacauagauauccagaaauaggcacuaaauaauuuacugauucuuaaaaaucuuuucuaguuuguuuuuaugauagugucuccuaaguagauuuuucuguccauccauccauaaucauucauccagaaaucugcauguucacacagacaucuggaaugacuuccacauaaugcucaugauguuauuagauugauuuuuuuuuuuuuuaacuuacuuuacuucuuguauccccuucaggucuauuccgaugucucuuuuucagugaaaccuuccuuggccauccuacugaaaaugacaaacccuccugaugcuccuuauccccaucccuggcuguauuuuuccccauagugcuugucaucuaacauacgauauaauuuacuauuuuccuuacgugauuucucccacuaacagguaugcuaugaaaucagaguuucuugucuguuuuguccucugcuguaucuccagugucuagaagagugcuggugccugauggguguucaacaaguguuuguugagugagugaaacuuacuuuguauucuuccuaaauuugaacaaucagcauguauaauuucugccccccaccccccaguguucuucuaaaaagaaaauuaggacugaaaauaccucaagaaauuaagugacuaaauucuggugaauagaaauauggacacuuuuauucuuuucuuuauauuuuaucuuuauuuuuaauuucucaaaaugaaguuuuaaggggcugggcgcaguggcucaggccuguaaucccagcacuuugggaggccgaggcaggcggaucaccugaggucagggguucaagaccaaccuggccaacauguugaaacccugucucuaauaaaaauacaaaaaaaaauagcuuggugugguggcuggcgccuguaaucccagcuacucaggaggcugaggcagaaucauuuguaccugggaggcagagguugcagugagcugagaucaugccauugcacuacagccugggugacagggcgagacuccaucucaaaaaaaaagggaauuuuaaggaagaauuugguugacagcaaaucacaggaauuaggacuccucucccucuagaacucaagaaauaacaggaaauguauuaaaaagagaagaccaggacagucagacagucaucaaacagauguacucuggagaggcacuauucauccaaaugccuuccggccucccaacacaggaaccaaaguggggagauccuauuuuucuucaucacuugguagccaguaccugggcccuuuauguaaccuuggcauaucaggugcugccacucagguccuucagucuugaacaaguaacagagauggcaggacauuuaaaauagaaucauagcagcaucaccagcaucuaacuggaugggacucugguagcuccuagugagauagcugacuauauuauuaccuauggucacacggaaugaagugcccagugaggacaagacauuggagagccacuuggcagcugcuguagaacaaaauacagagcaugagaacuucaaacggcuggucagggcagagaaggaaaaccagggaucuucuaugacuguccuaaaauaauuucuuacagccagugccuaaguaaucaaaagccaaacucaguauuugaucuugcagguugcuggcaaucaguugaauucacagauucaccacauuuuguaugugaaaggaagaaaauuuaguaggaaaacagcaggcccuguaguauuagaauguguauauuugugaaaauuuggaggauucugaauaucagcaacuaucuggaacauaugugacaguggguuaugcugaugaucaaaaagcagaggaaucaaguuucagauaugauuggauuuaucacuauggguucagucaacagaaauucuauauucaguuuuugguuugagccacugagagugacuuucauuguuugccugacugcuugaagaaacugaacuugacaguggacccucucugaacuccaguaacauauaauguaaaagaaaaaaagcuaacaacuuuagaaaauaaagcuuuaguggauuuaccacauaagaccuauccacaaagccacaguguuccuagagaacuagaaucugguuccuuaauccaagcuuugguagguggaaagaa

SEQ ID NO: 12825 - RNA, 2096 nt, Homo sapiens
gaugucucaccugcugaugaaacuccuacgcaagaagaucaagaaguggaaccucaaacugcggcaguggaaccuaaaguugcagggggccucaaaucugacccuguccgaaacucaaaauacagaugugucugaagaaacaacgggagguggaaagguuaaaaaaucaaaacauucuaugaaugugggcuuaucagaugcucaaaauggagaugugucucaagaagcaguggaaaauauaaaaguuaaaaaaucuccccagaaauccaccguauuaaccaauggagaagcagcaaugcagucuccuaauucagaaucaaaaaagaagagaaaaauggugaaugaugcugagucugauacaaaaaaagcaaaaacugaaaacaaaggggaaucugaagaagaaagugccaagucuccuaaagaaacagaaaauaauguugagaagccagaugaugaagaugacagugagaugcccagccugccccugggacugacaggagcuuuugaggauacuucauuugcuucuuauguaaucuugucaaugaaaacacucugaaggcaauaaaagaaauggguuuuacaaacgugacugaaauucagcauaaaaguaucagaccaccucuggaaggcagggaucuucuugcagcuacaaaaaccgucagugguaaaaccccagcuuuucucauccugcagcugaacucauuguuaaguuaaauuucaugcccaggaauggaacagggguccuuauucucucaccuacuagagaacuagccaugcaaacuuuugguguucuuaaggagcuaaugagucaccacgugcauaccuauggguugauaauggguggcaguaauagaucugcugaagcacagaaacuugcuaaugggaucaacaucacuguggucacaccaggcugucugcuggaccauaugcagaauaucccaggguuuauguauaaaaaucugcagugucugguuaucgaugaagcugaucguaucuuggauguugaguuugaagaggaauuaaaacaaauuauuaaacuuuugccaacacguagacagacgaugcucuuuucugccacccaaacuugaaaaguugaaggcccggcaaggauuucucugaaaaaggagccauuguauguugguguugaugacgauaaagcuaaugcaacaguggauggucuugagcagggauauguuguuuguccuucugaaaagagauuccuucuacucuuuacauuccuuaagaagaaccaaaaaaagaagcuuauggccuucuuuucaucuuguauguccgugaaauaccacuaugaguugcugaacuacauugauuugcccaucuuggccauucauggaaagcaaaagcaaaauaagcauacgaccacauucuuccaguucugcaaugcagauucaggaacacuauuguguacagauguggcagcaagagaacuggacauuacugaagucaacuggauuguucaguaugacccuccggaugacccuaaggaauaauauucaucguguggguagaacagccagagaccuaaaugggagaaggcaugccuugcucauuuugcacccagaagaauuggguuuucuucacuaccugaaaugauccaagguuccauuaagugaauuugacuuuuccuggucuaaaauuucugacauucagucucagcuugagaaauugauucaaaagaacuacuuuuuucauaagucagcucaggaagcauauaaaucauacauacaaaccuacgauucccauucucugaaacagaucuuuaauguuuaauaacuuaaauuugccucaaguugcugucauugguuucaaggugccucccuuuguugaucugaacgucaacagcaaugaaggcaagcagaaaaagcgaguaggcagugguggauuuggcuaccagaaaaccaagaaaguugagaaguccaaaaucuuuaaacauauuagcaagcaaacauccaaccgcaggcaguucucucacugaagacaugccuuucuuucaucuugaauaacuuuguccuaaaaugauucuuuuccucccuugauuuaacaggauuuuuguagccuuuagaauuuggacuuaucua

SEQ ID NO: 12826 - RNA, 766 nt, Homo sapiens
uuugcuugcuuuucgugacgaagcgccucccaccucggccaagcgcgggccgacugggaugcugcgccgucucggggggucccucggccggguaccggcgccuaggccuugggaucggggcccugggcuucgggggacuagaggcuaguaggcgcgaccccgccuggggcucuggacgagcagggcggggacguaaggagaguccuggggcuuggagcucguggccagaggucgauguugcacccucucccuaccugggggagagcaccacucuucucggggugcacagcgagccggccuccgcgcgccggcgggggucuguuuuuucaggggguggagggugggaucggaggcugggaugcuccgaagcugccguaggugggcaugggagcgugucugcgggcguacugagcgcggaggggcugcagccagccacuugagaacuucgaacuccacuucuccgcgcugcgcgucccggagcccugccuuucuuucuuccuuccucaauccuuccucccccucgcccggcccggccgcccccucccccucugcugggcucuccuccucggcccccccucuuugccucucuucuccuccucuccugcccucggcccugagauccgcuugacuucccaaagggauccgcacguaauccuuugccggguccuccgguucccccuuccaccucacuuucaucccugccccccuacucaucgucucuccccacccccgacaaucucucaacaaguauauuugcugaggaauu

SEQ ID NO: 12827 - RNA, 4391 nt, Homo sapiens
cugaaaccaucauggcuccugcaguacugagagcagauggguugggggugggaguggugagaaaguggagcccaucaaauccaggccccagaccguacugcucaggaaugagguggccucacauggccuuguggcccuuuaaguacagcagcagcaggugggugacaccccaaggggccccaugaaauggugugucccugagugaagacugguucacccagccacugccucaucuauccaccuauguauuccaagcccgugcccagugccguccuagguaccagggccuggggaaugagcaaggaugugcugcccucaggaacucagccuguucagguccagugugaggacccgugagcuggcccagcacacugagcuccagcccacagugaggggcccagcagggaggugugccauucccacugcauucugcagccccacuggcucacucuccucuccaggucuacugccaggaccugccaccacuguguucaaauacuuucccagggaaaaccucaucuccaacuaaaagaugucaugaagccaaauugggucuggcucccugaucacaacucuccucaccuugcccugcugugguccuguccaaggaucuaacccaggggcccggcuccauccaccaccggagggcucaagggaaauaagcagggcagggcugcagucuccccuggguccugagugggaccaggccuaacccacugcccaccuccaccccucugcucuccuugcugaccccuacgagccaagcuuacccccaccuugcugccucuccucuccaagcccuggccacgcugugccuggggaggcugacagcucuggauggcgccagugggcucccucccugcagggccucggucuuacaaugguuuguuccuuccucuacauuugagugaagcucuugccaagucucccaugccacagaucucggaguucuggaacaccuccccuccccucagguccagggacucuccuggcacgugcuggucuccuucucccugagugugccaucugcauccacgggaccuugacugacacaacacucuuaaggcccccucaccuuaaaacagccucucaggaccacacuaacuucucaucuugggcucucuagucuuuuaaccucuaacagaguggaggaaaauugggauuugaccaccacuuaaauugaggggugguucuucacuguaggaaaguguucacauaacugcuaguacccugguguugaggugugcccugacucccacagccugguggcacucaagaccaagaaggaggcugggcgagguggcucacgccuguaauuccagcacuuugagagccugaggaggguggaucacuugagcccaggaguuugaggcugcagugagcuauggucaccacugcaguccaucccgggcaacagagugagaugcucucaaaaaaaaaaaaaaaacgaccaagaaggagggaugucuguuuauuuacagugcacccuuugugccaggcccuuauguucaugaccuuacccaacucuacaaucuugcaaggcgguuuacaucaucuccacuuuacaguucaagaaacaaaggcucagauucauagccccugaauagucccucauagucccugaguucauaaguagugguuauaguacaaucuaagcuauuuaauuccaaagccagugauuuuucuggccgugagcuauagguccaaaggcuccaacagggcccuccagacucaauggcaggguggugucugcacaagcuggaaguguccuugugaugagcccaucaggagcggcccggauugagcaucccccuccacaucugcagcacagagucccggcgggugguguaggguaaauguuugauucggaacaagugucuggggacgauguucccgcuggguguauacagcuucuccccgucuuugcccaagagacugcgcagggccagguugcccgacagaagcuucucauagaacuccacuccaccacaggcauaggcugcagagagggaggccgugcggcgguccagccaggacuccacggcaugagugagagaauccugggagaaggcguaggccacaaagccugccacugcugccaccaagcugaaggcagcccguaaauucauggggccugcauggagccccaggguguacuuggcacccacgcccagugcccaggucccugccaggcaagcuggggccagcagggcgugcacggcagugguacugcuuuccagguacaccacuucccuggccaaggcgaacuucugggcuucacgggacaaggucagggaagcucucagccgggcgccugcugggcuccgccaguccacuguaugcccauguaugaccacgggaugguuaguguugaucacuaggucucccaagaaacuggcagggaugcccaccacagccccagcagggagucuugggaagccugcacucacagguuggaaggugaagguggugaagggcuuguagcaauggccugaaggaacaccuauguccuguagcaccucuuggaagaggcucugcagcuguggagggagcggagcuggcuggcccugaggccaguacugguagagccauuggaccacgggauccgggaagaggugguacgagauuggaacuccaaacaggccugcacaggaacccaccaagaggccuguccugugucucugcacaaaugcugcgguccgccacaggggaccugccaugaguguagucacugcggacaaucugggccaagaaaaagagaagucagccaguuucccugggucagccugcagacugaacauccuccaggguccacaccaccuuuuuaaaccaaaguaacacagcauaguggugaagagugugggcucuagagccagagugccuguguucaaaucccagcuccgucucugugcgucaauuuccccaugugccaaacaggugugucguaauggcccaccucuaggguggcggugaugagcacaugaauaaacauacauaaaacauuuagugucuggcacagcagcagauauuccuuauaauaauggcuguaaugacuuuuauucccaucgcugggcacggcacuccaacugccucauuccacucaucccaugguaaagcccuaugauuacuaauuuauaaggaaaaacguguucaauuuauugagugcuuacuauaugcuagacucaguucugagcacucuuaccgauugaacccucacaaccccaugaccuaauuacuacagcuaacccuauuucaaagcugugaaaacuuaaauggccaaaauccuaagcuagugaagugacaguguuaugggcugcacugugucuccuccuccuccccaguucauauauuuaaguccuaacccccaguaccucagacuguggcuguauuuggagacagggucuuuaaggagauaauuaagauaaaaugaggccaucaguauggauccuaauccaauuugacugguguacuuauaagaagagauuaggaugcaaacaggcacagcaggaagaucaugugaggauccagggaaaaggcuaccaccuacaagccaagaagggaggucucagaagacaccaacccuguuaacacccuggucuugaacuuccagccuccauaacucccagaggacaaauuucugcugguugggccacccagucuccgguacuucggcauggcagcucuagcaagcuaacacaggcauagucagguguccacagcaaacuuuuuguuuuagaaaacuuguuaugccaaauuacaagcauauaccaaaguagacaaaauaguacauccaucaacuucaaucccaucaacucauggccaaucuuguuugauuucucuuuccaccacacuuccguccaacugguuuauuuugaaacauccccgggcauccuaucacuucauccgugaauacgucaguaaaaauucacaauuauuucacuuugauugaaacuuacuguauuccuguccgugaaaagugcuuaaugagcaacgaaugaguugccgcaaacaaaaacgcaggguaccgcuuggccuaucuuaaucaagaacuccuauaagaaucauuaucauucgggcuuuuuuuuuuucccaaugcggaaagugaggcuaagaaaggaaaggucuggaccaaaguccaacgucccuagggccaucgcgcugcggggugggccuagaacacaguaccaugcagcccgccgguggcugggggaggaggggcugcaggagccccgcagagggguccucgcuacgcuuccacucugggccccuaggcuacuccgcagucugaacgcguuaccgggucgcaucaggccggagaagggucccucccgcucguccgugcgcucaccuccgccgccgcucggaacgccuacaugugcgcgcggcagggc

SEQ ID NO: 12828 - RNA, 4391 nt, Homo sapiens
gcccugccgcgcgcacauguaggcguuccgagcggcggcggaggugagcgcacggacgagcgggagggacccuucuccggccugaugcgacccgguaacgcguucagacugcggaguagccuaggggcccagaguggaagcguagcgaggaccccucugcggggcuccugcagccccuccucccccagccaccggcgggcugcaugguacuguguucuaggcccaccccgcagcgcgauggcccuagggacguuggacuuugguccagaccuuuccuuucuuagccucacuuuccgcauugggaaaaaaaaaaagcccgaaugauaaugauucuuauaggaguucuugauuaagauaggccaagcgguacccugcguuuuuguuugcggcaacucauucguugcucauuaagcacuuuucacggacaggaauacaguaaguuucaaucaaagugaaauaauugugaauuuuuacugacguauucacggaugaagugauaggaugcccggggauguuucaaaauaaaccaguuggacggaagugugguggaaagagaaaucaaacaagauuggccaugaguugaugggauugaaguugauggauguacuauuuugucuacuuugguauaugcuuguaauuuggcauaacaaguuuucuaaaacaaaaaguuugcuguggacaccugacuaugccuguguuagcuugcuagagcugccaugccgaaguaccggagacuggguggcccaaccagcagaaauuuguccucugggaguuauggaggcuggaaguucaagaccaggguguuaacaggguuggugucuucugagaccucccuucuuggcuuguaggugguagccuuuucccuggauccucacaugaucuuccugcugugccuguuugcauccuaaucucuucuuauaaguacaccagucaaauuggauuaggauccauacugauggccucauuuuaucuuaauuaucuccuuaaagacccugucuccaaauacagccacagucugagguacuggggguuaggacuuaaauauaugaacuggggaggaggaggagacacagugcagcccauaacacugucacuucacuagcuuaggauuuuggccauuuaaguuuucacagcuuugaaauaggguuagcuguaguaauuaggucaugggguugugaggguucaaucgguaagagugcucagaacugagucuagcauauaguaagcacucaauaaauugaacacguuuuuccuuauaaauuaguaaucauagggcuuuaccaugggaugaguggaaugaggcaguuggagugccgugcccagcgaugggaauaaaagucauuacagccauuauuauaaggaauaucugcugcugugccagacacuaaauguuuuauguauguuuauucaugugcucaucaccgccacccuagaggugggccauuacgacacaccuguuuggcacauggggaaauugacgcacagagacggagcugggauuugaacacaggcacucuggcucuagagcccacacucuucaccacuaugcuguguuacuuugguuuaaaaaggugguguggacccuggaggauguucagucugcaggcugacccagggaaacuggcugacuucucuuuuucuuggcccagauuguccgcagugacuacacucauggcagguccccuguggcggaccgcagcauuugugcagagacacaggacaggccucuugguggguuccugugcaggccuguuuggaguuccaaucucguaccaccucuucccggaucccgugguccaauggcucuaccaguacuggccucagggccagccagcuccgcucccuccacagcugcagagccucuuccaagaggugcuacaggacauagguguuccuucaggccauugcuacaagcccuucaccaccuucaccuuccaaccugugagugcaggcuucccaagacucccugcuggggcuguggugggcaucccugccaguuucuugggagaccuagugaucaacacuaaccaucccguggucauacaugggcauacaguggacuggcggagcccagcaggcgcccggcugagagcuucccugaccuugucccgugaagcccagaaguucgccuuggccagggaagugguguaccuggaaagcaguaccacugccgugcacgcccugcuggccccagcuugccuggcagggaccugggcacugggcgugggugccaaguacacccuggggcuccaugcaggccccaugaauuuacgggcugccuucagcuugguggcagcaguggcaggcuuuguggccuacgccuucucccaggauucucucacucaugccguggaguccuggcuggaccgccgcacggccucccucucugcagccuaugccugugguggaguggaguucuaugagaagcuucugucgggcaaccuggcccugcgcagucucuugggcaaagacggggagaagcuguauacacccagcgggaacaucguccccagacacuuguuccgaaucaaacauuuacccuacaccacccgccgggacucugugcugcagauguggagggggaugcucaauccgggccgcuccugaugggcucaucacaaggacacuuccagcuugugcagacaccacccugccauugagucuggagggcccuguuggagccuuuggaccuauagcucacggccagaaaaaucacuggcuuuggaauuaaauagcuuagauuguacuauaaccacuacuuaugaacucagggacuaugagggacuauucaggggcuaugaaucugagccuuuguuucuugaacuguaaaguggagaugauguaaaccgccuugcaagauuguagaguuggguaaggucaugaacauaagggccuggcacaaagggugcacuguaaauaaacagacaucccuccuucuuggucguuuuuuuuuuuuuuuugagagcaucucacucuguugcccgggauggacugcaguggugaccauagcucacugcagccucaaacuccugggcucaagugauccacccuccucaggcucucaaagugcuggaauuacaggcgugagccaccucgcccagccuccuucuuggucuugagugccaccaggcugugggagucagggcacaccucaacaccaggguacuagcaguuaugugaacacuuuccuacagugaagaaccaccccucaauuuaagugguggucaaaucccaauuuuccuccacucuguuagagguuaaaagacuagagagcccaagaugagaaguuagugugguccugagaggcuguuuuaaggugagggggccuuaagaguguugugucagucaaggucccguggaugcagauggcacacucagggagaaggagaccagcacgugccaggagagucccuggaccugaggggaggggagguguuccagaacuccgagaucuguggcaugggagacuuggcaagagcuucacucaaauguagaggaaggaacaaaccauuguaagaccgaggcccugcagggagggagcccacuggcgccauccagagcugucagccuccccaggcacagcguggccagggcuuggagaggagaggcagcaagguggggguaagcuuggcucguaggggucagcaaggagagcagagggguggaggugggcaguggguuaggccuggucccacucaggacccaggggagacugcagcccugcccugcuuauuucccuugagcccuccggugguggauggagccgggccccuggguuagauccuuggacaggaccacagcagggcaaggugaggagaguugugaucagggagccagacccaauuuggcuucaugacaucuuuuaguuggagaugagguuuucccugggaaaguauuugaacacagugguggcagguccuggcaguagaccuggagaggagagugagccaguggggcugcagaaugcagugggaauggcacaccucccugcugggccccucacugugggcuggagcucagugugcugggccagcucacggguccucacacuggaccugaacaggcugaguuccugagggcagcacauccuugcucauuccccaggcccugguaccuaggacggcacugggcacgggcuuggaauacauagguggauagaugaggcaguggcugggugaaccagucuucacucagggacacaccauuucauggggccccuuggggugucacccaccugcugcugcuguacuuaaagggccacaaggccaugugaggccaccucauuccugagcaguacggucuggggccuggauuugaugggcuccacuuucucaccacucccacccccaacccaucugcucucaguacugcaggagccaugaugguuucag

SEQ ID NO: 12829 - RNA, 5639 nt, Homo sapiens
uucugauuggcuuuccggugcucgcccgagcaggguuggggcgaguggaccgcgccucuaaaggcgcuugccagugcaaucugggcgaucgcuuccugguccucgccuccuccgcugucucccuggaguucuugcaagucggccaggaugucucagguacagcgcgugcacagccaggcugcgaaggugcagcgggcgggaggcccguugggggcucagccggcugccagaagcucucgggcucuuuccuuccgugccccucacuugcucaugggcccaugccuagcccugauucguuggacagagccuugugagcgggauuuuccguuuggggauuucuaaaucugcugcccaccccgcaacugccggaaaguugcccaugggguggacuucgcuguguagcgggagaggggugggagucgagggugcuugauggagagaugggggaagggguugcacggauuggaggagcgaggagacucaguccccaucccgaagcacagggcaggacgucgcggcggaguggggaagcgaggaguccguggccgagagcuuggaggucaggggaaguacggggccggcugcucagagugcgggacgaggagaaucgcggcccggggagaggugacccaggggccccucccuucucuccaguguagacccuugucugagaccgagcuauguggggcgaccucuggcuccucccgccugccucugccaauccgggcacugggacagaggucgguguugaacgcgcgggccccagggggagggaggggaccaacgggcuccggcgcugacaccgcggcacucaugcccuguccccuuucagcuguuuccagcauacugugccccgucuguccucaggccagggcuucgcugcagccccggccacucccuagugccuggcccggugguggccaggcaguuggccgcgcugcuucucccgcagaggggacccccacugggggcgaaggcuuggccugcccucuucacugcuguauuuccagaccugaugccugcguuugugagagcucuggauauaugguuuucgauugaaugagugaacuggaggggcuuccccuucuuguguugcugaaucuuucuagcugcccuguuggggcagggaggggcagacacacuucaggggcugcauugcccgaagggugccaccuuucccaccucuccauccccguaacugggcugucaucaggccacaguaggauucuuacccucucccacccagaggaggcccucaauccucuccucucccuuccauuuaggcugaguuugagaaagcugcagaggagguuaggcaccuuaagaccaagccaucggaugaggagaugcuguucaucuauggccacuacaaacaagcaacugugggcgacauaaauacagguaugcagagcggggguuggaagggcaucugcucaucaaagcaggcucagcagcucagacuggaagucccugggaacuucacucucaaacugccugaggcccuacucuucaggugggguauggugaugguuccugagguggaaaagaccauguuccggauucucagugucuccaguaguaacagaauucaaauccugguuuuagaaggucuuuacugguuaucaccagcagcuacucucuacuagggaagaagcaaaggcugcagcuuggaaaagacuugcugaaggcucucagcucaguaguaucauuguugagccguucagcuucugcccuagaugggcaggaucaaaguuggagcacuuuuuggagcacuugacagccuggccaagccugaugucaggagcagagaagcaccugguuucuugggcuaggucagagcauuucgcuaacaagucugugccuuccugaugauaacuuuuucccugcccagaaaucuuggugcagauuuugaggcugugcuuuggacugucauguucuguaauaacaucuuuccugccuugggcagguuucauucugucccuaagucccugaaacauggguggauacugaggcaacagcgcagugcauucugugcaaggacucaggguuaucauggcagcacagaagggaggucuccccugccccugcugaggaagaaggcgagcauggucccuauuuccgcaguagcugggguggaagauggagcaggugggcuggcugccaaccagcuggaagcaggaaauaguacccagaaugacagaucacaggcaguaccauaucaaacccugggguucacauggagcacuuaguugaagaaggucuuauggcgaaggugaguuuuacagugaguucguaaacucuguccuuccagggaggggaaggaaaggugaagugggggaggccagaggugccaagaugcuuuucugacaaacaguauuuucacagagacuggccugugcccguacuagaguuaccgauuuucacaugagucuagauagacuggcauaggaaucuaucacuuacugaucaaagaggugucaucggcucucucuagggcuguacuauacagcccuauuacacgauuauaaaacaugauaguccaaacacgauaguuuaguauaauagccaguagccacauaugacuauauaaauuuuaacugaggcugggcgcuauggcucaugccuguaaucccagcacuuugggaggccgaagcaagcgaaucaugaggucaggaguuugagaccaaccuggcuaacguagugaaaccccaucucuacuaaaaauacaaaaauuagcugggcaugguggcauaugccuguagucccagcuacuugggaggcugaggcaggagaaucgcuugaaccugggagguagagguuguggugagccgaggucgcaccacugcacuccagccugggcaacagaacgagacucugucucuaaaaaaaaaaauuuuaacugaaaauaguuaaauaaaaucaaguuuagucuucauucacaggaaccacauuucagaugcccaguagucauuucagguacuugguguggcaaguggcuccugaauuggacauugcaaauauacauguacauuuccauuuccaccgcuuggagagagcugucgaggagugcuauucuaggauccugaugaugaccacaagggcaguuuguuucagcugucccugggaacacuucccugaaagcgcucagggacauuuucucaggcacagugcuccaggcuacggacucugauuguucccuguggcuuuggggcugggcaucguagugaaauaggacaacagggagauggugaguguguuucccaacugcagaugacaacaggucuauaagcauaaagucaucauauaacuuaaagaaaccuuacccucggugaaaucucccacagaucagcaagaaauagacuaacaauucgguagaaaaauggggcuaggauauaaacaguucauaggaaaggacaccugauaucauuaaugauuagggagagaaauuggguagcuaacagcaggggugagagagaaacuuuauaguauuuuccucuguagcuuuugaauuuuaagacauaugaauggauuuuuuuuuuaauuguaauuaaaguauaauuuuuuuaaaagagaaauuuuggagucauuuaacuuguaagacaaaggcuaucuuguaauaagaauacuguucuuccuauuugcucuagauuuuaaguuuggauuggcauacauugguuuucuuagggcagaacccacucuacuagaccuauuuaaccccaugacagagccuagaaggaacagguguaauagaagauggcauuuauggcaagaagguugaucaaguucuccauuagaauuugaaccagaucuaaugccuuuucuucccuuguuuaagaacggcccgggauguuggacuucacgggcaaggccaagugggaugccuggaaugagcugaaagguaauuguucuaaucaauuucucucauuugugaaacccaguagugaaagagucuucauuaugaaguguaagggaagaggagagaaaacaaagucaauggggcacgugugggaaaccagccugaccugugccagaaugggaaaaaaccgggccaccuacuuuuucuccuaacaccauuuaugccuuuucuaaaagcaccaucucugagcaggagcaucaucuagagaggaggggcugggaaccaggccacugaaaaauaguuugggaaaugauguaguuggcguaggcuuuggauguguucagaauaaggggugguuuccugucugcaacucccucuccccuacaaggccaggcggugacccccuaaccccaguggcccuccccaguuccuuccuagccagaaggauacauaaaagaagggaaugagcuaaugcauggccugccgcuggcaucguaggcucagugaauggagccauuauaugcuaagcaccagcagccaagaaguauccaagcucguacuuaaucacgugccaccugcagcagcaagacccaagaguuggcaccaaagcuccuggcagcauuaguguuccugcuggcuaguuucugaauaagcccucuguccuucugcgaaugagaaacccuugaauucagaaagggccacaauacaauaaacacacuccuaggaucugcaaguaacugggaagggaaugcccaucugccugcccauuuucaugggacauuuccauaccauccucaggccccauguacucuccagugcuucagaacaagcucugaguuccaaagggucucuauccuucaccauagaauccaggaaacugggugucacugucucugagggauacauucaguguccuuucuacugcagcaagaagacaaagauuugucucauuccccuccaagaagcagccacuuuuggucagaguuccugaaacuuuucucauagccucucucuggggagaagagggugccuggcuuugcuuuuucacugccagcuuaacagcucuggaagauaggagcccaaaacagagacacugaaaaggccaaagccaauaucagccacgagaguuagcaggaccaguaaagucaccacgaugacaguuuccuaccugucuggaggguggcaccucucucccaaggcucacaauggccauucccccaggacaggugggggacgcagguguccagcagaugggcgacagaucuuggccagccccaccaggcuuucugagcacaguugcuuauggagcauucacuucgggccagguucuguggauacugucuccuguaauuaguagaaucucaacuuuauuaagugagaaacugagccuaggagaguuacagcagagcugccuggggcucuggaggcugcuuguuuccuaccaugcuaccucccugacacauaauccugucgauuccuuacagggacuuccaaggaagaugccaugaaagcuuacaucaacaaaguagaagagcuaaagaaaaaauacgggauaugagagacuggauuugguuacugugccauguguuuauccuaaacugagacaaugccuuguuuuuuucuaauaccguggauggugggaauucgggaaaauaaccaguuaaaccagcuacucaaggcugcucaccauacggcucuaacagauuaggggcuaaaacgauuacugacuuuccuugaguaguuuuuaucugaaaucaauuaaaaguguauuuguuacuuuaaa

SEQ ID NO: 12830 - RNA, 7008 nt, Homo sapiens
gugaacagaaagacaaaaucccuguccucauggagcuuguauucuagucaggggggcagcugauaaacaaaguaaauaauuaaauacaugguauacuagaaagugauaagaacuaagaagaagaaaauaacgaaggaaggggaaugaacuguuggaguaggguugaauuuuaaaccaguaacuggggaaacccuugcggagaggugaauuuuagguaaagauuggaggcaagcaaggaagggcuccagggugauauauacaauggcacgugcaaaggccuugcggcugggcaugucugggauguuucuggcacagugaggagaucagcagccagcacaggagugagugaggggagagcaauagcagaugaauauggguuuugaagaguaugugguaggaaaaucugaccugaucugaggaggggguugcugguuaggggaagugaugaucauagggcaauaugaaggaugaaggauaggugggaguuaacuauuaauaggugaaaggggugggugugggaagaguguccuaguaacaggaaggggucugauggcaaggaggcuggaaauggaccuggcuuuuaugcugagauggcagcuaugagagggugugagcagggagagacauuaaccgacuaacgcuuuaacaagguugcucuggaugcucuguugagaagagacagcagagaagugagagcaguuaggaggcuacuucagugauccaagugguaccaggaugggcagugguggaggugagaagcacucggaugcugggugugugguaaagggagagcugauggaauuugcugcuagacccagauacagagugugagaaaaagaaaggagucaggaaugaccccaggauuuuuggcuugagaacaaacauaauggauuugcuguuggcugaguuggaggugacugcacagggaacagguuuggggguggugaagauggaaggguagcauugaucauucauucauuccauaagcuacuuauuaggcacaucuaaaugcuuggcagugugccagggcuggaaguaguggggagugaugccuaggauggucccuuaccuuguuauccuaauggcccagcugggaagagguaccauaauccaguaaucaugcaauaagugcauaaauagcauuaccacaaggucuacacaggaggagaacauacauuuugaaggguaggugguaggaaaaucuaaccuagucuggggagggagcugcucauuaggggaagugaugaucacggggcaauaugaaggaugugugagaguuaacuauuaauagguaaaagggcuggaugugggaagggcgucccaguaagaggaacagcauaugugaagguccuguggucagagaaagcaugacagcgucggacauuugaggaagaguagaacaggcagaguaccuggaaaacagcagggaagagagcauguuagagaagaugcucgaaaggcuugcaggccauaugcaggucauuuguuaugauuagaaaagcaaugagacaccauuaaagcacuuuaaacagaggcaggagcuguccagguguccauuuuugaaagaucacucuggcugcagagaggaaaaugaauuggagagcaccagacugcaaguggaagacccagaaggaggugauugcacaauccagcaaagagaugauaaaacuguggacagaaacuggcagauugacaagauauuuagaagguaaggaaaccagcaguacuuuucaauaugcugguaugagggaugaagagagaaaauagaaagauugugucuuuuaaucaugaauguagacagaauguagaaaaugaaacucagggucuuuuccuauuauuaaacaauuggcuacaaauucuuaaugagaaaugcagcacacuccaaacacuuguguugccuucuacuaguuccugagauaaaauucuugggccuaaaauuguauauauaucauacuugggcugaacugaguagaggcaucuaaauccaguggcagagccaugggaagcaguggaguggggugaggaguggagagggauuaaagccacaguaagcagagauagacacagcuggcuuugaagcucagcccugccaucugcuauguaugagguuuaucagucacucaucgagucugagccucagggucuuugucuauaaaaugaaaauaauagcaccaaugcaauguugcuugugauggauagaugaaauggcacaugcaaagugaauacccaguaccugaaacaggauuaauaaaagguuauuguaauuauuauuuauaauuaugcuacuguuuaucagaggacuuuagcaccuugauuuacagucugccuguaucagcuagcuauugcaauaauaaugcugcauaacaaacaacuccaaaagucaguggcuuaaaaaaauaagcauuuacuuucacucuuuuauuuguagguuagcugaguucugcugagcucaggcuccacaggugauucuaggaaucuacuggguccagaucugcuccacaggucuugggcaugccauucucauugcagcugcaggagcacaagagggccagcuuaaauauaccagcauauuucaaaccucugccugcaucauguucaccaguguaucuuuggagaagagagucacacagccaaauucaagaaguggaaaaauauacuucaccucuagugggaggaauugcaaaaucacaugacaaagaauguggacauagggagggugaagaauuagggccaauugcccuauuuaucgcaucacucuucaacaccucugcuuuuccacgaagaaucauuugggaucauucagggauagaaaaauggcuguugagacccaagucucuuuuccacucuaguuucuuucaucuccauguuccucccagcaauucuuuuucagggcugugacuuuguguuccuuucaaggagggucagucaagcuucuuugauuguaagccaaagcaaacaacucuugccauucuaucaaaaagggaaucaaaugaaggcuaucaggcagcucaaagacguucaggaagcuggagaaccaggcuaaaaacagagcauaugacagcaggccagcucuggggauccucgcagcagaaccugcacaacucucugccaggcacugaugcuggggcaagggagcucccacaaggcuuuccgacacugugucuuugggcucaggauucaaaguccuaaaagagagucucauuggcuuaacuccugucucuuggucaggacaggguagggcaccacaguuuauagauuuccagcacuauccaaaguaggaaauaguggcuucccaaaagaaagucagaaugcuauuaggaagagagaaugagauaagauguccaaaaaaaaaaccugauguccucuuugucagacuuccaagccaaugguguaacagaaagagccuuggagagcugacaugggcuggauuuuauccacuacucugccacuaacuugcuuggaacaccgaaagcugaauucuguggauucuuucuucacaaacacuuguauggcacuuaacgguguugcaggcaauaaucuaagaacuuggcaaauauuaacucagcagucccugaucucaaggagccauuagggaggacggcaacuuaccucaucucacugauugguuguaaggacuaaauaaacaugugaaacaucuagcagaacuccuggcaugcagauaauguuaaaaaaaaaugccaguugccaucucccaccaaucccccacuuccaucuuauggagagcuccauaagacaggaaacugccugagguuucagggaccauccugaguugauauugacauuuaggacagcuccccauuuaauagaacagccugaccccucugcccacuggaguccaauaggagguuugggacauuguaagacaugcuagcacaucuucagagugaacugagguaugaccucagggugucuguuacguccaucuucagcauuuucucaugccagggaaauuuguugccuccuuuccuacgcucugagcagugccauacacauuccaaugugaugaagggaauguuuccuauuagugcugucuaguaugguagccaauagccacagcuggcuacugaacccaugaaagagggcuaauuuuacugaggaaaugaauuuaaaaauugaauucaauuuuaaucuuugaaauuuaaauaaccacuugugacuagcagccacuggauagagagugcagcuagagcuguucgugcuguagaauacaccucaggggcucugacaccugggguaggggcagccagauggugccuuuagggaaggcucacuggcaaugucucacuuuccacccuuaggaggcugcuucagaagggucucugcuuugaccaucuccagcccuggccccugcuccccccaacuccuagcagccccccccacccccaccccaggguggagcagucagcugacgacuugguuggggaucaucuugcuucaauucugcggcucaguguucucacaaucgacaggcccaaaaguuagugggggugagauaaaugggagacacuuggagaagauuuaauuaauccgggguuucaguucccccagcgcaacucauaccuuuacagccaccugucucuugguugcauucacagguugcauuuuacagaagaagaacaacaacaaaaguccucuauacaccaauaagaagagccaggaccacaaaaugugaaagcugaagggaaccuucaagagcaucugacucaacauccuuauuuuauggguggggaaauggacucauccuaauuuuagcaugggugucuuaaucuguuccuacugcuauaauaaaauaccugagaguagguaauuuacaaauaacagaaauuuauuucuuacugguggcuggaaguucaagaucaaggugccagcagguuugguguguggugagggcugcucucugcuuccaggauggugucuuauuacugcauccucuggaggggacgaaugcuuuguccuuacaugacagaaggaaaagaaagaugaaaaggggccuagcuaguuuccuccagccuuuuauaagaugcuaaucccaucucucaugguauaaucacuuucuaaaguucccaccccuuaggaugguuguauuggggauuaaguuucagcaugaauuuugcagggggcacaaacauucaaaggauagcuguggacaagcuggguguuggccucgcuggucuaguccugcaggaugggcugugggaaaggagacagccuuccucccauaacugagcugaugaagccagaggaaaaggccacaggaucccaagaaagggagcugggggcacacccacagacacguauccaagaucugagcaagggguggggaggagagcggugggguccaggcagacagaaagcuggggcaggugaggucagccagagagggguggacccacauucugggcaauuagcagagcaccccucagggcccacccaaagacucuccuggguugcuggggcccauuucuuuuuucuuuuuuugagauuuuuaacaauagugaauaucauauguguuuguuuauuuuuauuauacuuuaaguucuaggguacaugugcacgaagugcagguuuguuacauaguuauacauguaccacguugguuggcugcacccaucaacucgucauuuacauuagguauuucuccuaaugcuaucccucccccaaccccccacccacccaccggccccgguaugugauguucucuggggcccauuucuugaacagucugcaucuauuuuacaaacccaagaaggagcacaggauuuuaaaaagcagugaaagguagucauucacagaaccaggacucacucccauguccucugauuccccucccaguccucuuuccaccacuucacccuggugaaacaggacacacauuuugaaacagcuuuuccaucuagaguuauuugacaguauacacgauuauaauguuagguauaauuacuugggcuugucuuacuaagggccaggaaugugcugaugguuucauaggccauuaugucacuugauauuccuaacaguucugucaaguagguuuucuucuacccauuucccagguguggaaacaaucuuagggagaucgagugaccuaucaaagguugaagagcuagcaacuggcagagcugaaauuugcacucagcgcugucugacuugaaacucuugcucuuguaagucuuguggguggagcaguacugccucccuagccacacugacagacucggagacuuacagguggcaugacagccuggggacgcagggcuugguagcagcauagaggacaaaaccugggacccugauccaccucugaguucugugcuuccuccagagaccacguuuccccuuucucauauguccuaguuuccucuuuuggccaggugacuucacaauugauuuuauuuggcagguggggagaggucucuccugugguggucccaacagugaauauugauuuuugggggccaggagugugcucucauuugggucaucucugaaccacaccacuucuugaguggcaucccauggugaagacgguaccuuguccuuuuggccagcaccuuggacgugaagggaggcaggguucccagcagacugcugggaaaagguuaggagcuccaugcagcauccucgaugaacacuguggaccacuccacaggagaauagaugucugagcaaagagcacucaccacugauuaauaggcaugcacucucccucuacgggggcagggcuggagggcuguuaaucaucucaccacaguucccuucaucagagcacaggagugcccacgugcuccccauguccggggagaggugugccucaaacucucagguagggccaagcugccagccuguccauggcuaccaaaauguuccugggaggaccaggaaggccuuaccuggggggcuuguuccacucccaucacuguacgccucucaccaagcgcuucccagccccacuggagauagcagcucagcuucaccucugagugauau

SEQ ID NO: 12831 - RNA, 16202 nt, Homo sapiens
aaauucuaaagucuacaaaaauccuguuaaaucaaggggaaaaaaaauucauuuuaggacaaaguuauucaagaugaaaggaaggcauguguucagugagagaacugccugcugucagaugauuucuugcuaauguguuuaaagauuuuggauuucucaacuuucuugguuuucugguagccaaauccaccaccaccuccucgcuuuuucugcuugccuucauuacuguugacgucuggaggcaaacauuaaggaaaucaagcaaaaaagauaaugaacuccaaucuaacaucuacacagagaaaaaaaccggcaugaacacuacuguuccuccacaaccccauucucaacaaugaaaaugugggaacauaagccuaugcaauaaauuuccagaaaauuaggaguggccacgugacuguggacuuaaauuagcagguaugauuuuaaacuucgguguguaauagucauauuaauuauuucuuccacacgaugaaauucaugacagugaauaaggauuuaugaguuuaaucaggaaguugguaggagcacauuaaaaaaacaccuccugugucaaaacaaaugacuaucauuucucuucggaauugauuuaggaaugccuaagugaaggagcugcucuuccuuccacaggacucgacauacauucauuucagcugacauuuacucaaugcugacaauggggauggugacccaaaauuugguccucuaguucccucagaaguuaccccuauggcacugaagcacaggccucauuucagcugcucaguuucuucuucugaaaggcacaaauuauaaaucacaacugaagcaacuggaaguacuccugccuuuuaucuuaagcaacaccuaaguuuuauuuucuuuugcugaacuugccacuuucuugcauaaaauccuucagggguucuaagaugauuaaaacuccuugaaaggucccauccucucuuuagcuucaaaacaccccauucaccuaaguacccugcacagugcagccucagcaaacacugaaguuuugauuuuuuuaaccuguguuucugccuggaacacacaacugucucugucucuccuugacagucaaauuucuuugucuuuugaaggcucaaggcauaagcugccuugucccuguaaccccauccuaaugauuaagcccugcuuaccccauccaaccucuauguccugugcuagcacagaaaagcagacaucgaccagggugaacacuggagccuccagucugagccagaacacauaccaauccacugcaaagccccaaaugccccucugucaagcuuuuguuccuuagucacaggauaacuucauuaaagaaaaggauacucagaucaacgaagggaggcaccuugaaaccaaaugacagagcaaccugaggcaaauuuagguuauuaacauuaaagaucuguuucagagaaugggaaucauaggcucguauguaugacuuauaugcuuccugggcugacuuaugaagaaaguaauucuuuucaaucaauuucucaagcugaaauagaaagaaacacugguuuuaauaaacaaaaacaaacaaaaaccuccaaaacaccagauuuuaaauauccuagagcaaagccacuccauggaaaacauuuaaagagggcacagaguggugauaacuagaauagcaagaaaccuuauacacuacacagccugauccucacuuuaggacaggguagacuucaaaggacagugauugcccagugaaucacuacaaacagagugcugggacaagguuccuguuuacucacaaacguuuaaaaagcacauaccugagacugaaugucagaaauuuuagaccaggaaaagucaaauucacuuaauggaaccuagaaaucaaaaguauuaagauuaguaaaccaggaugaucagcauuccgauacuggguacugaagacagggaaggaugaaccggccuaugaaauucccucaggacagaaaggaaaaucugcuuuuucuagucucccaauguugaugggaaaguuacaucuuugcucugcugaguuaggcaaucugcacuucuuucuuucugaaaggcaaggaacuggauagggacacagucaguaaagcacuuuucuguaagaaucucuauaauccugacuauuugcaaccaugaaucagcuugaagcuucuagucagaagggccaucagccccuuuucuccaugucagaagaggggcccuaauacccccacaguccuguauugaggcuugugacacuggaggccaugaugaccacaaacuccuacaggauggaucugccaucaguuaucacucauuagauaacuagaaaagcaacaggccugugccaggugcuagagagaaaauagguaccuaacucauggacucugcccucagagagcuugccgucuugagggggagaaagauaaguaaugaaaugucaaccuguagauucuggauauuagcccuuugucagauagguagauugcaaaaauuuucucccauucuguagguugccuguucacucugaugguaguuucuuuugcugugcagaagcucuuuaauuagaucccauuugucaauuuuggcuaggacuaauauccagaaucuacuaagaacuuaaacaaauuuacaagaaaaaaucaaacaacccaaucaaaaagugggcgaaagauaugaacacacacuucucaaaagaagacauuuaggcagccaacagacaugaaaauaugcucaucaucacuggccaucagagaaauccaaauaaaaaucacagugagauaccaucucacaccaguuaaaauggcgaucauuaaaaagucaggaaacaacaggugcuggaggagauguggagaaacaggaacacuuuuacacuguuggugggacuguaaacuaguucauccauuguggaagacagugugacgauuccucaaggaucuagaccuagaaauaccauuugacccggccaucccauuacuggguauauacccaaaggauuauaaaucaugcugcuauaaagacacaugcacauguauguuuauucacaauaacaaagacuuggaaccaacccaaaugcccaucaaugacagacuggauuaagaaaauguggcacauacacaccauggaauacuaugcagccauaaaaaaggaugaguucauguccuuuguagggacauggaugacacgggaaaccaucauucugagcaaacuauugcaaggacagaaaaccaaacaccgcauguucucacucacaggugggaaaugaacaaugagaacacuuggacacaggguggugaauaucacacaccggggccugucgugggguggggggagggggaagggauagcauuaggauauauaccuaacguauaugacgaguuuaugggugcagcacaccaacauggcacaugaauacauauguaacaaaccugcacauggugcacauguacccuagaacuuaaaguguaauaauaauaaaaaaagaaagaaagaaagaaaugucaaccugaugagcaccugugcugugggaacaaggaggcaggagaucagcgauggcuucccagcaaagacagaggcgagcugaaaccaagcauucuggacaaagugugcaaaagcuguagagcaauuucagggaacugccugcaguuacaggguagaggaagccuaucaucaagacuaugccagaaaggccaaugaggauguaaaugucaggcaggagaaggccugauaugcaucccccacauggccuagcaaugaagaggccacuuaggguccugauggauucaauucuggugugauaguagaaagcuaaagccaaauuaggcugguuagggacugagagggagguaaauggcaagaauauaagccauuuuuccaguaaggcugacugaggaaaggcaacagacaguagcuccugcaggcagggguagaagaacagguuuaagguugaaguuacuuuuuuacagugagaaauuugagaugguaaagcgccaaccgcaaggaagagacuguaggccaagaguugaugaauaggagacagagggcaggggaggaggcagaggcuagagcgaacaaggauuccccacugcuucacaugagguaagaggaaagaaggggagcagaagcagagaugacuaggugugagggagcuucaaaggaguggagaagguuucaaagagggcuggagggaacaggaaaggagaggcugggacacagagguguugcuggguaacagagcuagaaagccgagccaugugggcaguuccuucugugcucacuucuugggcuagaaguacauaaaaccuuacuugcuuaauugccauaagaaugguuguaacagcacuggccagacucgagacuccucugacacauguagaaauguugcuugcuaacaaucccuacaccaagagaaaucuuucuccaaguacagaucuuuaccuuggauuguuucaaguagcgaagaaaacccaauucuucugggcgcaaaaugagcaaggcaugcccucucccauuuaggccucuggcuguucuacccacacgaugaauauauuccuuugguggagaaagaaaaucugaguuaacgcagugacuuccacaugagcccauuugcguaucugcauccugaguaugugcaugucuguacugagaugguguagucccacggugcugggccacacacaccuucaccacacccccacaaagcugggccagcaaucgcucugugcacaucacccccaauaggccaaugauugaggcccaaaaaaaaaaaaaaaaaaaaaaaaaaaaggcuggacaugauguuugcauuaacagcgaucuaauaaaaugaguauuaugugugcuucaucaucaaaacggcuuuaauccaguguuuguugaaaauacuucucaaugaagcuuauucuaccacauauacuacagaaguuuaucuacuuccuuaagcaauuuuauuuccuucaggcaucugcuguucuuaagagaucauuccaaggaucucauuuucauaacuuaagucccacugauccuuuucaauccucuggcacagcccguuugagcccugaaaagccuuaaguacuuuucaauaccagagaaauacugcagucacuguauaguagggaucuuuaccuugaauguggaaugcaguuuccgucagggaacugggagaauaagugaacuuuuaaugcagagucauucugaagauauuccaaagaugccaguuaccuuagggucauccggagggucauacugaacaauccagucgacuucaggaaugucuaguccucucgcugccacauccguacacaauaguguucccgaaucugcauugcagaacuggaagaaugugguuguacgcuuauuuugcuuuugcuuucccuagaauuaaauaaaaacauccauuagagcuggaaucuugaggaagacuagcaguagaacccccaaauuguggaacuguuacccuauuucgagcucaucccuuggccuauguccuauuuccccaacuguuccgcaagccccucaaggaggauggugucuugcacucuucgaaaguccucauaccccuccacacccagcagcgcucccccacacaggauccaucaucuaguggugaucaaacuacucagaacaauguuuccaggagagggcaauaccuccaauccuacaaucuauaggauuuaauaagcauacccuguuuucaaugagcucaucaucaucacuuacaugaauggccaagacgggcaaaucaauguaguucagcaacucauagugguauuucacagacauacaagaugaaaagaagaccauaagcuucuucuuucgguucuucuuaaggaauguaaagagcagaaggaaucucuuuucagaaggacaaacaacauaucccuagaaagcguuuaagcagacagauacaaaugaaccaaguggacauuuuccauuuccuaacuuguguaauuucaucaagagcacugauaaacacaguguguaaacugucaugccucaccuacagcauuuuaaaaguucauuaacccauuugcuuucugaaugauccuuccaacaauuacauaaaaacaccaaguaagaucccuacaguuuucaguuauugauaaaaaguaccuguucaagaccauccacuguugcauucgcuuuaucaucaucaacgccaacauacaauggcuccuuuuucagagaaauccuugccaggucuucaacuuuucgaguuuggguggcagaaaagagcauagucugucuacgugcugaaacagauacauauaaaaauaaccccaaucuuuuagggaaucuuuacaauugccucacaacuacaaauauucuagguagagauaucagaaaugggagauaugauguuucuacagaaucuacaaauauuacaaaagguaaaaaggguauaucaugaaacacuaggucuauaaauuugaggacuuagaugaaauggacaaacuccuuugaagacaaacaacugaagaaaauaggaaaacuuuaaauagccuuauaucuacuaaagaaauuuuaguuauaaccuucauguaaagaaaauuccaggcccaaauggauuccauuggugaauucuacugaacauuuaagaaaaaaacaucaauuauucacaaacucuccaauaaauuaaaaagagggcuuacaugucaacucauucuucgaagucagucauuacacuauacaaaaaccugacaugacaugacaagaaaacuauggaccaauacaauucgugagcacauauacaaaauuugaaauagaauuuuaguaaagugaauucagcaauauauaaaaaggauaauggcucauguuuauucuagaaauggaucagguuuauucuagaaaugcagguugguucaacauuugaaaaaucaaccaauacaauucacuauguuaacuaaagaaaaaacaugauuauuucagcagacagaaaaaaaacauuugaccaucuauuucugauuaaaaauccucagcaaacuaggaacagaagggaucuuccucaaucugauaaaaggcaucuauauaaaaccugcagcuaacuucauauguaguuaaugguaaaagacugaaugcuuuccccuaagaucagaaccaagauaaggaugucugcucucaccacuucuauucagcaccauacuggagguucuggccagggcaaucaggcaggaaaaaaaaauuaaauaaagaggugaaacugucuuuaucugcacaugauugccuauauagaaaauccaaaaggcuacagucaucuggaaagucauacugaauaaucauucgguacaggauuaacugucuugcuagauacaagaucaauauaaaauucaacugugugugcauauauauguguguauauguguguguguauauauguauauauuaaagcaacgagcaauuggaacuugaaauuuuaaugaaacacucagagauaaaucugacaaaagaugugaauaaaccuguaucccgaaccccccuaaauaugauagagaaaauaucgaauacauggagauauaccuuauuauggguuacaugacucaauacugucuuccuccaauaaucucuauucaauaaaaucucagucaagaucugagacuuuuuuggagggaagggggagaaacugacaaaccaauucuaaaauuuauauagaaaagcaaaggacaagaauaccacaacuuuaaaagagaacaaacuuggggcuaacauuaccugauggucaagacuuaauaggaggaacuggaacuuucauacacugcucauaggaauguuaaaugguacagccgcuuuggaaaacaucuggcaguuuuuuaaaaaguuaaacauacacuaaacauauaccaacuaggacacuccuagguuuacuuaagagaaaaggagauauaugccucuacaaagaguuguagaugacuguucacagcaacuuuauuuccagaaaaugcaaccuaaucuagcagcagaaaacagaucaauacucaccuggggacaagguauacguguaaggaggggugggagggagaaauugaaaaggggcaggaggaaaccuuugacugugauggacauguucauuuucuugauugcagcgaugaugucacagugguaaacaaaucaaagaacaucaaauuguacauuauaaauggguagauauaauuauacuuugacaaagcuuuuaaaaauaaauuauauaaugaaggaaaccauggucuuaguuauaaccaguucauaauguugcaaguacuauaaccaagguauguacaaguaaggcaaaaaaucugcggcuucuugggggauguuagaugagguaagaaugggcaagagguggaggacaggaccuaugugaagacugcuuaacgugccuuauaacuucuaaaacagcaaaacuauuauaucaaguuauaauacauuugaugcuuguauuccaaauuaccuuucggguuaauuggcacaacuaccucacuuggcuaugguaaaguucuggcauuaguacaguuuuucuauaggaacaacucuuaucuaccuccaacagauacuuugcaaaccaaaugcagaugcuaccuacuuacuuggcaaaaguuuaauaauuugcuuuaauuccucuucaaaccccacauccaagauacgaucagcuucaucaauaaccagacacugcagguuuuuauacauaaauccugggguauucuaacaaaacaaaggacaaagaacaaccauuaguugucaguuuauguuucauacaagacaaugagacaagcacuacaucucuuaccugcauaugguccagcagacggccugguguggccacaaugauguugaucccauuaccaaguuucugugcuucagcagaucuguuacugccacccauuaucaagccauagguaugcacguggugagucaucagcuccuuaagaacaccaaagguuugcauggcuaguucucuaguaggugagagaauaaggacuccuguuccuaaaaaugauauaugguagaagucuaaauguggcugucaccacugaguccguaacagcuacaauaaaccucuagugaaauaauggcagaaacaagcagaugaacgcuuaccauuccugggcaugaaccuuaacuuaacaaugaguucaacugcagggaugagaaaagccaggguuuuaccacugccuguuuuugcagcugcuagaagaucccuaaauauuaaaaagggaaaggagaaagacauuuagccuacucauuuacgacguacuacauacacacaccuuaggcacuacggcuagaacaugaacaagaaacgucuacagugcugaaauugaucaccuggguuauauacugaaaucauaagucagaacugugcuacaacagaagcagaacaccuuucgaacacuuuccuucaaacaucaguaauuaacuuaaagccuuuaauguaugcuggauacaugacccaacauauaguacaaaaucaacagaauauacugguauguucuuuaucaucuacuaguucuaaaaauagaugccaauaucuaagcuucaauguuaaucauaccugccuuccagaaguggucugauacuuuuaugcugaauuucagucauguuuguaaaacccauuucuuuuauugccuucagaguguuuucauugacaagauuacauagagaagcaaacgaaguauccucaaaagcuccuaaacagaagacaauuuaucauuagcaaauuuaucuuuuuuuuuaaaaaaguauugcuacaguugccuaaaucuauuuugcuuagaaaagcuucccgcaguaagaaaaggcuaaaccuuaauuauucauaugugauaauaucaagaaaaagacccuauaucuuucaaguuucuccacuguuaacggcugugugaguuauaguccagagaccauacuauaacaaaacaagggguagagaggagguauaaccaaggaauuuauauaaaauaaaaauaccaaaacaaggaaaauaaugagaguccagagauaaaugaaauguuuaagaaaucugauauaaaagugaaaacauugagcauuaauaaaaacugagugugaagucaauaauaaaaaaaaaaccuguuaaucucacuccaacaagacacagaagagucagauacagccacagaauguuaggcugagccuacguaucaaguaauacaguggugguucagcagaaggcaucaaaaucaccuggggguuccccauacuccacaugcccaggguguaaaccaaucacucuugaccuuggcauugcugacaucugggcugaauaauucuuugcugugaaacacuauccugugccuuauaagauauuaugcaguguuucugaccucuacucaccagaucccagcagacugcuccuagcucugagaaccaaaaaugucuccuaggcuuaggaugaccaaucuucucaguaggcuagggacagaggagauucuugggauucagaacuuucagugcuaaaacuguuaaaguucugggcaaaccaggaagaguuacucuucuuacucggggggcgaauuucccugcucgagagcuacuaccaaaacguuugcaauuuggauuaagcaggucuaggguugggccucaacauuuuaacaaaccaaccaacccaaaccaaauaaacaacucaaguaacuccuagacauaucugguuaggagcagugaauucuagccuaaacucaacuuuauaaaggaacaaaggccaaaggagguuaaccucguacagggccaaucauuuuccuauuacaacauagaaugagacucagaaaaggacaaaccaaggaauccuagaagcugcuagugugcauauaaaauauuuggugucaggaaugaacaaaaggaaaaaaacagggaacaaaaagaacuaaaacaccacaaaauagaagauaaagagaaaaagcagcagaaagauauaaaaaaaguuucuuguugauaguuacuuuuuucagguaaacugaaagucacaacugaaccuucaaaccuauaauccucuaagagaggcacauuuuaaagaaguuaccucuagaaaacuuccuggacguuaccugucagucccaggggcagacugggcaccucacucucaucuucaucauuaucuggcuucuccacauuauuuucuguuucuuuaguagucucggcacuuucuucuucagauuucccuuuguuuucaguuuuugcuuuuuucguaucuuugguuuuaaaagacaaaauccgaaaaaauuuuuccuuaaaauagaauuccaaaugagaucaacaaacagaagaucucugauauaaagacguauauuuucaaaagcuaaguauaugcuguauuaauuuguuaagaauucuguuuggugaaaaaugagugguuguauuuaaaaacccaggguacagacagacuuggugacaaaaccuuuuaggcuuuuguucaacuaaacaguauaaacauaccaauuauaaguuucacauacuccacugaggggaaaggaagcauaccugauuaacauaauccuuaaaaacucauuauaaguagucauuuuucuucccacgccaaucacuaucaaaggcucuucauguuacuagagauagacuguaaaggaagggcaacaacccacuugccuggcugacauacacuggacugugccuuggcuaucagggaugagggugggaggaaaggcagggcuucuucccacccucauuucuacauucacaacuuucauguggccccaacuaccuuuucaguccuaccucucacuucucuuuucaauguucgacucugggucaaauggauuaaccacaugcuguguuuauauaaaacuauauggcaauuagugauguuugaaaagaacuuagaccacaacccaggacucucuguagcucaguacuggucuccucccuguaccugacggccacccuuccaggaaagagucaacuuuguaggaccuacauguucaaaagccacagauaucuucagcuggucuccauggcuuauuuuguuuucccuggaauaguuccuaaaauguacccauaaggugguugggugugguggcuucugccuguaaucccagcacuuugggaagccgaggugggaggaucacuugagcccaggaguucaagaccagcuuggacaacacagugagaccccaucucauaauaaaacaaacaaacaaacaaacaaacaaaaaacccauaagguuaaaacgcccagcauugugauucaaugcuugggagcagaaauaauaccacuuccuggggcauacucaaaacaagaauugugaaggcaauaauuuuagaacaggauuacaaugacuucuguguguaggcaucaugaagacaguaaugcauguuuggaaaaguucaaagucccuuucuaaauaaaacccuuauuucagguaaaauacaugaauaggauguuccaacucaggggcuggcaaacuuuccgcaaagggccagauaguaaauaguuuaggcuuugcaggucauaugaucucuguugccauaaacacaaccaaauaggcauugcuaugacccaguaaaacuuuauuuacaaaaacagguagaaggagggauaguuugcugaccccuaucuuauccuaccuugauaucucugcuuauacaaaucucaauuauaauguccauucuuucauccgagcuuacugaaauuccaucaucuucaaaaaacauuccuuccuuuuccuccugccauucuuagcacuuggaaauuaauguuccauuuauucagaaguuuccuacuuuauauacuuuguaacuaauauuccuuucaaagggaggaauuuauggaaggaaaaugggaagaaucaagcaggaaaaaagguaacuuaaaaagaagagaaaauuucuagaauucuaaggagagucuuuucugagagagguuuucuucaagguuagugaaauuaaaaauauauuccucaauauuuugagaaaaguugaaauggacuccccgcuucugccaauaaaauguuuccauuagcuaccaggcuaaucucuaacauacuggugaguacagggaauucucaugucaugugcacacaauaguaauagaaagaggaacaauaaccgucugugaaaaacuaaauggcugaaguucaaagauaauaaauaccuaccaggcucagcaucauucaccauuuuucucuuuuucuucuuuuucuuuuuugauucugaauuggaagacugcauugcugcuucuccauugguuaauacaguggauuucuggggagacuuuguaacuuuuauauuucccacugcuucuugagacaugccuccauuuugaguuucugauaagcccacauucaugggcuuuuguuuugauuuuuuaaccuuucuacuucccauuguuucuucagauacaucuccauuuugaguuuccgauagggucagauuugaggccccuguuuaaauaaacagaacauauacugugacaaagaaggagaaguuuacuuagaaacacugaaaucccaaaugagaacuuccauggcuuccugacacaaauuauuuagauuuucuucucuuucauguaauuaaaacaacuuauaguuuuaugguguucccuuauagggaaaguaaguuaucuuaaagaaaaaauacuggaaaagggaaagcuauauugauuucuuaacugcaaaagaccguacaucugacuuuaaggagucuaggacaggaaaacuucaaugaggucaaauauuuaaacagaugaggucagauaauggcaguuacagaauaaacauaaguauuugauaaacauaugauuaacugauauauugaaaaagacauuuacaacucauucacacaaguacuauuuuucauaccacuucaaaacauucaaccccaacucuucuagacugcagugaguugaaaauucaguugauaagaccacuuauuugcuccaauauuuaucauaugcaaauacaguaaugcgugcacaaugacauuucugugaauuaaggacaacauauacaguggcuccauaagauuauaacggagcuaaaaaauuccuaucaccuagugccaucaguaacugcaaugucguagugcaacauauuacucauguuuguagugaugcuaguauaaacaaaucuacuguaaugccagucguauaaaguacagcacacauaauuauguacaauacauaauacgugauaauaaacuauguuacuuguuuauguguuuacuauacuuuugaucaucauuuuagaguuuacuccuuuuacuuauuaaaaaaaaaugagucgacuguaaaagagccucagggagagagguauuuuagaaggcacuguuaucauaggagaugacagcuccaugccuauuguugccccugaagaucuuccagugggacaagauguggaagcggaagacagugaaacugaaugugucugugucuuuacauuuuuaacaaaaagcuuaaaaagaaaaaaaaauaaaauaaaaaucacauagaauaaggacaaaaggaaacuuuuuguacagcuguauguacaaugugcuuguguuguaagcuaaguguuauuaaagucaaaagguuaaaauuuaacaaguuuauaauguaaaaguuacagcaggcuaagguuaauuuaagaauaaaaguauuaaaaaacucaacaguguagcccaaguguacaguguuuauaaagucuauaguguacaguaauguucuaggccuucacauucacucaccgcucacugacucgcucaggguaacuuccaguccugcaaacuccauucaugguaaguacuguauacagagguaccauuuucuaaaucucucaugucauagucuuuuuacuguaccuuuucuauguuuagauauauuuagccauacauacacuuaccauuguguuacaauucucugaguauaguacaguaacaugcuguacaggaugacagcuuacgagcaacaggcuauaucauguagccuggguguguaguagauuuagguuuguguaacuagauaaaguucgcaaaacgacaaaagccccuaaugacacauuucucacaauguauccccccuccuguuaugcgaugcaugacuguaccugagaauguccuuaccaaagguucccuguuuguuuacugaaaaagauaaaacaccaucuuuuguucaaauuuacuuacauaugcgcugaaaaguaguaaugcuguaguauuauucuauaggaauuagaaauacaagaguauuucaaaacauauuccuaaaauucacaaaccuauugccuccugcagaauuuuuuuucaauuaaugucuguugaaaaccaacuggggcaaggcacugugccuccaaacuuucccucggggaguuuguaucuuaaccuggacaacagguuaacacaauuacuucaagaucuguggccccacugucaggacacugggacugcaaaugagguagguaagaaaggugacauucagauaaaauccuuuucauuuaggucacugugcgggacacaaauacguagaagcucuggugagaaagugcuacgagaacguguggaaguggguagaggaaggcaauaguaucaaagaagcucuguggaaacagccagacgggcuuuuggggaaagaaauacgggaauuaaauagaugugaaaaguggguggaaaugagacguuucaugcagcauaaccggaaaugagggaugaggugaggugcgacuugcagguggugagggaaccaaaagcuaagguggaaaugcaaaaggcaggguuagucguaagccuagaagugaacggggaguccucccgcucuaacguuguaagaagacacugauugcucagaaaggucaggagcagcgcuggagccacgcgacgagugggcagcagcgcgggucccgaguggaagcugccuuuucacucuccccaaucacacacgcugcaggggaagcugccuccgucacacagagcagcugggcccccggccgcccgaacgcgccagggcucgcgcgugggucuucugagccaccgcgagucaacgcaucucacccugaaacuuuagguuccgcugccgcaauuugagguuccgcuucucgaucuucuuacgcaggaguuucaucggcaggugugacauucugcccaacaagugccuagaauaaggcgccacacaguacagcuacucaguucucaggcugacguuacuucccuuccggccgcacgugcgcagcucggccaacaggaaacgcgucacaggaacgcuggcacccggcggaacgaaaaugcuccagagcggaaau

SEQ ID NO: 12832 - RNA, 16202 nt, Homo sapiens
auuuccgcucuggagcauuuucguuccgccgggugccagcguuccugugacgcguuuccuguuggccgagcugcgcacgugcggccggaagggaaguaacgucagccugagaacugaguagcuguacuguguggcgccuuauucuaggcacuuguugggcagaaugucacaccugccgaugaaacuccugcguaagaagaucgagaagcggaaccucaaauugcggcagcggaaccuaaaguuucagggugagaugcguugacucgcgguggcucagaagacccacgcgcgagcccuggcgcguucgggcggccgggggcccagcugcucugugugacggaggcagcuuccccugcagcgugugugauuggggagagugaaaaggcagcuuccacucgggacccgcgcugcugcccacucgucgcguggcuccagcgcugcuccugaccuuucugagcaaucagugucuucuuacaacguuagagcgggaggacuccccguucacuucuaggcuuacgacuaacccugccuuuugcauuuccaccuuagcuuuugguucccucaccaccugcaagucgcaccucaccucaucccucauuuccgguuaugcugcaugaaacgucucauuuccacccacuuuucacaucuauuuaauucccguauuucuuuccccaaaagcccgucuggcuguuuccacagagcuucuuugauacuauugccuuccucuacccacuuccacacguucucguagcacuuucucaccagagcuucuacguauuugugucccgcacagugaccuaaaugaaaaggauuuuaucugaaugucaccuuucuuaccuaccucauuugcagucccaguguccugacaguggggccacagaucuugaaguaauuguguuaaccuguuguccagguuaagauacaaacuccccgagggaaaguuuggaggcacagugccuugccccaguugguuuucaacagacauuaauugaaaaaaaauucugcaggaggcaauagguuugugaauuuuaggaauauguuuugaaauacucuuguauuucuaauuccuauagaauaauacuacagcauuacuacuuuucagcgcauauguaaguaaauuugaacaaaagaugguguuuuaucuuuuucaguaaacaaacagggaaccuuugguaaggacauucucagguacagucaugcaucgcauaacaggaggggggauacauugugagaaaugugucauuaggggcuuuugucguuuugcgaacuuuaucuaguuacacaaaccuaaaucuacuacacacccaggcuacaugauauagccuguugcucguaagcugucauccuguacagcauguuacuguacuauacucagagaauuguaacacaaugguaaguguauguauggcuaaauauaucuaaacauagaaaagguacaguaaaaagacuaugacaugagagauuuagaaaaugguaccucuguauacaguacuuaccaugaauggaguuugcaggacuggaaguuacccugagcgagucagugagcggugagugaaugugaaggccuagaacauuacuguacacuauagacuuuauaaacacuguacacuugggcuacacuguugaguuuuuuaauacuuuuauucuuaaauuaaccuuagccugcuguaacuuuuacauuauaaacuuguuaaauuuuaaccuuuugacuuuaauaacacuuagcuuacaacacaagcacauuguacauacagcuguacaaaaaguuuccuuuuguccuuauucuaugugauuuuuauuuuauuuuuuuuucuuuuuaagcuuuuuguuaaaaauguaaagacacagacacauucaguuucacugucuuccgcuuccacaucuugucccacuggaagaucuucaggggcaacaauaggcauggagcugucaucuccuaugauaacagugccuucuaaaauaccucucucccugaggcucuuuuacagucgacucauuuuuuuuuaauaaguaaaaggaguaaacucuaaaaugaugaucaaaaguauaguaaacacauaaacaaguaacauaguuuauuaucacguauuauguauuguacauaauuaugugugcuguacuuuauacgacuggcauuacaguagauuuguuuauacuagcaucacuacaaacaugaguaauauguugcacuacgacauugcaguuacugauggcacuaggugauaggaauuuuuuagcuccguuauaaucuuauggagccacuguauauguuguccuuaauucacagaaaugucauugugcacgcauuacuguauuugcauaugauaaauauuggagcaaauaaguggucuuaucaacugaauuuucaacucacugcagucuagaagaguugggguugaauguuuugaagugguaugaaaaauaguacuugugugaaugaguuguaaaugucuuuuucaauauaucaguuaaucauauguuuaucaaauacuuauguuuauucuguaacugccauuaucugaccucaucuguuuaaauauuugaccucauugaaguuuuccuguccuagacuccuuaaagucagauguacggucuuuugcaguuaagaaaucaauauagcuuucccuuuuccaguauuuuuucuuuaagauaacuuacuuucccuauaagggaacaccauaaaacuauaaguuguuuuaauuacaugaaagagaagaaaaucuaaauaauuugugucaggaagccauggaaguucucauuugggauuucaguguuucuaaguaaacuucuccuucuuugucacaguauauguucuguuuauuuaaacaggggccucaaaucugacccuaucggaaacucaaaauggagauguaucugaagaaacaaugggaaguagaaagguuaaaaaaucaaaacaaaagcccaugaaugugggcuuaucagaaacucaaaauggaggcaugucucaagaagcagugggaaauauaaaaguuacaaagucuccccagaaauccacuguauuaaccaauggagaagcagcaaugcagucuuccaauucagaaucaaaaaagaaaaagaagaaaaagagaaaaauggugaaugaugcugagccugguagguauuuauuaucuuugaacuucagccauuuaguuuuucacagacgguuauuguuccucuuucuauuacuauugugugcacaugacaugagaauucccuguacucaccaguauguuagagauuagccugguagcuaauggaaacauuuuauuggcagaagcggggaguccauuucaacuuuucucaaaauauugaggaauauauuuuuaauuucacuaaccuugaagaaaaccucucucagaaaagacucuccuuagaauucuagaaauuuucucuucuuuuuaaguuaccuuuuuuccugcuugauucuucccauuuuccuuccauaaauuccucccuuugaaaggaauauuaguuacaaaguauauaaaguaggaaacuucugaauaaauggaacauuaauuuccaagugcuaagaauggcaggaggaaaaggaaggaauguuuuuugaagaugauggaauuucaguaagcucggaugaaagaauggacauuauaauugagauuuguauaagcagagauaucaagguaggauaagauaggggucagcaaacuaucccuccuucuaccuguuuuuguaaauaaaguuuuacugggucauagcaaugccuauuugguuguguuuauggcaacagagaucauaugaccugcaaagccuaaacuauuuacuaucuggcccuuugcggaaaguuugccagccccugaguuggaacauccuauucauguauuuuaccugaaauaaggguuuuauuuagaaagggacuuugaacuuuuccaaacaugcauuacugucuucaugaugccuacacacagaagucauuguaauccuguucuaaaauuauugccuucacaauucuuguuuugaguaugccccaggaagugguauuauuucugcucccaagcauugaaucacaaugcugggcguuuuaaccuuauggguuuuuuguuuguuuguuuguuuguuuguuuuauuaugagauggggucucacuguguuguccaagcuggucuugaacuccugggcucaagugauccucccaccucggcuucccaaagugcugggauuacaggcagaagccaccacacccaaccaccuuauggguacauuuuaggaacuauuccagggaaaacaaaauaagccauggagaccagcugaagauaucuguggcuuuugaacauguagguccuacaaaguugacucuuuccuggaaggguggccgucagguacagggaggagaccaguacugagcuacagagaguccuggguuguggucuaaguucuuuucaaacaucacuaauugccauauaguuuuauauaaacacagcaugugguuaauccauuugacccagagucgaacauugaaaagagaagugagagguaggacugaaaagguaguuggggccacaugaaaguugugaauguagaaaugagggugggaagaagcccugccuuuccucccacccucaucccugauagccaaggcacaguccaguguaugucagccaggcaaguggguuguugcccuuccuuuacagucuaucucuaguaacaugaagagccuuugauagugauuggcgugggaagaaaaaugacuacuuauaaugaguuuuuaaggauuauguuaaucagguaugcuuccuuuccccucaguggaguaugugaaacuuauaauugguauguuuauacuguuuaguugaacaaaagccuaaaagguuuugucaccaagucugucuguacccuggguuuuuaaauacaaccacucauuuuucaccaaacagaauucuuaacaaauuaauacagcauauacuuagcuuuugaaaauauacgucuuuauaucagagaucuucuguuuguugaucucauuuggaauucuauuuuaaggaaaaauuuuuucggauuuugucuuuuaaaaccaaagauacgaaaaaagcaaaaacugaaaacaaagggaaaucugaagaagaaagugccgagacuacuaaagaaacagaaaauaauguggagaagccagauaaugaugaagaugagagugaggugcccagucugccccugggacugacagguaacguccaggaaguuuucuagagguaacuucuuuaaaaugugccucucuuagaggauuauagguuugaagguucaguugugacuuucaguuuaccugaaaaaaguaacuaucaacaagaaacuuuuuuuauaucuuucugcugcuuuuucucuuuaucuucuauuuugugguguuuuaguucuuuuuguucccuguuuuuuuccuuuuguucauuccugacaccaaauauuuuauaugcacacuagcagcuucuaggauuccuugguuuguccuuuucugagucucauucuauguuguaauaggaaaaugauuggcccuguacgagguuaaccuccuuuggccuuuguuccuuuauaaaguugaguuuaggcuagaauucacugcuccuaaccagauaugucuaggaguuacuugaguuguuuauuugguuuggguugguugguuuguuaaaauguugaggcccaacccuagaccugcuuaauccaaauugcaaacguuuugguaguagcucucgagcagggaaauucgccccccgaguaagaagaguaacucuuccugguuugcccagaacuuuaacaguuuuagcacugaaaguucugaaucccaagaaucuccucugucccuagccuacugagaagauuggucauccuaagccuaggagacauuuuugguucucagagcuaggagcagucugcugggaucuggugaguagaggucagaaacacugcauaauaucuuauaaggcacaggauaguguuucacagcaaagaauuauucagcccagaugucagcaaugccaaggucaagagugauugguuuacacccugggcauguggaguauggggaacccccaggugauuuugaugccuucugcugaaccaccacuguauuacuugauacguaggcucagccuaacauucuguggcuguaucugacucuucugugucuuguuggagugagauuaacagguuuuuuuuuuauuauugacuucacacucaguuuuuauuaaugcucaauguuuucacuuuuauaucagauuucuuaaacauuucauuuaucucuggacucucauuauuuuccuuguuuugguauuuuuauuuuauauaaauuccuugguuauaccuccucucuaccccuuguuuuguuauaguauggucucuggacuauaacucacacagccguuaacaguggagaaacuugaaagauauagggucuuuuucuugauauuaucacauaugaauaauuaagguuuagccuuuucuuacugcgggaagcuuuucuaagcaaaauagauuuaggcaacuguagcaauacuuuuuuaaaaaaaaagauaaauuugcuaaugauaaauugucuucuguuuaggagcuuuugaggauacuucguuugcuucucuauguaaucuugucaaugaaaacacucugaaggcaauaaaagaaauggguuuuacaaacaugacugaaauucagcauaaaaguaucagaccacuucuggaaggcagguaugauuaacauugaagcuuagauauuggcaucuauuuuuagaacuaguagaugauaaagaacauaccaguauauucuguugauuuuguacuauauguugggucauguauccagcauacauuaaaggcuuuaaguuaauuacugauguuugaaggaaaguguucgaaagguguucugcuucuguuguagcacaguucugacuuaugauuucaguauauaacccaggugaucaauuucagcacuguagacguuucuuguucauguucuagccguagugccuaagguguguguauguaguacgucguaaaugaguaggcuaaaugucuuucuccuuucccuuuuuaauauuuagggaucuucuagcagcugcaaaaacaggcagugguaaaacccuggcuuuucucaucccugcaguugaacucauuguuaaguuaagguucaugcccaggaaugguaagcguucaucugcuuguuucugccauuauuucacuagagguuuauuguagcuguuacggacucaguggugacagccacauuuagacuucuaccauauaucauuuuuaggaacaggaguccuuauucucucaccuacuagagaacuagccaugcaaaccuuugguguucuuaaggagcugaugacucaccacgugcauaccuauggcuugauaauggguggcaguaacagaucugcugaagcacagaaacuugguaaugggaucaacaucauuguggccacaccaggccgucugcuggaccauaugcagguaagagauguagugcuugucucauugucuuguaugaaacauaaacugacaacuaaugguuguucuuuguccuuuguuuuguuagaauaccccaggauuuauguauaaaaaccugcagugucugguuauugaugaagcugaucguaucuuggaugugggguuugaagaggaauuaaagcaaauuauuaaacuuuugccaaguaaguagguagcaucugcauuugguuugcaaaguaucuguuggagguagauaagaguuguuccuauagaaaaacuguacuaaugccagaacuuuaccauagccaagugagguaguugugccaauuaacccgaaagguaauuuggaauacaagcaucaaauguauuauaacuugauauaauaguuuugcuguuuuagaaguuauaaggcacguuaagcagucuucacauagguccuguccuccaccucuugcccauucuuaccucaucuaacaucccccaagaagccgcagauuuuuugccuuacuuguacauaccuugguuauaguacuugcaacauuaugaacugguuauaacuaagaccaugguuuccuucauuauauaauuuauuuuuaaaagcuuugucaaaguauaauuauaucuacccauuuauaauguacaauuugauguucuuugauuuguuuaccacugugacaucaucgcugcaaucaagaaaaugaacauguccaucacagucaaagguuuccuccugccccuuuucaauuucucccucccaccccuccuuacacguauaccuuguccccaggugaguauugaucuguuuucugcugcuagauuagguugcauuuucuggaaauaaaguugcugugaacagucaucuacaacucuuuguagaggcauauaucuccuuuucucuuaaguaaaccuaggaguguccuaguugguauauguuuaguguauguuuaacuuuuuaaaaaacugccagauguuuuccaaagcggcuguaccauuuaacauuccuaugagcaguguaugaaaguuccaguuccuccuauuaagucuugaccaucagguaauguuagccccaaguuuguucucuuuuaaaguugugguauucuuguccuuugcuuuucuauauaaauuuuagaauugguuugucaguuucucccccuucccuccaaaaaagucucagaucuugacugagauuuuauugaauagagauuauuggaggaagacaguauugagucauguaacccauaauaagguauaucuccauguauucgauauuuucucuaucauauuuagggggguucgggauacagguuuauucacaucuuuugucagauuuaucucugaguguuucauuaaaauuucaaguuccaauugcucguugcuuuaauauauacauauauacacacacacauauacacacauauauaugcacacacaguugaauuuuauauugaucuuguaucuagcaagacaguuaauccuguaccgaaugauuauucaguaugacuuuccagaugacuguagccuuuuggauuuucuauauaggcaaucaugugcagauaaagacaguuucaccucuuuauuuaauuuuuuuuuccugccugauugcccuggccagaaccuccaguauggugcugaauagaaguggugagagcagacauccuuaucuugguucugaucuuaggggaaagcauucagucuuuuaccauuaacuacauaugaaguuagcugcagguuuuauauagaugccuuuuaucagauugaggaagaucccuucuguuccuaguuugcugaggauuuuuaaucagaaauagauggucaaauguuuuuuuucugucugcugaaauaaucauguuuuuucuuuaguuaacauagugaauuguauugguugauuuuucaaauguugaaccaaccugcauuucuagaauaaaccugauccauuucuagaauaaacaugagccauuauccuuuuuauauauugcugaauucacuuuacuaaaauucuauuucaaauuuuguauaugugcucacgaauuguauugguccauaguuuucuugucaugucaugucagguuuuuguauaguguaaugacugacuucgaagaaugaguugacauguaagcccucuuuuuaauuuauuggagaguuugugaauaauugauguuuuuuucuuaaauguucaguagaauucaccaauggaauccauuugggccuggaauuuucuuuacaugaagguuauaacuaaaauuucuuuaguagauauaaggcuauuuaaaguuuuccuauuuucuucaguuguuugucuucaaaggaguuuguccauuucaucuaaguccucaaauuuauagaccuaguguuucaugauauacccuuuuuaccuuuuguaauauuuguagauucuguagaaacaucauaucucccauuucugauaucucuaccuagaauauuuguaguugugaggcaauuguaaagauucccuaaaagauugggguuauuuuuauauguaucuguuucagcacguagacagacuaugcucuuuucugccacccaaacucgaaaaguugaagaccuggcaaggauuucucugaaaaaggagccauuguauguuggcguugaugaugauaaagcgaaugcaacaguggauggucuugaacagguacuuuuuaucaauaacugaaaacuguagggaucuuacuugguguuuuuauguaauuguuggaaggaucauucagaaagcaaauggguuaaugaacuuuuaaaaugcuguaggugaggcaugacaguuuacacacuguguuuaucagugcucuugaugaaauuacacaaguuaggaaauggaaaauguccacuugguucauuuguaucugucugcuuaaacgcuuucuagggauauguuguuuguccuucugaaaagagauuccuucugcucuuuacauuccuuaagaagaaccgaaagaagaagcuuauggucuucuuuucaucuuguaugucugugaaauaccacuaugaguugcugaacuacauugauuugcccgucuuggccauucauguaagugaugaugaugagcucauugaaaacaggguaugcuuauuaaauccuauagauuguaggauuggagguauugcccucuccuggaaacauuguucugaguaguuugaucaccacuagaugauggauccugugugggggagcgcugcuggguguggagggguaugaggacuuucgaagagugcaagacaccauccuccuugaggggcuugcggaacaguuggggaaauaggacauaggccaagggaugagcucgaaauaggguaacaguuccacaauuuggggguucuacugcuagucuuccucaagauuccagcucuaauggauguuuuuauuuaauucuagggaaagcaaaagcaaaauaagcguacaaccacauucuuccaguucugcaaugcagauucgggaacacuauuguguacggauguggcagcgagaggacuagacauuccugaagucgacuggauuguucaguaugacccuccggaugacccuaagguaacuggcaucuuuggaauaucuucagaaugacucugcauuaaaaguucacuuauucucccaguucccugacggaaacugcauuccacauucaagguaaagaucccuacuauacagugacugcaguauuucucugguauugaaaaguacuuaaggcuuuucagggcucaaacgggcugugccagaggauugaaaaggaucagugggacuuaaguuaugaaaaugagauccuuggaaugaucucuuaagaacagcagaugccugaaggaaauaaaauugcuuaaggaaguagauaaacuucuguaguauaugugguagaauaagcuucauugagaaguauuuucaacaaacacuggauuaaagccguuuugaugaugaagcacacauaauacucauuuuauuagaucgcuguuaaugcaaacaucauguccagccuuuuuuuuuuuuuuuuuuuuuuuuuuuugggccucaaucauuggccuauugggggugaugugcacagagcgauugcuggcccagcuuuguggggguguggugaagguguguguggcccagcaccgugggacuacaccaucucaguacagacaugcacauacucaggaugcagauacgcaaaugggcucauguggaagucacugcguuaacucagauuuucuuucuccaccaaaggaauauauucaucguguggguagaacagccagaggccuaaaugggagagggcaugccuugcucauuuugcgcccagaagaauuggguuuucuucgcuacuugaaacaauccaagguaaagaucuguacuuggagaaagauuucucuugguguagggauuguuagcaagcaacauuucuacaugugucagaggagucucgagucuggccagugcuguuacaaccauucuuauggcaauuaagcaaguaagguuuuauguacuucuagcccaagaagugagcacagaaggaacugcccacauggcucggcuuucuagcucuguuacccagcaacaccucugugucccagccucuccuuuccuguucccuccagcccucuuugaaaccuucuccacuccuuugaagcucccucacaccuagucaucucugcuucugcuccccuucuuuccucuuaccucaugugaagcaguggggaauccuuguucgcucuagccucugccuccuccccugcccucugucuccuauucaucaacucuuggccuacagucucuuccuugcgguuggcgcuuuaccaucucaaauuucucacuguaaaaaaguaacuucaaccuuaaaccuguucuucuaccccugccugcaggagcuacugucuguugccuuuccucagucagccuuacuggaaaaauggcuuauauucuugccauuuaccucccucucagucccuaaccagccuaauuuggcuuuagcuuucuacuaucacaccagaauugaauccaucaggacccuaaguggccucuucauugcuaggccaugugggggaugcauaucaggccuucuccugccugacauuuacauccucauuggccuuucuggcauagucuugaugauaggcuuccucuacccuguaacugcaggcaguucccugaaauugcucuacagcuuuugcacacuuuguccagaaugcuugguuucagcucgccucugucuuugcugggaagccaucgcugaucuccugccuccuuguucccacagcacaggugcucaucagguugacauuucuuucuuucuuucuuuuuuuauuauuauuacacuuuaaguucuaggguacaugugcaccaugugcagguuuguuacauauguauucaugugccauguuggugugcugcacccauaaacucgucauauacguuagguauauauccuaaugcuaucccuucccccuccccccaccccacgacaggccccggugugugauauucaccacccuguguccaaguguucucauuguucauuucccaccugugagugagaacaugcgguguuugguuuucuguccuugcaauaguuugcucagaaugaugguuucccgugucauccaugucccuacaaaggacaugaacucauccuuuuuuauggcugcauaguauuccaugguguguaugugccacauuuucuuaauccagucugucauugaugggcauuuggguugguuccaagucuuuguuauugugaauaaacauacaugugcaugugucuuuauagcagcaugauuuauaauccuuuggguauauacccaguaaugggauggccgggucaaaugguauuucuaggucuagauccuugaggaaucgucacacugucuuccacaauggaugaacuaguuuacagucccaccaacaguguaaaaguguuccuguuucuccacaucuccuccagcaccuguuguuuccugacuuuuuaaugaucgccauuuuaacuggugugagaugguaucucacugugauuuuuauuuggauuucucugauggccagugaugaugagcauauuuucaugucuguuggcugccuaaaugucuucuuuugagaaguguguguucauaucuuucgcccacuuuuugauuggguuguuugauuuuuucuuguaaauuuguuuaaguucuuaguagauucuggauauuaguccuagccaaaauugacaaaugggaucuaauuaaagagcuucugcacagcaaaagaaacuaccaucagagugaacaggcaaccuacagaaugggagaaaauuuuugcaaucuaccuaucugacaaagggcuaauauccagaaucuacagguugacauuucauuacuuaucuuucucccccucaagacggcaagcucucugagggcagaguccaugaguuagguaccuauuuucucucuagcaccuggcacaggccuguugcuuuucuaguuaucuaaugagugauaacugauggcagauccauccuguaggaguuuguggucaucauggccuccagugucacaagccucaauacaggacuguggggguauuagggccccucuucugacauggagaaaaggggcugauggcccuucugacuagaagcuucaagcugauucaugguugcaaauagucaggauuauagagauucuuacagaaaagugcuuuacugacugugucccuauccaguuccuugccuuucagaaagaaagaagugcagauugccuaacucagcagagcaaagauguaacuuucccaucaacauugggagacuagaaaaagcagauuuuccuuucuguccugagggaauuucauaggccgguucauccuucccugucuucaguacccaguaucggaaugcugaucauccugguuuacuaaucuuaauacuuuugauuucuagguuccauuaagugaauuugacuuuuccuggucuaaaauuucugacauucagucucagguaugugcuuuuuaaacguuugugaguaaacaggaaccuugucccagcacucuguuuguagugauucacugggcaaucacuguccuuugaagucuacccuguccuaaagugaggaucaggcuguguaguguauaagguuucuugcuauucuaguuaucaccacucugugcccucuuuaaauguuuuccauggaguggcuuugcucuaggauauuuaaaaucugguguuuuggagguuuuuguuuguuuuuguuuauuaaaaccaguguuucuuucuauuucagcuugagaaauugauugaaaagaauuacuuucuucauaagucagcccaggaagcauauaagucauacauacgagccuaugauucccauucucugaaacagaucuuuaauguuaauaaccuaaauuugccucagguugcucugucauuugguuucaaggugccucccuucguugaucugaguauccuuuucuuuaaugaaguuauccugugacuaaggaacaaaagcuugacagaggggcauuuggggcuuugcaguggauugguauguguucuggcucagacuggaggcuccaguguucacccuggucgaugucugcuuuucugugcuagcacaggacauagagguuggaugggguaagcagggcuuaaucauuaggaugggguuacagggacaaggcagcuuaugccuugagccuucaaaagacaaagaaauuugacugucaaggagagacagagacaguuguguguuccaggcagaaacacagguuaaaaaaaucaaaacuucaguguuugcugaggcugcacugugcaggguacuuaggugaaugggguguuuugaagcuaaagagaggaugggaccuuucaaggaguuuuaaucaucuuagaaccccugaaggauuuuaugcaagaaaguggcaaguucagcaaaagaaaauaaaacuuagguguugcuuaagauaaaaggcaggaguacuuccaguugcuucaguugugauuuauaauuugugccuuucagaagaagaaacugagcagcugaaaugaggccugugcuucagugccauagggguaacuucugagggaacuagaggaccaaauuuugggucaccauccccauugucagcauugaguaaaugucagcugaaaugaauguaugucgaguccuguggaaggaagagcagcuccuucacuuaggcauuccuaaaucaauuccgaagagaaaugauagucauuuguuuugacacaggagguguuuuuuuaaugugcuccuaccaacuuccugauuaaacucauaaauccuuauucacugucaugaauuucaucguguggaagaaauaauuaauaugacuauuacacaccgaaguuuaaaaucauaccugcuaauuuaaguccacagucacguggccacuccuaauuuucuggaaauuuauugcauaggcuuauguucccacauuuucauuguugagaaugggguuguggaggaacaguaguguucaugccgguuuuuuucucuguguagauguuagauuggaguucauuaucuuuuuugcuugauuuccuuaauguuugccuccagacgucaacaguaaugaaggcaagcagaaaaagcgaggagguggugguggauuuggcuaccagaaaaccaagaaaguugagaaauccaaaaucuuuaaacacauuagcaagaaaucaucugacagcaggcaguucucucacugaacacaugccuuccuuucaucuugaauaacuuuguccuaaaaugaauuuuuuuuccccuugauuuaacaggauuuuuguagacuuuagaauuu

SEQ ID NO: 12833 - RNA, 1385 nt, Homo sapiens
caaaagaggaccugcuguuuaauaaauucagcuuggauuuguugaggcucagaaaaguauaccccaacguauggcacuuugguaugcuaaguuugaacuaaaaaacuaaacaggccucugaagccgccuuagaaacaaagucugucucccccccgacuuucuccccacuaagcaguucacagaaaccagaauuccucuucccuacgguggucauacaaccuagaaauaguacuccaaccucccugguccucugccuuucuguguaggagcuggccaugaagaaauacucagaccuaccuugucugauaguagauccugagacccucauuccagaagagguccugcucuauacaugcugcacagagaggccaagaagaaucugaacaggccucgcuggguucaacccucagucuauuaccauuagaucacacccuuuguccaaucacauuucuauaaggcuguccauucuucacugaaucuaagcauaaaaacaggcaguuuucccugagucuuugcaucuucauuucugaaggcuccuguaucacauaaaacuuugauucaauaaauuuguuacgcuuuucucuuauuagccuaucuuuuguuauaagcauguuugccgugccccuuaugauggggaggaaaguaucacaccuuuucugccccuaccguuucaaugguaucaacauccaagcucuagaguccggcuuucgucuuuagauugauucagucucugaauuuaauccggguacuccaaaaugucaauuccucauuuaaaggaguccuccucguuucuugaagagucacccuuuuccuuuuucuugucugcuuugcuugugauugaaaugagaguaggauuuaaaugccuuuguggugcacuggaaauaucaccagaaauggggagaggggucuuacuuuauuuuguugcugcuguuauuauuguuguugcuggauuggaaugagaagaucugaguugaccuugaccaacuuacuuuaccuuguugaccacuaauuucuucaacuacaaauugaaagaguugaacuacgucauuucaaagaucccuuccugcugcaaagaaaaagaaaaaugcuaugauuacuuggauaaagacaaugaaaaucucuacccauuaauccugguucuauccucuaagguagaacauccuucagauauauuugcagagucaucuccuccacuuuuuuccuccagucuaucccauuuaaucccccugucaauggcucucaaaguaucaccuggggagucuaagaacaaaaauaccgaagcuucgacugcuagagauucugauaucauauuuaacgugaucguucuuggcugggaccuuggcauggguauuuuguaaggcacuuccccauucuaagagucaucu

SEQ ID NO: 12834 - RNA, 524 nt, Homo sapiens
uguuuuuguuuuuugcgggcaugaggggcugguggugagaaagccagcugacucuuuauugcuuugggggcagggggcucaggagcucuugguggcgcggguccgcuuccgcuucaccaucacaggcuucuggcugcacaggauggcgcugacccugcggauggcugccaugcgcaggucggggcgguacuuguucuugaggaucaugugucugaugcugcugagcgugacgccagcauucuuguugauggugguccgcgcguaggagguggcaggcuucggcuggccggaucucugcuucgugaccaccaccacaccuuuguccucggcugccggcuccacgcccacagucuuguggugaaucagcccguuguagcggaaggagcuggggccuucaaguuacugggcuuggugcuguaggucggcauaguccucuugaucagaaacuggagcaguucugcacgaccauccauugcagaugcgcggacaugguggcggcuccucucgcaguggcggccugagac

SEQ ID NO: 12835 - RNA, 9995 nt, Homo sapiens
acaauacaagaggaaacucauggaucuuucccauagaacuuuacagguaguaauuuggauuuucccccccaguguuuauaagacuaugugugugaaauaauguacuaaauauagauuuuuaaaauagaaaaaaaaauacuaaaaugaaagaauaaugugaaauuacaaguaccgaauucuuucaguaaaacuuugaaauuggaaaacaagucucauagguuugagugaggagaauaaaaauauccuaaaguucguauuuuagugacaguuugagggaaagcagugaagaaauaaagcaucuuagugcaagggaagcuucugugagauuauugaugucucauaaauuucauaaaauaguuucauaaaauaguucagaaaauuuuuugagugcuagaaaaaggaguguaaccauaauggucgaaaaacaauagaauuuccaaauuaacaggaggaauuaaaagaauaauaacaacugaaauuauaaacuaucaugaaaacagaaauauuacauaccagaaccagugggaaacagcaaaaucuguacucagaggaaaacuuacagccauaaaaaauucucauuuaaaaaaaucaaaugugaaaaauaaaggaacuuaguacucauguuaaauuagaaaaggaauaucaagauaagccaaaagaaacuaaaaagaaagaaagauaaaugugaaauuagugaaagacuaaaaaauguaauaguggaaagaauaaauuaaaaaacuguuucuuugaaaagaccguuaaaauuacuaagcaucucaucagcuggaagaagggaaaaacagaguaaaauauacaaaauuaguagugggaaaagaggcaucaccguagauauacaaaacagaauaagaagauacugcaugggccgggcacagugucucacucuuguaauccuagaacuuugggaggccgaggugaguggauugccugagcucaggaguucaagaccagccugggcaacacggugaaaccccaucucuacuaaaauacaaaaaaaucagccaggcaugguugcuugugccuguaguuccaguuacuugggaggcugaggcacgagaauugcuugaaccugggaggcggagguugcagugagccgagaucacgccacugcacuccagccuaggcuacagagcaagacuccaucucagaaaaaaggagaaaaaaaaaagaagaugcugcauguacuuuaggguaacagauuuggaacucagaggaaguuuuauuuugauuuuucuaugaaaaugaaaauuaccaaaaucuacagagaaguaagaaaacaaauaccacagaaacaguuggaaaaaugaaagaugaaacaugaaaaaggccuuagggacagauaguuucauugccaaauuuugucuaaccacaaaagagcuaauccaguguuauuuugauuauucuagacaauugaggaauaauuuauacagcuucauuuguucuuuuuucacagcuuaagauaauuugcauaccauacuauuuacucauuuaaaguguacaauucaauggcuuuuaguauauucagagacuuguauaaccguuauuaccacaaucaauuuuagaacauuucugucacccuacagacaaaucccguacccauugucagucacuuccccguuucacugcaaaucugucaguccuaugcaaccaguuuugccuauauggguuugccuguucuggaaaccucauauaaauggaaucauaacgauauauggucuuuugugacuggcuuuuacuuagcauaauguuuucaaaguucaacuguguuguaccauguaauaguacuucagguacuaauaaaugauuauuauucauuuauugcugaauauuccaucauauggcuauaccacauuuuacucaauugauggacauuuuggugguucuccuuuuuggcuauuaugaauaauauugcuauuaaaauuuauuuacaaguguuuguuuggacauauacuucuauuucucuuggguauaaaccuaggagugaaauugcugugucauaugcacacuauguuuaacuuuuugaggaacuacguaaacuguuuuccaaagcaacuguaccauuuuacauuucuguuuguagcaucucaaaaaaagaaauuauaaacagcuauuuuaaagagaugcaaauuaugcuaagugaaaaaagccagacuuaaaggcuguguaaggcaugauucuauuuauauaacauuauacaaaagaaaauuagggacagauaacagauuaguaguugccagggacuguagaugaagagagaagugugacuacaaggggcuuggggugauggaaauauucuguaucuuaaucacuguggugguuacacgacuguauguauuugccagauucauagaacugaacaccuaaaacaggugaauugucauauguagaguauaccucaaaucggaccaaaaaaccacauucuaaaugaaguauaagcaaagagaauccagcuauuuaucaauuucuuaaaaaauauacuaugaccaaguaaaguuuauuucaggaaugcaagguugguuuuaauaacaggacaucuaucaacaugacuuauuauagcaacacauuaaaggaaaauauauaauagaaacuguaaccaaaaaugaauagcaaauacuccaaaaggcaaaacacuaaaaucgcauuuagaaacuagacaacggacacccaauauuaucaucauuauuuguugcuaucuuggagguuuucauaaauaaaacaagcaaagaaauaauauaaacauugggaagaugauuaagugaucuauuuuugcugauaugauuguauaucuggaaaacccaagggaauaaaccauagaauuaauguaguaagcuggcuagauauaaaaguacaaaaaucaacuuuccuuuuuacuaucuggaaauaggaaaauguuccauucacuauggugacaaaacuguaaaauaggaauauauuucugaggaaaguauagguauuuacaaauagauaaacuauauucuuagaugagaauacuuaauacccacuuuacaaaauuaaaaaugaauuacagcuuuuuaaaaauagauuaagcugggugugaugacauggcaccuauagucacagcuacucagaaggcugaggcaggagaagcaccugagcccaggaguuugaggcucuagugagcuaugauugugccuaugaauagccacugcacucuguugccugggcaacauagggagacccugucucuaaaaaaauuuugauuaaaauuucuuuaaguuuauaaagaaggauaaguguuugagacuagcuuguucaggaacaaaaaagaaauagugaaggggacuucuuuaccagauuucagaaccuauuuuaaaccucuuauaauugaaucaauauagugucugcaugggauuggacagaacaaugcauggaacagaguagggaauuuacaaauagaugcaagugugcugaaaauuuaauauaugagaaaggugguauuucaauucaguggguuuauuuaauaaauaaugcuggaguauaacuauccauaaggaagaaaagaaaauuagaccauugcauuguauaaaaauaaaguggacuaaagacuuuaagaaacuuucaaagcuguauguacagccugggauuugagagacauugaucaaaaagcuagaaacuauaaaccaacauuggccacauaaaaaauuguguagcaaaagauaccagaagccauuugucaauagucaugugauagaguuuaggaaaaggaaauuuugcaaacagcauucauuuuagauuuaguguucauauucauauuauacaaagagauccuauaauuugacaguaaaacccaauugaaauuugggcaaaagauguguaaaggcaguucauagaaaaagcaaaugcaaaauaguucuuagucauuaaaagauggucccuuuaauuuacuaggaaucugggaauugcagauuaaagaaaaaaaaugagauccuggccgggcgcaguggcucacgccuguaaucccagcacucugggaggccgaggcggguggaucacgaggucaggaguucaagaccagccuggcgaagauggugaaaccccgacucuacuaaaaauacaaaaauuagcugggcaugguggcaggugccuguaaucccagcuacuugggaggcugaggcagagaauugcuugaaccugggagguggagguugccgugagccaagaucacggcacugcacuccagcuugggugacagagugcaacuccaucuggggaaaaaaaaaaaaaaaaaaaaaaagagaucccuuuacacucaugcgguugggaaaaauuuaaaccaccaccaccuguucuugacaggaauguggggaaaggguauucugauguguggccuaugaaucuaaaucauuaggauauuuugaaaaagcaaucuagcagcuuuagaacugaaaacguacauacuuuaaaacucagccucauuguuaaagaucuauaccaguuaaauagauauaugcaccaaaauguuuauuauagcauuguagugucaaagcuacaaaauuuauuacagcauuguuuauagagucaaagcuacaaaaauguuuauuauggcauuguagugugaaaacaaaauguauauccaucaagacaauaauuauugauuauugguuaauaacauuuaaaaagcauacagccauuaaaaauaacaaauuagagcuauacuucuuaaggcauuucaugagauuuugauaauaaaauuauuuuaauuauaaaauuuaaugguuaauauugauaauaaaauuuuguuaauuuuauauaauccauuuuuaaaaacuuagaugaguaaaaagcagucggucuauguguguguuuaugaaaaagauaugguuauaggagcauggaugagaguauggaaggauuugcacuguuuuuaacagaguaagcugggcuuggagaguagcagcaaaccaagagucugccuuuagaggccacugcuuuagacccuuucccccgaugcauuguuaaauuggaaagaaagagaagcagccuggcacaguggcccacgccuguaaucccagcacuuuaagaggccgaggcagaaggaucauuugaguuuaggaguuugagaccagccugggcaacaucgggagaccucaucucuacuaaaaaaaaaaaaaaagaaaaaaaauuagccaggcaugguggugagcaccuguaauuccagcuacuugggaggcugaggugggaggauugcuugagccuaggagaucgaugcugcauugagcugcccuccagccugggcaagaaagcaaggucgucucagaaaaacaaaaacaacaaccaaaaaaaggaaccaugucacagagugauauauacaguuuaguuuuauuuuggaucugugugugugugcucucucuguaugaugagcaaggagaaagguacaggggaauaaacaucaguuagcacuauuugucuuggggguaugagagaaaauuugucuuuuacauucucguauuguuucuuaacaaguacauuuugcuuuuguaaucucaaaaaaaauccaagaaauaauuuuuagaccuaaauauuauaaacucaucuuuaaagaacacuuuauuuggaaaggcugugaguaaaugucugaaacugguauuauguugucuauuuuuuuguacugcuuuuaagccauaccauaguuuuuguuugucuguuuuuugagacagagucucgcucuguugcccaggcuggagugcaguggcgcgaucuaggcucacugcaagcucugccucccggguuuuccgccauucuccugccucagccucccgaguagcugggacuacaggcgugcaccaucaacguccggcuaauuuuuuguauuuuuaguagagacgggguuucaucauguuagccaggauggucucaaucuccugaccucuugauccacccgccuuguccucccaaagugcugggauuacaggugugagccaccgcgcccggccaagccauaccauaguuuuaaaauuguuggcuuggcaaaguggcucacaccuguaaacccagcacucugggaggccaaggcuagaggaucacuuaauuaagcccaggaguucaagaccagccugggccacauagugagacccccccccccaccccgccacaaaaaaauuaaaaaauguaaccaggugcgguggugcacaccuguggucccagcuacucaggagcugaggcaggaggaucacuugagccacagaggucaaggagugagcuguguuuacgccacugcacuucagccugggagacagagcaagacccugucucaaaaaaaacaauuaagucuauaucauuguauuuauaugauaacuuuugccuaguuaaaauggacagaaacauaauucaaauccugaacuguugaacccuacuguuguuugauuuucagcugauuucuuucaguaacuaauuguacuacuacuacuugcauaacuaaaaagagaugauucuguuguuauuggugguuuuuauuuguauagguccuaaucaaacaggaaauucaaaggaagagugguuaugccauucaggcugaugaagagcaguugcgaguucagcuggauacgauucagggugaacuaaaugcaccuacucaguucaagguaaccacuucuaagaccauaauucuaaaauuuguuucagguggaucugcagacaaaaaguuauguaaucuucaagcaggaauuuuguauacuuguguuucuuaucuccaauuagaacuuccuuucuaaaguaaacucagucaugguucuuuuggcuaguauuaguguuucgaauauaauguacagagagagaaauagaaauuuuuaauagaugguuuugaaaccauccuuucagaagaaaacauugucuuuuacaagucuucgucggcaguuguaauuugacucagucuuaacuuuuagggccgacuaaaugaauugaugucucaaaucaggaugcagaaucauuuuggagcagucagaucugaagaaagguauuacauagaugcagaucuguuacgagaaaucaagcagguaaguguugcaugaggcugcauuauuuaaagugugagcucaccacuucacaccuauuaggauggcuauuauccuaauaagaaaaguguuagugagaauguggagaaauuggaacuuucuugcacuguugggggaauguaaaaugguucagccucuauggaaaacaguguaguguuuacucaaaaaauuaaagauagaauuacgauaugaucuagcaggucuacuucuggauauauacccaaguacguuggaagcagggacucaaaacauauuuguacacccauguucauagcaucuuuauucacaauagucaaaauguggagauaacccaagaaucaaucaaagaauagagaaacaaaauguaguauauagacacacaauggaauauuauucagccuugaaaaaagaaugaaauucugacacaugcuacaaugcaauuugaccuugaagaaguuaugcuucaugaaauaagccacucauaaaagggaaauauuuaugauuucacuuaugaaaaguaccuaguaguccaauuaauagagaguagaaaggugguugccagggugugaggggaggaggggaugggaggaacuuaacugguacagaauuucaacuugagaagaugaaaaguucuaaacaaaguggauaguguugauuauugcacaacagcauaaauguaccuaaugccacugaacuguauacuuaaaaauaguuacaggcaaaauuuuaugguaugccuguuuugccacuguuuaaaaaagugaauuaucccucuccucgccaaaaagaugaauuuagagguaguagagacacuaaaguuuccuagaccuugcuccuuaaaguguagguaguagccgcaccuggaaggucauuagaaaugcaaaauuucaguccuuacuccagacguacucaaucugcauuuuaucaagaucauagaaugauuuguaugcacuuuaaaguuugagaagcaacugcucuagauaauaccuucccugccuauaugucgcauguaaguuauaaacauuugguuauugaucuguccccuaagcucucaggagaucuggauggagguagguugagguggccagaaccuccaaccacuuuucuaggguuuucacauugugugaaaaaguugggaaacacugcuuuggcuuauuuucauuaguauaaaugcagauugguuuaaugaaaaugaacaguuguaucuaaagaaaauauaugaagaugaugaacuuuguggaacauacuagguagcuaaugacuguuggcauggcccugaggauuuuagauaaagauuauaaaugucaucaacaaauccaauuuuauuauguuagaauggauauggcugguuuuaugcaaccaaaaacuacuuuggcuuccagguucuuggauauuacacacauaaccaauuauauuccauuguuuuaaguauuugcaauaaauuaacagguuccaguauauugaaauaaauaguuguauuaaauagaguugauauaugcaauaaaacugggaauaauuuaaacaccugucuuuuuuaaaauuaugagcaguguauuguuuugggauugaaucaugguucaccaucuacuuuaugaccuugggcagguuauuuaccuguaguuucuuuaacugucgagaugauaaugguaccccaaagggggcucaaaaggauuuuaaaugaguuaagugagugaauaccaguacuguuaaaacagcaccuuaacccaugaggaggagucuuaaaaaaauguuagcaucuguagucaucaccaccauuaucacuauguacuuuguacuucaaaacaugaauauucucaguuuucagaauguuauuuugcuagucaucuauauuugaauaccuccuuugaguucuguuuuauuaucaugccuuuaucaaaaguugguaaaaggaauagcuaucuaaaaaacauuuuuguuggaagauauuguucauuauauauuuguuugauuuuauuguucuuuagaguuugucuuucacuguuagcaaaagauguaguacaaauguuuaaauaugcaugcccucuauauuuagagcacuuacuagguacuguguugcuaguaaaauagucaaaguggagucuuuuuuccugugacuagcuugcaguuuuaagaaauuaauacauuaauauguuguuucuuaauuuguucuagcauuugaaacaacaacaggaaggccuuagccauuugauuagcaucauuaaagacgaucuagaagauauaaagcuggucgaacauggauugaaugaaaccauccacaucagagguggugucuuuaguugacaguucacaaacuuguguaaagguuugugaaaugcaucuucuuacugcaucagaccuuccuuaagaaugaaaccgaccacauggagggaaaaagaaaacaauucuuucuuggauugguuuuuugagaaguuuacugacaaauuacuguucaucaaaucugaaauagucaccucacagcucuucaaagaaaaccuuugaaagauuuauaucuaaaagcuguauuuacuuuaaaagaagugcauaauuaccaaaauuguauguacuauuguacauuuuuacaacagcauuuucuuaaacauaaucuguguuuaaugauuauuguccauugagccuguacucugcuuuccauaccaaguaaauaugaaauaaucuacuuugcacauaacagaacaaacuauaauuacuuggcuguuggagauuuguacuugaguauaaauguacaccaguuuuuguauuugugaacucaucugugggaggaguaaagaaaauccaaaagcauuuaauguuuuguuuuuguucuauaaagauaugaaaauguauuuuuauauuauuuuacuuauuuggaauuuacagagcacaccuaagcaauuaggauauaacaaaacuacuuaaccauuuuugcaaccauuuuguuuuuuaagccuuuuuauuucuaaaaagaugaaa

SEQ ID NO: 12836 - RNA, 6672 nt, Homo sapiens
cgucuugagagcgggugugccgggugacgagaaaaugcugcaaagauuaacgcucucauuccugaaucccagcagaaccucauuagauccauaaaugggaacguaagcuuuaaagauguuuuugcuagaauaaacuaccacaacacuugagcuaauuaugccuuaggguguauacauacccggcuccacaggucagacgcugugaccuaagaaaaucaaccacucucaucguugaaccagaagcuucccuggacccacccauacaccccauuggaguuuuuuuuguuuugguuugguuugguuuuuguuuuuugagauggaguuuugcucuuguugcccaggcuggagugcaauggcacgaccuuggcaccgcaacuuuugccucccguguucaagcgauucuccugccucccaguaucuagaauuaaaggcauggaccaccacgcccagcuaauuuuguauuuuuaguagagacgggguuucuccauauugaugaggcuggucucgaacuucugaccucgggugauucacccgccucggccucccaaagugcugggauuacaggugugagccacugcgcccggccaccccgguggacuucuaaccacuccuaccuucccuccuaccuacccccuaacccaggcuguaucauccguugcagucgucuugaagaaccaaggaggaaaauugcaccagcaaaaaaaaauugagucaugaaagaugugaaaagauggaaacauuacauauaauuuauucagaagcaaagucuuuuacaguggaggugaguuugcaccaagugaacuacacuuuucauaguugccccagcgggcccguuugaugcuugauaaacccacucuuggcaagugggacuugcugucugaaucccggcuggauaaagaacaaugaguauggauuucuuggaaaagagagauauaaauucagggaugucuuuauuccuccuucgccugggaauuaaacuaauucuuccaaaaguucaaacaguuaucuccucuuuaaggcuuuuuacaacucccagagugcucuaguugcccucucuaugucuauacaacucugucuuuauucauucagccaguauuuguugaacacuuuuuauuugcgaggcacaguccuggguucuaggcauacacguuugaaaagguacagauaaucuagcauuaucacguugcuuugaaauucaguggcugugugucucacaccccacccugucucccaacugcaaugaauacuuguuacaaugaaggcaggaaugaagucuucauauuuguaugcccaggaacugaacuggaaucugaugacacgcguuacacgacuccuccuuacacugccaccaccugaaugaggcagcugcccugggcccagaugcugaccucauacugugcuuucugaaguggcaaauagacguuuucaagcacagucccagggaggcagaaaggccagucuuuuggccccuggaaccccaaugagucaauguuuaaugcagccacgagucuagucacaagugugauuguuuuugacugguccuuugacucacugaccauuccuggcauucguuugcguugugaacuaugauucuguuucuccugguguagucuggguguaguguggaagccccaauuuaauaauuuccgaccucacuaagugcaaggucacauuccaaucuccagaccuucauucaggaacuccuucccccgcccucuuuucuugagcauauaugcuacccacgcggagggcaccucacucgcucuauagguagcaagacccguuguccuuuaggaauacggagguuuacaucuucguucugagggugggggaaaaaucaguugucacuuuaaaagaguucgcgcuugcuaagguacuaaggcagaagccgcaccgaagcgucgcgauaacugcaaccacccgcaacuucucgcgauguuuggccccgcuaaaggucgccauuuuggaguccacccggcgccugguuuccccggcggcgucucccaacaggcugccgggaccaaagcuggccccgcgggugccuggccugugggcagccggaccgacacgauguggcggcuccgcugcaaggccaaggacggcacccauguuuugcaggggcuguccagccggacccgggugcgggaacuccagggccaaauugccgccaucaccgggaucgcccccggcggucagcgaauccucgucggauacccucccgagugccuggaucucagcaauggggauaccauucuggaagacuugcccauccaaucugguaaggaaucagggcuggggccagggaaagucccgggaggauggagaggggcgugagagagaacaaaacaccagucaaggcaagguggcugugagucggcgggggggcuuugaggccaggggcgaggauagaucaaagaacagagaaugcugacgggggccagggcaagugucuagcaacuccuugucuugacacaggguugaaagggaacccaaagccuugaagacccccuuccccauuccgcuuucuggucggcuuugaaacuaucccauuuuguuuucccucggcguccacaaaaauauaaaguagggccuauuuucucuguccuuaugucucuuuuucccuauaucaccgaugagaucucaagggugcaggauuuuuuuuuucuugauucauuuuugcaguccccuucguagauacuucguuugacaggcauacucauuuucgaguuagcuuuuaaaacacccacugaaagcucuuucaauuucuaaccagcagcaguuauuucugugccauaucaaaacuugaacaucaguguuuauaauuaaaagcuuucaguugcuguaucaaggauguuguaaacacucuagaguagauaaguuuccggagaaggagaacccccuagcggccuacucuguagugagcaccuucuguaaaauacuguauaaggaaaggaaauuuuguuuuugaaauguaucuuuuuagguaagcuugaaguuguuuacuccagaccccuucacuaaauugggaugcaaccucaaguguuuuuuguucuuuuuucaucuuuaugaaaauucagugaacaaagauucuuacugguaacuuacuugcaaaacuguauucuccuuaguaaccccaguuuaugcuuuaacuccuucaguuuguaauuuacagacuuggcuagagaacacucgguuucuucuguaauuucuuugcagaucgggauuuguuuuauuuuuaacaggugacaugcugaucauugaagaagaccaaaccaggcccagaaguucaccugcauuuacuaaacguggugcuucuaguuacgucagggaaacuuugccugugcuuaccagaaccguggucccagcagacaacucuugccucuuuacuaguguguacuaugucgucgaaggaggagucuugaauccagcuugugccccugagaugagacgccucauagcacaaauuguagcaagcgauccagacuucuauagugaggcaauacugggaaaaacaaaucaagaguacugugacuggaucaaaagggaugacacuuggggaggagcaauagagauaucgauuuuguccaaguuuuaccaaugugaaauauguguaguggauacacagacaguaagaauugaucguuuuggggaagaugcaggauauaccaaaaggguucugcuuauuuaugauggcauccacuaugauccacuucagcguaacuucccugauccagauacaccuccucugaccauuuucuccucuaaugaugauauuguucuuguacaagcacuggaauuagcagaugaagcuagaagaaggagacaguuuacugaugucaaccgcuucacccugagaugcaugguaugucagaaaggauuaacuggacaagcagaagcaagggaacaugccaaggagacaggccauaccaacuuuggagaagugugaccuaugcaugaaugaggguugaagccuacuaccucacacauccagaaggcucuggguuuuccaauaagcuaugguaacccuaaagaacaaaggauacaaugcuugaaccauccuuuuaacuuaaaaccacuaagacacugaaauuccuuguuaagauuaaaauuagugugcaaguuuacagaugugugucuacagugguaaacuguacauacaugccucuuucugcuggagugacagaauaggugauccuugccaccuacugacacugaccugaagguugagauugaguauuauaaacuagcacccagcagcuuuaacuuguagaagaaagcaucacauuuuggguaauguggaaggccuccugugaguccacugggcauacgauugagauugaguauuauaaacuagcacccagcagcuuuaacuuguagaagaaagcaucacauuuuggguaauguggaaggccuccugugaguccacuggacauuuaccacagugucuccaguaacugagucuuuuuaaaaacucugaaugaguuaaguuucuaaauuaugaauugauucaucaaaugaagauacucagaauuguccaaacugauuuuauauugcaauuugguagacauuauaaaugugugcuuaaccacugauaaguacaucacaagcaauuuuuacagggaugagucucauccuugagaauguuaucacaaaacaggaacugauugugcccuguuuaagaucucuagcauauaaaacguagaauguaugagggaauaggugccugagcagcuuccugaagcuuuaaaagaccguuggccucguguuuuaaugcaauucauguauuggucuuugucacauuggauaacauuuuaaaguuaagcaggguacuuuuuuaauugaaauuccuugaaauucgaguccucaguuuuuucuucauuugcguaaaguuuaucggggggaauuuaauuuucucagcuuuuuguuaagagcacuuccuccaaaaaauuuuuuucaaguaauaaugcucugcuuuggguugguuuuuguaagauuuuuugcacaccuaaagaguguuugcuuuugugcuagccuuaucccuccacuaaaguuauuuuaaauaauuucacauuucugcaaauuagcacuuugcuuaucugcaaucuuuuacuuugauuuuugaaguuuuaaagcaauuggaguaauacuguugaaugaacuaguuucacuuccaaaauagaaaaaauuguaaauccuugccuuaugcagcuuucucagaauucugcuucuuccuaguacuagauguguagccauuugcuuaguggacuaauccgcaaggcacacccucuaaaacuuagcuucacuacaagaucuuccagauaaaaguuuucuaccucuuuucuuaauuauucugaucagggaugcuaaauuauaauuuguuauguauuaucucacauaaugugaagaggcuuaaugugaaguuuuguuauuuuggucucuuuuuuauuaaguaucucacuuagaaauucagugguauacuuuaaagcacuuggaucuuuuucagcauaucugccuagcaaauguuuuaaaauugacauuuauuuuuagcacuuucacuuggugaagguggccauauaaaauuaaggaacauuugaacaauauaagagaaaagaacuuuuaaggaacaauucacaaaguuuguuugaaauugucagaugacauuucuugaguaccuuuugugugcauaguuauuuuagacaauauaagcuguuauggucagcauaacuuaaaaguguuuaguuuucuauuuuacugagccuuaaaaauagcacugaugagcuuaugauacuuaauguuuggcaaucauaauguguucaaauuaaugggauugaaaaucucuccacaccugacucucaucugaucuggaugguuuugguuuuguaucuuuuuuacuucucccagaaaauacuaaauuuaaaacuguaaauuaagaauauaccacuagauaacaauuaucaaauugagcuuuaugcaucauuacucagaaagcuugccuuccuuucuuugcuacuucaggacacagaguugacauuugcuuacuacagcuuuagaucuagaaguuuauucgugcaacaaauauuuauugaguaauuuauacugugccaggcauguuuugauauguuucugucauauguuuugauauguuccaacauaaguuucugucacuuuauauucaguauauauuuucuacaguggguaaauuuaacaaauggaaaggaauagaacacugauauuuuacagaauuaaaccccuucauuguaagggcuuuguuuacauauuaagugucaaguauuuauucaggggaucuuauuucauuguauuuuaucuguuaucuagguuguccauuuaccgguuggacacugauacucugucaaauuccuuucaaaaaugacucuuuagucugcugaaauuuagcacuaguacuuuaguguucugauccuggaaaauucaaggugaagcuuuauuuguggaccaucugauuuaauuauugaggauuaaaaaccuaaaccuuugcucauucuaaacucaagcuuuuaagccucacagaauuuacagggguuugcuuuuuguuuguuuguuuuuucauuuuuuacugugcuuauuaaacucuuggaauuaguuauuaaagggaguaaauucucaucuugggaauuuugaaaaucuauggacuua

SEQ ID NO: 12837 - RNA, 1842 nt, Homo sapiens
gauaauggggcuguggagacgucuuucuaugucuuuuaggcugaggccaacgugaauagucacauagcauuggacacagaaugugacagggauuaaagguuuucaaagugaaucauucaugaaggagaaacucagagucagcuuauccuuggcaaggcuauuuuaggaggaagaggacaauaaagauauuuuucuucaagaaacucuuggcgucagcuucagagcuuccaggggcuauauuuggggcuugcuuuaacauguaggcccacaugcgaaaggaaguuccagaggcaaauggaaggguuauucugcaacccucuccccucccuccaggauauuuuuagagcugucucaaaaucuuuccuggccaucugagugggccugaagaauauacaacucugaagugucccaaauauuaggaaaagggcuggagaugccaagaagagacuuggcccaaauuucuuauauuccaauuugcccuuuuguuuucccuucaaccuccucuguggaagagcaacuauuccagcaaacuucuagccccauacaacauagacaguaacugucugagaugaccauuauuauuuucuuccaaaaaccucuauguacucucucauaaugaauaugaucuacuuuaagaucuacuuaauauuuaauacuaagcugcuuuucccuccucccauaccauccaguuucuccaccaaccucccccuuuaaguuaauauuugcuuuagaaaugcacacuuacuugaacauuagccagagccaaaugucaucaagaaaguaaauguacaaggggaaaaauucccguauggaaugcauuucaaagucaaguacaaaucauuuaguacauuuaucuguggccagucaugccacaguuccuacuggccuggcagcucauagcuggcuucauuuccugcuuuuccucauacugcccuugacauaccagaucaaguaugcagaaguacuuuuaaaaguuaaaagcaauaccacugaaguuucaggucaaauuguuauguugcacuucuuauuuggagcuaaaucagaggugcucaaagugagauguuugacaaaggcugucaaacauugaaacuugggacugcuucuaaucugugccccuaagcauucaagccaggacugagcaaaagaaaggccccugccaugugccugcccagcuccagagcugggcgcuagugggccagccuccugacagacucugcccucccuggugccuacaguuucaggaggcaacuccagcagcuuugcagaguagcaggagggaaagguuuccagcucuucagcauuccuuccucucugcagggugguucucaggccccgccaguuucugcggagggagcgcuuucucacagcucucucucccucuccuguucuucuucucgcccucccccccgccuccccgcccccgcccccaaccccaaacccaacagagugauagcagcuacgacuuccuguccacugaagagaaggagugucugcucuuccuggaggagaccauuggcucacuggacacggaggcugacagcggacuguccacugacgagucugagccagccacaacucccagagguuuccgagcacugcccauaacccaacccacuccccgggguaaggcagacccucugggguggaaccccagcaaaacccagaaaaucaauauguccccuccggccacuuucuaccucgccugcccucuaccccaagggucacaggcagaagaagguguagccacacuccucaccacucuccuggcuagaacagagccuugucccuggagggaaggagggaccccuggcaagccagcuuccuaugucugucuaugaagua

SEQ ID NO: 12838 - RNA, 1127 nt, Homo sapiens
cauacacacagguaauuauaaacccacauucuuaccauuucacacauaagaaaauugagguuuggaagagugaagcguuuuucuuuuucuuuuuuuuuuuugagacggagucucucacugucgcccaggcuggagugcaguggcgcaaucucggcucacugcaaccuccgccucccagguugacaccauucuccugccucacccucccaaguagcugggacuacaggcgccugccagcacgccuggcuaauuuuuuguauuuuuaguagagacaggguuucaccguguuagccaggauggucucgaucuccugaccucgugauccgccugccucugccucccaaagugcugggauuacaggcgugagccaccgcguccggccucuuuuuuucuuuucuuuuuuuugagacaaagucucacugugucacccagacuggaaugcagugacacaaucucggcucacugaaaccucugccuuccagguucaagcuauucucaugccucagccucucaaguagcugggacuacagaugugggccaccaugucuggcuaauuuuuuuuuuuuuuuuuuuuuuuuguagagacaggguuucgccauguugacgagacuggucucgaacuccuggccucaagugaucugccgccucagcuucucaaaguacugggauuauauaggcaugagccacugagccuggcccugaagcguuuuucucaaaggcccucagugagauaaauuagauuuggcaucuccuguccugggccagggaucucucuacaagagccccugccccucuguuggaggcacaguuuuagaauaaggaggaggagggagaagagaaaauguaaaggagggagaucuuucccaggccgcaccauuucugucacucacauggacccaagauaaaagaauggccaaacccucacaaccccugauguuugaagaguuccaaguugaagggaaacaaagaaguguuugauggugccagagaggggcugcucuccagaaagcuaaaauuuaauuucuuuuuuccucugaguucuguacuucaaccagccuacaagcuggcacuugcuaacaaaucagaaauaugacaauuaaugauuaaagacugugauugccaccaac

SEQ ID NO: 12839 - RNA, 3344 nt, Homo sapiens
uagaauuuacaagguuuuuuuuuuuuacuguauaaaaauacaucaccugcucuagucagguuauaaauauaaucugugaauuuuuuuaaaguuucauguccaaguaaaaaaauaaauacauuaaauagcaaaaaauaaauaaauauauuaacuaauaaauauauccaauagcagaaagauauuacaaaaaucuuauacaaguauggucucaauuaagauuggggaugcauaaagacaaucaugcaaggaagcaaguaaugcauaaauaagauacacugugaccagcacaagacuaguacaguaaagagauggugguuuggggucaugccuccucugcagguauugaagacuggagcucuugaccucgaauauucuuagcagcagcaucacuuuccuccuauucugucuccuccauccauugcagaagaaugucuaguucccccaaagccuucacaacugcugccugagguuccagcugaaagagacacacacccaugugguuagcaauucaugagacagcauuugcuccaggaccuaucucuuuuauggauaggucugcugacaauuguaagcagagcauucuuuucaagaugaagcacuuaaagaaguuauagaaucucaagauaucacacaaggaagggaaaucauugaguucaucacccuggucuuauguacagaaacugaggugcaaggggguagcagaaguaaaacugcuacuuaagacucuugaaucacagagaucaaaauaaucaagcuauuuucuuuaagaaacgugugugugugugugugugcacgugccuguguguguguguagggguugccuacggugcacacaucaguugaacagauauugauugugccaaucaccuagcugaugguuagggaugaaaaggugaauggcacaaucccuauccacaguugagugaggagacuggcaaaaacaggcaacuaaaauguaguguggugaauaaagggaugaaauuccuacaagaugaugugggaggcaucuaacucugagagaaggagccagcaccuuccugaaagugaugcccaggcugagucuuuaaaggaugaguaggauuuagucagugaggagugaaauccaggccuuccuggcagacaugagaaggugugaaggugagaaauugaauggcaugggugugugugugaaauugugaguguuuucaaagguacauagaagugugugaacauuguaaaacuauugccucugguuugugcagcuaaaagauccagaugucacuguagugacuugauggaaucauggccauucccuuuccauuuccagagcaucacccagagaggguacuccucuagagccuggauggguguccccuggguuaaagcaagggcugguccucaugauuucagagggcuaugaaccugaaggcuacaggaugucuaacagugaauaaccaucccaccuaccuaugaucucaguucuuaaaacacacccaucccaaucaaugccaaagucgcauauaccuuuucaaagugacucagaaucuggcuguauuucuucauugcuuccuccccacaauggcaugucaugugggcaugcugaaaaggacccaaagaauaauagauuauauuacagauucugauuuuuugccauugacaugaagcaggcagaaacucuacucuuucacccacaacccugaggaugcuuauuccuauagaaaagcucuuucagaccucacauuuggaaucacuaaguucaucaucagcuaggagaggaagccaccuuuuaggcucaaacauggaacucaucacuucuuuuuuagaaauaggcaggcaguacugaaggcauuugccauccccguaccccaucuggccuccccacaacccccagcuguagucuaggagcucuaucccagagcucuuugagcccccaugagaaaaaaaaaaaaaagaauugaauuccuagguccuauucagacuauauucugaggucaagcucaauggucuacuaauugacugccuagacagaggacgcacuaauauacuguaggauaccucaccuacagaaaaaguauaauuucaaagacaacagaguuaucauuaauaucaaauaguuagcaucuuauaguucuuuagacuuugcaaaguacuuuuugccuagagcauauaccgaaaagucaauaaaacugaguucuuauuaccuagucacaugucucaacacagauuauuagaacuuuuggacucaguuucuccauccauuaaauggagguaggaaagagaguuuaguugcuaagccauugaagcugugugcugagaugcauccugucacccaagacccacacucacacagagccggagguccuucuugaugguaagaaaggaauuggcgaggcugcugaucuuccggagaguauaauggucaggggucugguaguuuuuaaauacccuguccagauagagucuuagcaaauggcgcaggaggcagcaucgauucgcaggcugcaaaaaaccacagguauauuggugaggggaaaggggagagcagagacaagaccagggugauggagaugcucccacuccacuccuccucccagaguuugucugggccaagcacauaccuuugugucuugcaaagacucaguccuccuuaagauucugaugucaauguuuccaucuuuggcuugcuaaacagaagaagacaaaacaagcaaggaugagucagugccugcugccagggucuucaauaucaagacuucucauccacucccugccaagaacuagugggagguguccuuucccaaaacauuuuaaauauuugaacuacaguuauuucuuuggaauacaucccccggguaaggaauccccagccugccucuuuuuaugauuacacugccaguacugccaggaaagagaaacggacaaggaaggaagagaaaaggcuuucaggagagguagauacccgcuuacguaccacacugccccguaucucagaaaauccauuucguauuuccugaagguuuguggcgaucacacagcuucccaaauugagugucuucaguccaguggaaggaguccauaggagauaaaacgcagcagagagaaggcugaaggcaagacuagaggcuuucaucuuaggccugaaaucuggagaccacaggagcuaggaauucaaagaagagagcaugacuuacugaguuuccccuccuccaaguguccacggggugagggguggggggucaggggaagagaacagccuuaucuggccucagacaguguggcccauccacgcaacuuacuaagaaaaacugccaagccucccgugaagagaagauuucaggucugaguucagagucugagugcgaguu

SEQ ID NO: 12840 - RNA, 55560 nt, Homo sapiens
uuuauucuauuaaguaugaucugugcugcuauuguuccacuaccuccaucucuauguucccauugggaagcagaauuggcccuaagguuuagggggacugaccuggacugggaaucagcaucagaaacaguuuuugcccagaaagagggucuuggugcuuucuuuucuuucucucugucucugucucucucugucucucucucucucuccucucuuuugccacacacuguuauacuguggcugucuaggggagauaggcaugguaguuacuaggagugggucucccuccuucaccucuucuccuuuaacauaaugcuuuuugccuuuguguuuccaacaggucagcggacagauugcagucuagccaggugaguguggccugggacaggccugggaagugauagaggcuugguggguagagcaaucuuacucugggagagagccaaggaguugaguuguaaaggcauugaaugacuuuacaaagcaauggccuggggcgggguuuguuuacuucccuuugccuuacugaccccaucugaucucagauagaaaugggguuuucugggacuuugagaaggagcuaagcagaacugaguaaaagggguuaucauuugcugaaauugucccagagacccccuaacgccacugaauugcaaguaacauaaacauucaacuguagaggauucugguaaccuaaccuuagcugcuagacuucaacauaggggcucuggggagucucugacccagagaaagaagaucaggagauggcauuugauuuuuuuuuuuuuuaaugcccagaaaagaaggcagccccuaauuaguagugacuguugcuggauaaugaaauauuacauugcauuggcucgccaaagaguauugguagaaauauuugccugauguacaaguaugcaccccucccaaucuuuccccaccuuccccuuccuccuccaccccagccaaauauuuucccucucagucauggugcugcuaugagaaaauuugugagcugucggagagcaagguauucauucauccagcaguucucagaugccuagaaaugugcugauuuaacuagagaaggggcuuuaauggguuggacuccuuagagacccuggguuagcccauuauaucaaccacuuauaucugccaaaacacauaauaauuaugaggccauuuacaauuauagguucauuauuuagagauagcuucauuuggcuuucauuguuuugucauugugaauuacaauaaagaucccauuaauauaccagucuugaugacuggagggaaccaggauaaugggauucucuggaacacaucuuuuugguguuagagucuuacuguaaguucaccugagcuccugagucuguggaaggcucuguaggacugaaaagagcugaguugaauuucccggugcugaguuauuuugcugugagaccuuaggccgcucuuuuccccucucugaacucugguuuccucuuauagaagaccagagcacuccacuagauucaagguguccuaggauuccaaagggguuccucaggaguggccugguggcaggggcagagcgaugaccagcaaccaggcucuggucccauccuucacucagagcaggacagcccuggccuccuugguuuggguguuaugccucugagucagauucccuuugagaagaggcuucugaggcuaaacacagauuggaaaacauugaccuagaggauucucaagguuguuuccaaacuagauguucuacacucuaaacccagaaaaauuguucccuguaaagauagcgaucuuuaaggauuuccuagagaaacaaaacaaaaagcauccuuugguguuucccagugucuccuagcaggcaaaaaaaucuucuuauugucuagcccaaaaauauuuuacuaaaaauugaaccaguccucuccuauucuaauuuugaguagugguagacauuaaaagcagggacgucugugcuuuugugaaaaaaaagagcuuucguaggcuuuauuguggaaguaauuuaucaaguuucuuagccauuucugggacugaacugaguaaugucacauguuucauuggcuaccacacagauuuuuuuuaauuauuaaaaacuuuacuucuggguuuaagagugauuguuuaucucauucgucccaauuuucucuuuuucucccuuguugcuggauugguccaaucugauucggcgggauuggucacaggcgcagcucaacugugaggaaacagguaagggcccaagcggggccaggcuggucuggccugaaaauauaguccaucccacaggcauuuauugagcgccacugugugcaggacagacaccucugacuucaugccugcauuuggaauguaucauuuagucauaguauguuuaauaugguggcaaugucauugauuuaacuaguuggaguggccauagucuuuuugacuugucccucuccuuucuagucauuuauccucuugcauacuagggguuugguuucauuggugcagauuguuccagaacugcccauggcauccuuuuccaagaccacaaaagaggcuugacacuuccuacauuugugcuaacauaucaguaacucacagcaccuaauuagcuagaccagacaaucucgcuuuaaguuggcagauuuuguuugauuguuuccgguggcguagucauucuagauggauuccuaagacaugcuaacaaugagaagauuaagucuggucuaggaacgauaggcaagggccguucaacucugcaauuuggugcaugaucuucaguguuguguuaaaaucugccacugggcagccagcucucauuacccauauuaggagggcucuuagagagcaguggcauggauaauccacaucaauggauaaucuaaacagcacuugugcuuguuuaaaaaaaauuaauugaaguauuuuuugcaguagcaaaauugacuuccuaauuauacuuuauggcaaauacugaaaugauuuuauguccccuaagcucauaccagcuaugcaguagacagcagggagggcggguggagagagcucagaaaugucuuugugucugcucaggggaaagcuaauccaggcuuuaaaaaaucauuuuggguaauucucaguggcucuagccacagggagauaaucgaauaaagagggcgcaugguuuuuauggugucggcagcaccggcauuucuucagcucaucugacugcucugacaggguggaccauuaagcuggggaacuuggaugauacaggccucgcuugucucagcuuugcugucacuauuuuccccuucucuacuuugaaucucgucuuaaugaguaugccaucagaugcaauuacacauuuuuuaaauuauaaaaauuuaauugcaagucuccucccucuuuuuccucuauuucuuucuuccuccucuuucuuccauaauuucauuuaaaacuagagaggaauggagugacuccuagagauaauuuagugcauuuaaaauuaauaggugcauaucuugcagagggagcaagccauuuucccuuuaacacuaagaaaagaaaugagcuugaaguuuguucuuuucaguuccuuggcugaaaccaggcaucuugcuuauagcuggagcauguuugcaagggguuugcagcuccacuguggcugcaggagugccagagacaucaguuuggcaggugauaugugcccuugguugggcucacuguuggaggggaacagcacccaucugguuugcauccugcugcacauaagcaguugcaggcaaaguguguuugccuggugcuagauuugcguaggaguuacaagauauaccaaaauccccaauccaauaaagaccuuguuuucauucugcugccccaguuucucucuagcaguucauaucuacuaguggaucagcaagaaguuuuccuaagauggucaggaagauaaaauagauaguaaguuacuuggaaggugaguaaucuuauauaaguaacaaggaaauaauuguuuguuuauggcaaaucaggcaaacaagaggaagaagcuaguaguuuuuguuuuugagggucuuuaauggguuccggucauuuuugacccugucaaagacuagguuuaaaccaucccagaccuuuuuuaaaaaggagacagucucacugcugcuuccagaccuucccugcucccuguaaccucagcauuauuucucuccuggccaugacuucauaucuucuuuguuggccuuucuccauuccucuaaauugaagcauuucuccagggcucuguccucucacgaugucucucuauauucuuuccuuugucacucuuguucccuuagaugaaucuuucucuucuucccuaagcauucuuuuguucuauaaugcuguccuuuugaguccaaugaguaauuccucagugaucgacuagacauucauacuugaaaguugugauagcaccuucuaccuucagcaucagucucaccgucccccaucacauuuugauuugcguagccccucccuucacuucucuguuuguguucggggggacuccauucuucacagucucugaggccccaaaucuuaccuuugaugcuuuuuucaucauuacucacauauaaucuguugucaagauuuguauuuucucccuugguaaaaaugaaaauuaacaaauguaguacaaauaaguaccuaacaaaaacucuaacccucuuacucaugugaaauuaugccagauaaugcauauucacagauuuucuggccaccuuucugauuuuuuuuuuuucuuuuuugagacagggucuggcugugccaggcuggagugcaguggcacaaucuuggcucccuguaaccuccaccuccuaggcucaagcagugcacccaccauagccuccugaguagcugggacuacaggugcacaccaccacgccuggcuaauuuauguauuuuuuuuuuuuuuuuuuuuuuuauagagacugaguuucaccauguugcgcaggcuggucucgaauuccugagcucaagugauccaccugccucggccucccaaagugcugggauuauaggcgugagccaccacgcccggcccuuucugauuguuuucuccugcaaauuacuggaccacugcuuuacuauguuuuccaacuuaggcccuaccuuucucccucuacuuuugguuuaaaguucccuuaaucugauuggaugagaauuuggccugauuccuuaaaggccccuucuaacccuaagauuucauuaccaaaaaauaaaaaaguguaugaaggaauuaagcugacaaggauuucuaacauuggaggagggaagaagacagagagaaaggaagagacgaauaguacauaaaaauguagacacugcucagucagugcucacgccuuuagucccagcacuuugggaggcccagaugggcggaucaccugaggucaggaguucgagaccagccuggccaacaugguaaaaccccgucucuaccaaaaacagaaaaauuagccagccaugguagugggcaccuguaaucccagcuacucaugagucugaggcaggagaaucacuugaaccugggaagcggagguuccagugagccgagaucaugccauuguacuccagccugggugacaagagagagacucugucccaaaauaaauuaagauaaaauaaaauaaacucaguuaacucuaugcaagggcaguggugaagugcaggucuucguggcaccacaggagugcacagacacaucccagggaaauuaauuuacucauugcucagaaacauuauaaggagagaggaggauggcaggagcguucaaagccuuugugacuuuguccauuuugugcuccuacuggacucuuagacuccacuggagcaguggggacuagaaaaaugccugugcaguaggacaggucaucuuuagcccacccuuaccugccacagguuauccauugggggcugcaugugagugcugcugguaaccacggacaugcagguuaauauuuuucuugcccuguuuccugccaacccuuuguacuugccuuuaacuaccacugauauuccauuuccugcaggccaaauuuuguacucacacaauuuguugaagccaguagccuguaagcuuuccagcuuuccucucucuaggucauaauauauaaaccuaggaccaacaaaacuaugcaaacgcucauaucacuaacuucauuaucacugcugcuacuauuuuuuaauaauuuauauuaauacacaauaauuguacacacuuaugggguacauguaauauuuugauacaugcauacaauuuguaauaaccaaaucagguuaauuaggguaucugucaucucacauauguaucauuuuuugguguguauguauugggaacauuccaaaucuucuaucuguuuugaaauauccaauaaauuauuauuaacuauuauuauccuacugugcuaucaaacauuagaacuuauuucuucuaucuaacuguauuuuuauacccauuaacuaaccucacuuuuuuuuuguuuuguuuuguuuuguuuuuugagacagggucucguucuguugcgcaggcuggacugcaguggugugaucucagcucacugcaaccucugccuccucaauucaagcaguucucaugccucgaccucccaaguagcugggauuacaggcgcgcaccacaacgccuggcuuauuuuuguauuuuuaguagagacagaguuucgccauguuggccaggcuggucucgaacuccugaccucaggugaucugccugccucagccucccaaagugcugggauuacaggcgugagccacugcacccugcccaaccucacuucuuuuuuuuuuuuuuuuugagauggaguuucacucuugucgcccaggcuggggugcaauggugcaaucuugccucacugcaaccuccaccuccuggauugaagcaauucuccugccucagccucccgaguagcugggauuacaggcaucugcugccaugcccagcuaauuuuuguauuuuuaguagagacaaaguuuuaccauguuggccaggcuagucuugaacuccugaccucaggugagccaccucaccuggcccaaccucacuucuugaccccucacuccccgcuacccuucccagucuccagaaaccgucauucuacucucugccuucaugcaaucaaauuuuuuagcuuauagauacaagugagaauaugcaguauuuaucuuucugugccuggcuaauuuuacuuaacacaguguccuccaguuccaucuauauugcugcaagugacagaauuuuauucuuuuuuauggcugaauaauauuucauuguguauauauaccacauuuuacccauucaucuauugauggacacuuagguugcuuccauaucucagcuauugugaauaaugcagcaauaaaccugagagugcaguuacacugauacuucaauauacugauuucuuuucuuuuggaucuauagccagcagugggccugcuggaucauaugguagaucuacuuuuaguuucuugaggagcuuccauacuguuuuuuugcgguagcuguucuaauuuauauuccugccagcaguguacaagcauuccccuuucucugcauccuugccagcauuuguuauuuuuuggcuuuuugauaauugccauuuuaauuguggugagauuauuuaaaaauuugcauuucuuaugauuagugacauugagcauuuuuucacauaccuguuggccauuuguaugucuucuuuugagaaugccuauucaaaucauuugcccauuuuuuaaucagauaguuugguuuuuugcuauugaguuguuugaguuccuuauauauucuaguuauuaaucccuuaucagguggauaguuugcagauaucuucucccauucuuuagguugucucuucacucuguugaucguuuccuuugcucugcaaaagcuuuguagcuugagauaaucccauuugucuguuuuugcuuuuguugccuaugcuuuugaggucuuacucaaaaaaucuuugcccagaccaguacccuugaagcauugccccaaugguuuuuuuuuuagucauuucauaguucaggucuuacauugaagucuuuaauccauuuugauuuguuuuucuauauggugagagauaggaucuaguuucauucuucugcugcuauuauuuguaaaugagaaauguaauaacagaagucuguaaacauaaaaagacuccccccagauugagcuuuucuggcauuuucauaguggaacccaguuucuuccuuagaauagggaagagaagacaaagauucuuccccugagaucacccuagccuaaccagccagucagugaugccgacaagaggacagacacuggcugcuguagcuggaaagcuggaggaagcagauggguuugggggucaugaagaugagcauuugggucgcugcgaccguccugacaccagcuccaacuuggcacauacaguacucccuuuggcaucaucccugguucccagaaagcuugagagguagaggcuaagccagcuuuucucucagccugacuuuuuugugagacccagcugcuugccuaauaguggccaaacccuauggcuacaguggcaaauucagagccaggggagggauccacgcagaccugucaaacgggcagaagcuacacagacccaucgcacuugacagucuggucucuguccugaacaucuaaagcccuuucuaguuaaguucgguccccucucccugaucucuuucuuccacacagcugaauuauuguacauucagcugcauuauaaaacccuacugguuuaggccaggcacgaugguucauaccuguaaucccagugcuuugggaggcuaaggcaggaggauuacuugaggcuaggaguuugagaccagccugggcaacauagcaagacccucuauguaaaauaaaaacgugcuggguguggucuggguaccuguaguuccagcuacucaggaggcugaggcaggaggaucacuugagacuauuugcucaagguuacauugagcuaugaucgcaccacugcacuccagccuaggcuacagagggaaacccugucucuaaaaacaauaaauuaauuuaaaauauaaaauaggccgggcguggugacucacgccuguaaucgcagcacuuugggaggccgagacaggcggaucacgaggucaggagaucgagaccguccuggcuaacacaaugaaacccugucucuacuaaaaauacaaaaaaauuagcugggcauaguggcaggugccuguauucccagcuacucgggaagcugaggcaggagaaaggcaugaaccugggaggcagagcuugcagugaccugagaucgcaccacugcacucugucuggccugggcgacugauugagacucugucucaaaaaaaaaaaaaaaaaagaaaaagaaauuguauauauaaaauaaaacccuacuaguuuugaguaauacuugguaugcacaccuggcaauguuugcugaaugccuagggugcaguauggguaguggcaaaguguuaggucuccgagggagauugccuggguuugaauccugguuuugccacuugccagcugugugaccauagcagcuacuuaaccucacuaagccuucauuucuucauuuuucuuuucuuuuucuuuuuugagacagggucccgcuccaucacccaggcuggagugcaguggcuugaucuuggcucagugcaaccucuguccucugggcucaagcaguccucccaccucagccucgcaaguagcugggaccacaggugugcaacaccaugccaggcuauuuuuaguagagacagagucuguugcccaggcuggucucacacucuugaucucaagugaucugcuggccucggccucucaaagugcugggauuacaggugugagcgaccgcaccuggccucacuuuuucauuuuaaugaguauaauaauaauaauauguacuccauaggauuguuaccagcacuaguccaucuaaaggacuuaguacauggccucacaccucuuuaaauuccucuauaaaugguaggcacuaauguucauguguuaauaggaaauauuacucuccuugccuccaguccccuccccagucuguagaaggcaaauugaggcccaaaaaaguucagugacaugagccagacugugaagcaaaacaacagagcaaagauugacaucugggaggccugcuucuuugcuuaguaccuguuaguccccacuauuuagaguuaguuuuucuuuucuaucuuaccuuuauaccaaacaaacccucuuucugaagcucccauugguucauucugcuaccuucaacugagaauaauugagcaccucuuaugugagagcaucauggccaacccuggacacccaggaauugacauaggaucugcucuugugaaguuugagcuguaguggugacaagugccaacaaauauucacauccacacauuggagucacagucaggguugaggagaacauacccccagcaggagcagcucaugcaaagccacgaggcaaaggaggacuuugcagaacagaaacguggccagcauagcuguagcagaagcuaggggaaagaacaggcaguggaacuggaggcacaggcaguauuccuggcaugcaaggccguguaagagaguaaugagaggucuuugaaagaguuuaaauaaugaaaugugcccuuuuaagauuaccuaauuacuaugugaaggaagagaaaugcgggucagaagauggcaaggaugggaauugagguauugguggauugaacuagguugggggcaguugagauagagagaagcgaauggauuugagagauauuuagaaggcagacaugacagaauauuaauuaauuaggugguggagaagguggugagaaacugguuuggggcagaagaugaucaguuuuguuuaggacaugcuaacuuuaaggcaucuguguagcauuccaugugggugguuguauuuuugugcucuggaacuuggaggacaggccaggugcuucuuuguagaccggcuggugauccgcuaagacaguucugcacgguuuggcccguuuucucugacccugggcuaucccuguuugaauauucuaauguuguguuucccuuuggcuuuucaggacuccagccaggcaauuccucuggugguggaaagcuguauccgguuuaucagcagacacgguaagcaggaugacagccuuguccauauuugugcaaagauugggaagaacuuccaggaauucuuuguagaguaagaauagagauugacuucccauccuggcauucucagaaaaggaauaaauucuuacuuguccacauaacuuuugcuaccucaaaauagccacaccuagacauugaaagaaaugcaucauauauuuugacacaaaaugccucagccacuuaucacgcagcauuuuuuuagcuugagaguaaguuugaaauugcagcuguuauguaaauacagcugcuauuaugugguaacaguaguuucaccauuacucacagucuuugcaaguguggguaucucccacuguacagccugaccauuuugucacuuucuguaccagacuaguuugaaaacaacuccuuucccaauguugcagugauuccuaauaaucaguuuuuguucugguuuggucucacuggauacagcauggccaagggcugaguuaguagcuggucuuaaaguuguauccaacuuuugagaaucugcagaggcaggcugcuucucagccuaggugaaaucauacucucuucuacuuggaugaagcugaaucuuauaaacaccauuccucaccagcuacuggucucauuggacagaauuuagcgaucgaaauaauugccagagaauugauuucccagggauuagaguguuuauaaaggacagaacuagugcuaugaaaauuucuaggaacugagcaucagaaauuguuuuuagaugcuguucuuucugugauaggaaaaggggcagagugaccuuucuggagcuaaggagguagauaaaauauugcuugucuaaauucagaggcagcuauucucucucccucuccuugucuuuuucucucccuguaaacugggacauugcucagguucauuuuuggaauaguaauuauuauagcaugguuacaauugaucucauucuaaucagcuauaauuuuuaaauuuuaucccuauucauuuaaaguaacagcauuguauaucaguauugaacagucaacaaauuuaucaagucccugaucaaugcuggguaccaugcauugccaugcaggaaaacagaaacaggaauaauauacucuuccugucuuuaagugguuuugugaugcaguugggagaaauaaguaagcaagugauaaguuaaauaaaaagggauaagcugugguaauucagaauagaguauaagaaauuucacaagauaguaaugauuaacagucaaacaguuugcaaagaaaaguccaaacggaguucaggggaggaugaauuauuugugccuaagagacaauaggaagaagaaagucugagccacuguucauuagcauacauuucauucauugaacgaauacauauuaguugcuuauuauaucccaacaaaaaguuucugccuucauaaaccuuacauuccacugaaagguggauaagcaaaugaccaauugaucagccaguaaauacaguaugucagguauuggugaaugucaugaagaaaaguaaagcagggugaggggauggagaaggaagagggaacacuguuugaagcugguucagggaaaaggccucuccuaaagugacauuagggcagaguugugagggaguaagccuuguggauaucuggggaagaguaucuuggggagcgggaacaagugcagagauccuugccauaugcaggaagccagcguagcuggagcagagcaaaugaaaaaggaagcggcaggagaugaagcuggaagccagacucuuagggccucaugugcuaggauuggauuuuauucugaggaagaugggaagccacuggagaauuuugaacagggagucaucuuuuuaaaggaucccugaugcucuauggagcuaagacuguaagaaggagacaggaagcaacugcaguagccugaggaagacaugauggcggccuagaccaggguguuagcugugguauuugcugaaaagugggcagguuccagauauuguggcaugaauguaccuguuucugccccuuacagccacagugcgugagugcuucaccauuacuguggugaagcucuggggaaacaggcacauuuauauguuacuaaugggaaugcaaacugauacaacucuuuggaagggaauuuggcaguaucuaacaaaacuucauaugcacuuacgauccagcagauccuaggaauucuagaaauuugccaugaaguuacaucuccaacaauacaaaaaugcaugcgcacaagguuauuugugacagcauuguuuguaguugcaaaguauuagaaacaaccuaaaugcccauacauagaggagugguugaagaaacuaugggacauucauucaauggaguacuauauaagaaugaguaagauuuccuugaacuaauauggagagauucccaggauauguuguuaagugaaaaaaacaaaaugugaaagagucuauaucauguagaauacuacagaugcuccucggccucuaaugggguuacguacggauaaauccauaguaaguugaaaauguacucaauauaccuagccuagggaacaucagagcuuagccuagccugccuuaaaugugcucagaacauguacauuggccuacaguugugcaaaaucaucuggcaacacuauacacuguagaguauguguuguuuacccugguaaucacguggcugacugggagcuguggcucuuuguugccgccaagcauuauaagagaauaucguacuauauuuugcuagcacaagaaaagaucaacauuggaaguauuucuccugaaugcauaucauuuugguaccaucauaaagucaaaaaaucauaagucaaacuauugcaagucagggacuauauauauagauauucuuuugcauuucauuaccuuuuauauaagagagaagaagauauaagaauauccacguaucuucucauuucugcaaaaagaaaugcaggaaggaugaaucuaggaacuaauauuuaauugguuacuuauaggggauggauggaaaaaacgugaaaagaauggggcaaugggaaaugguaaggaguggcauuucucuuaccuuaguguaguuuugacuuuuagaacaacauuaguguuuccuguacucaaaagauaaauaaacaagccaagcaugguggcucaugccuguaauccaagcacuuugggaggcugaggugggcagaucacuugaggccaggaguucaagaccagccuggccaacauggcgaaacccugucucuacuaaaaauacaaaaaaauuagcugggugugguguugggcaccuguaaucccaucuacucgggaggcugaggcacaagaaucacucaaacccaggagauggagguugugaugagaccacaccacugcacuccagccugagugauagggugagacccugucucaaaaaaaaaaaaaagauaaauaaauaaauaaaggcagaguauggguacaacccaaaauggaaugcagacaguaacauauaaaccuaacuguauuacaagugaauaacguaaccacaaugaagagaaugaggaagaaaauaaccuaaguaauuugucuugacuguaauauaaaucugaagauaaaaagaucucuaaacaaauauuuuacaguaauuaguaauuuuuuaucacacaaauauggauuagcaauucuaaaaguauuuuauauauauucuaggaucaagcaaauauauuguggauuuuuuaacaauugagcacauaguagcugcucaaaaaacaucuguuccacuaaauugauuuuucccaaauaggggcuuaaggugcucaugaacucccuaaaaaaccauaguaaaaauuuuuguguauaggcaucuaaugaggauagagcucauaaccugugucagucuugaaagagucuguggcccacugaaugcuggggauuuucacauccuaacuauccucaaaucccaugggagguagacauuauaguccccauuauauagaugagaaagcucaguggugggugagggugauucaggaaggcuuaaaggaagagaagcgauuugaggaacaauugaaacugaaucaugauggaaaaaaacaaaaaaacaaaccgccauuuucaugaggaagggagcaagauaacgugaacaugagauggcugcuguagaaaucauuugaagaauucuccaggagaacaacuuuuggcaaugguuggaucccgugcacaauggaagguuuugugccauuuccaaauagcuuaguccaagucugaugaguuuuauacuuucauguucaugugaacugagaaaaaauuuaaaagaucauggaugugucacuuugguuauguaaggauucgccugcauuauaauaaaaagccaacugguuuuucccuuuacuuucuggaaaccagccacuuauuaauguuucugcuucuagaaucuagagauucugucuguugagcaagaacacauaguagucccuccaaaacauaaguucucaggaggaaacagagaccagaccuaaagagagcuccauguguuccaggccugcugccugauuuccaaugagcucuccucucauuucuucuuguccuggacccccaggccaaggcugcuuuuccuugguguccuaaccuaccaaaaaguaucaagaugaugacgcucuuucaagaauuugugcaauggcuucaccaacuagaacauagugaguagccugguuuccgagaugacauuugcuuauaccauguugugacauguggcuguuucucucaaagcacuuguuguuuacauacuaucuuuaaacaacauuaucuggcuuuuacaucccauuuguaacuaguauuauaguccuauuacacugguacuaaugagguuuuaacauugccugccacucugugaggaauauucuggagauuccuuuauaggagcagacaacuuaaggccuauuacaagccagguaacuauauuuccucugcuuacuuuuuaauguuguuucaguuggauucaaaauaucagucccggccuaugugguuuaccuccaaaggucuaacugauagaauucaucugccuccucacugagaaacccucaaacagugggcaaaauguagcauuaguccauuuuguuuuccuaaaauaaaauuugagauuucuccagcaugucaagguuuuugaaggauugugccguaacagagggauuuugacagaaugcuuaagauugagacccagggauccugagaaaagcugagcgguccugaugcaaucagagaugcuaguccaguccaaccccuggggcuggcacugaugacacacuugcuggauuucucacccguuuugcaguuguguguguggugcugucuguaaagccauguccaugcucagacugaccaaugugguuccagccucugcacuugcacuccaguagacuccagaagccugguguugaggacugaguaugauugcagccacaaggccugaguuugagucauggcccugguucuuacuuccuguauaacuuaaggcugacuaucacucaucaauccccucauccagagaaugagauuguugccaaccuuuaccuuguugugacauuauuauuucugaggaccaaguaauuuauuucugugaaagcauugauuagcagcagucacuaugccagcauuuuuuucaugauuuuuuucucuaacaaaaccaagaaauucuugugcacauuaucguaguauaacauucaugcauguuugucuuuagaguaaagcuguagucaggaaccagugccuagcacaaugucuggcaauacuaucuguugacugaucacuucauagcaagcuuguucaaccuguggcccaugggcugcagcacaaauucguaaacuuucuuacaauauuacgagauuuuggggggauuuuuuuuuuaucaucagcuaucauuagaauauuuuauguguggcccaagacaauuuuucuuccaaugugguccagggaagccaaaagauuggaugcuccugacuuauaguuucauguucucucuuuuucaugaguauugaaagcauugcccccuugaacaaucaaaccguguuaaaacagcuaaagcaauauuauaaucucagaccuuaugaaacuccucugaugagaacuaaugccuugaccuauuucccauucuuuuuuuuuuuuuucuuugagauagaguccacucugucacccaggcuggagggcaguggugugaucauagcucauuguagcuucuaacuuccagguucaagugaaccuccuaccugagccuccugaguagcugggacuacaggcaugcuauaagcacugugccuggcuacuuuaaaacauuuuuuagagacagggucucauguugcccaggcuggucacaaacuccuggccucaagcaguccugcugccucagcuuccugaguacauuuuucuauucuugacccuagaugauuuaaaaaaguaccaaugggucacuucuuugcuuuacagaugggaaaagagaggcaaaacaagggaaggaaucugccucauagucgcccuuggagucaaaggagucucuaacuuggugcuuucuagugaaaaugaaugccucgaaauuauuccagugacuuuuccaacauccuugcacauguuuuucuccuuuggccuaaagaagagagacagcgugcuuaaauacaugcuggcugggggagacagauauucaacuaagcuuggcacuaugcuugugaauuugcuuuuucuucuucuugaucacuuuucuguguauuuccaggacuacagcaugaaggaauuuuccgggugucaggaucccagguggaagugaaugacaucaaaaaugccuuugagagagguaaggaaacagucuugaagauaaaaccaaauauuugccagcccccugggguauuggcuccacccuuucuucucuaagagguccccagaggucaggaagccaacuucccugucucuucaggggguaccugcugucuuguacacauuccccuguagauaugcagagaaauaccagggcacaucccaguuuccuucuucuuucguagcccuacccauccugccucuuucacgccgaugaucugccaaaacccaagaaguuaacuaugauaucugggcgguuuauggcuucauccggaacccuugguagcaguuaauaucaaggcuaaugcgcuuguucauuguagcccauuuauuauuuugugggcuauuaagguaaugggcaagcuuuggcaauuuccgucacuguaauggauauauauagugucaauuugagguuggcccuaucauuaaaucuaauuacaucugauaugaaauuuuccauagggagcucuggcaugauuguucuguaaguagguguucuugguugcaggccaggagacgugagagccagucucaggagcuggccuccuuggccucauuuuucuccccgcaggggcucagucccagccugguuucaugauucuugugagauacaguugcugugucccauccucagcccauagggaaugucccugagccaggcuggcacaagagaguuuauauugguggacucaucugccgugcuuugguccuggagccccugaaauggagcagucuuugcuuuaucuguucccuggucugucccacucauggccaccaugccgggcagaaagcugauggauugggaccaggacaugcaugguucaccccuuccccacguucguccuguguguuuuugccucucucacucucuuuccuuuucguggggguugcuuauccucaggagaggacccccuggcuggggaccagaacgaccaugacauggauuccauagcugguguccugaagcuuuacuuccgggggcuggaacacccucucuuccccaaggacaucuuucaugaccugauggccugcgucaguaaguaccauucuggcuucagauuggcuucugggcuacagcaccgguagcaagagagaaaaaguuuccacagggucuguguguucucauaagcuuuucaaugaaguuuuucuuuuccccagugaaauuucuccucagccucacuccuucauccccuggugggaggggaggaggaaagacuuuucaguaagaaucuaggaccccccaagucaguacuccuggccuuuuuuuuuuucuucugauucaucucugggcuuuaucuuuuuuuaguaaaauaccuuuauuuucaauuauguauuugaagcuuauacauuagugcuugugcuuuucaugguacaagggggaaaagcauaagcguugcaaauauuucaugcuuguugcauuaaacaagacauggcuuaccugcuaaauguauuaauauguguucuaggaacaaaagcccucugcacauuuaaaaguaguaauaggauauuuucccaaagagaaagguauauucucugcuuuauccucuuaggaguucucugccucuuacucuaaaauuugggucuugaaaagcuauuccuagccauuugguuuagcuugugguacuggaacacccucucauuuguuugccagggaaaacaaucaauggaaacuuggauuaauacaggucagccuggaagcaggcccugucugacugauggcuccagaggcuggagggagugguaccuuugaauggagaaaagauccuucuuccuagguugaccagaucuucauaccugcugaguuuccaguuucacucaguaucugcccugaguacuugucccucucuguuauccugagaaaugcccagggcauuugggaagcuggcucucugguuuguuuuguugacuucuguuugugggagucuaguggaagugaguuaugugggugauuaagaaugugauucccuugggucaugucuuugucuuuuuccgggacugggccuaggugaaguaucuuaagcugaacugggguugccaagacaguucaauaucccuuggcugcccaguucuucccuagagauacacucuucuuccuaauccaguacuucccaucucuuuuucauauaaaggcacucauagaaaauggcaguguuuacauggcacacuguggaagugagaggcugccuaugauggaggaccuguaauugaccuauaauuaaccucuccacagcacaagaaaaccuuucaggucuccuucccaauaucacuacauacccaggggccugcuaccucuugccucaggccacuuuuuacucauucauagugcagauaagggagggagaagauaagccacacuuguccagaggaugagauggcauguguggagugagcaggacaggccucuugcacagccucucuucccaccgagaaguaggcccuuugaggcuuuguguugagcaguuacagcagguuggcggcagcucccugucagugguuguuugaauaagagggugguagauccuguggggaacauuucuaaccccauuuccugugcccaaauccaaauccaaacuuguuauuaauaacaaugagauuacaacaacccuaguucaguuuaauauuaauaauguguaauaacgaguuuggauuuggauuuggcacaguucccugugcccaagaaguauacaccuuacauccggcaaugguaaaugucuggagcccagcaggugcccucuucuaacagcccuacuccaaggagcaacagggaugacacuccugucacugcaccagugcugugcgugggcuugaucugaugcuguccguguugccccugcugguaguagggacuucugaucauuacugccugggaucccagucauaguggaggauaacacauggcuuucuucuuuucagcaauggacaaccugcaggagagagcucugcacauccggaaaguccuccuaguccugcccaaaaccacucugauuaucaugagauaccucuuugccuuccucaaucagugaguagccuucccagugaacagcuggaucaggcuuuggcuugggcacuggaaguuccucuauggaccuaugccuauucauccaucccaacaaaauauuuauugagcaccuacugugugcuagccacagugcuagacuuauuuaauacaucguuaaauaaaagaugaaagccuugauauaauuuagcuccuguuccagggaaggaaacagccaauaacagauauaucagguagaauaagugcuuagaagaaaaauaaaaaagaguaaagagaggggaaagaguaaaggggucugaaugaaaggagggagaagcacuguaguugagguggacagcagaggccugccugagaagacaguguacaagcagcagcccagaggaggagaaaagagugccacggggccauuuaaaaccccagagucaugguaauagcgaguuuggauuuggauuugggaagcaauuagaagauuuucuuuuuuuuuuuuugagacggagucuugcucugucuccaggcuggaguacaguggagcgaucuuggcuuacugcaaccucugccuccuagguucaagcgauucuccugccucagccuccugaguagcugggacccaggcgcaugccaccacgcccagcuaauuuuuguauuuuuaguagacaugggguuucaccacguuggccaagauggucaccaucucuugaccucgugaugugcccaccucagccucccaaagugcugggauuacaggcgugagccaccgcacccggcauguuacuaucugauuuguguauuuuauuuuuuuaaaaacugccaacugcuuuguggagaaguuacuggaaagggucaugaagagaaacagggagacccuaucccaagguuaccaucuggucuggccagagguguuaguggcugagucuggagagcggugaggaggggucagguuugugauacauuuugaacauagcauuaacaggauuugcccauggauuauacauagaauauggagagagaaaucuuaaauuguuggcaugagcgacagggacauaggguggucauuuauggaguuggagaagacaagguguggagaaaggaaucaagacaauguguugauguggucauggucauuugaggcacuugugagauguccaaguggagauuuugaacaauuggaccuaggaauccaacccuuaagggagaaaccaggaguggagcugccagugcaggaguugcccauguacuggugguauuuagcuaaucacccagggaacggaugugucuacaacaaaggucugaggagcagagggggccgcggguguggauggggcauuucuucucguccaagcagcauguccuuguguggagcaagcuuuggaguccccacaugacaggaaaggcaccaagcaaggacaugugauucuuccccucugaggcaccucugucuuuucacuuugguuuugcugcaguuucgcccucaacagccuagaccaaagguuauaaaugggcacccugagagccagauaaagccgaagauguguucucuucaggugucuauugugucuugagaacaaugaaaucauacuuacauuuggggaaauuucacuuuuuaaaaaccuagauuucuagcuucuuuugaaaaauuauuagaucuggugauacugacucugcagucccugguggcagcaauucccuguggaguaagggcuguacucccuagauggggcaggcacuccccaauucaccacaguccccagcccuccccguugucccccaauccugaggcugaauucaguugcuauuuaucaucacucuuguuuugugguuuucauagagaacaaaaauguuucucuggauccaugaaucuaucagaguaggggaaacaaaagguaaaccaagggacccagguguuuuugcacauauuucuuugugaaaaugaggagccuucuacaagguuagucucugcuuaaaaggaauacaacuuuagagaccauuucauaagugucagcuugcuuccaaguuuguggucaaccuggccuuauagguaucuggguuaguggccccagcuugagaccuuuucuggggcacccacacuaucauguagcccccuugcuggcccuucagagcuacagaggguccuuguuccccaucuugucucuuccaugcgguugugucugcucuauucauuggccaggcccugacucagcaccaccacugccuuuggguugaacaccccagugagucacacagcguguucaugugcagccuggaaacucugcuaauuacucucgaguuagucccuucagggcuaccagucauugucuccccucagagaccaauaccugcccucaacaugagccucgucugugcccccagagcugggagcaugacaguggugagcaaauggggaugaggggaaaacagggagggcugggggacuauaugugacaguacaguggggagaaacaauagaauaagcauccaugcaggguugcugcuugcagagauggcagccacuauugaagacagcauaggaauugcaccaauucaaauuauucauuuuguuuugcuuuuauuggguuuuuuucugauugaaacgagauugauuugcucaucaaaguguuaacauuaaaaaaaugcagcauuaauaaaguguuuucuaaaauaauaaauagaaugcaggacacaaaugauaaagcagaccaccuccacaggaagacagcagcugacaggugugcacuuccggacagggguagcaauaguuggcagguagcucccgaugcagacucugccugggcccagaccaucaggacccuuuuucuucauugcugugaguccuggauguauguguacuuuauuucuggcuacuguuuguucuuggauuggacacauugucaaucucaaggaaccaaaaaagcuaauaucucaguuucugugggucuggaauccaaguacagcuuagcaggggcccucuggagagguaauugcauaucauuaaaaaguuaaaaauccagaaaagugcaugcuaaaaaguaaguuucccaacaccaauccuggcgccccaaaaagccucuguuccuaaccacaaugcugaaccuuuuuaugaagcacaaaagaugaguucaaaucaguuaggagaauucacuaauaauaugaacugaaacuguagaaauacaguagaacucuuugaggacauggcaugagugacuacaagucgacaccaaaaauuuuaaagcagagaguuguuacuaauguuauccauuuuagguauuucuuuguuuuuauuuuguuguuguuuguuuguuuuuguuuguuuguuuuugagauggaguuuugcucuugucccccaagcuggagugcaauggcacaaucucugcuuacggcaaccucugccucccagguucaagcgauucuccugccucagucucccgaguagcugggauuacaggugcauaccuccacgccagacuaauuuuuuuguauuuguaguagagacaggguuucaccauguuggccaagcuggucucaaacuccugaccucaggugauccacccaccucgaccucacaaagugcugggauuacaggcaugagccuguaauuacaccgcgccuggccuagauauuucuuuaaaaauaaaaauccaguuuuuuauacucuuacacuagacacagccuucagggacuucaaagauuauuaacaccaugacauuuuacacaaaacugugugcauuuauaugcgcacauaugugaauuuuucuggggagagaaucccuaguuuuugucaaguuauugaaggaacuuguguccccuaaauaguuaagaaccacugcuuuaggacaggcgcaguagcucacaccuguaaucccagcacguuggguggccaaggcggguggaucaccugaggucaggaguuugagaccagccuggccaacauggcgaaacccucucucuacuaaaaauauaaaaauuagccaggcgugguggugcacgccuguggucccagcuacuugggaggcugaggcaggagaaucacuugaacccaggaggcagaggccucagugagccaagauuguaccacuguaacccagacaggcgacuccgucucaaaaaaaaaaaaaagaaccacugcuucagccccuaaacuuagauguucccacuguauauuggaaaagaaaaauggauuuucaucuguauuuugaugggagcaagaaaauagaccuagaaucaugagaccacaguccacaaagauguguccucuucaagcuccuggucauuguagccaccuaugaauugaacaguucuuaccuuagcaggcuucccaacauucuucaucuuccacagagcuuugacucaggacucucaggacuagaguuuguuucccuuugaccaucaggcuucccagacacuacugguuuucuuuuauguuaccaaaacauugucagaucacucuaaaguaucaaggccuuccuccucuuugucccuccaugacaccaggaacuggccagccuuggauuagcuacagcuuaagccugcagcaccucaugccucaguuguuugcucugagguuaccaagguaauuauccuccugucccuccccaguuuuaauuugacuaggaaguagacuuagaaacuuccccuagucuuuucuaaaucucugcucucuuugaacucaggauccggggaaggauuauacacuuuuaagaacuccugugaagcaauccaaugagauuuguaaccucccccguugcuggccucuccugcauuugauuccaggcucuagagaacagugauucucaacucuuuucucccaucacguccauaauaccacucuucaaguccugcagugauucgcaaacagacaggggguacaucuccaggaggggagagaaccacugagucagaggguaaugggcuuuguaaugugaggcuggaugagggguacacuacagaaacaaacucugcaaucaguucugaagaacagcuacucagauggagacagcugagucucaggccucguuucccaacagaggaccuuugguuccuucucagaaucaaauccugcccaugccuauaagggagacuccucagcagagcucacagcucugcaggcuguguuggggagguauccagagcuggcccagcccucaaugccuggacgggcaaggcccaaugggacucaucaggugcaguggcucauugaaggccuuggguccuuggccaagguuggagguguggcuggaacagcugcuggcugagaaggggagaguucccagaauaaauaaauacccgagaaugaagucagccugcauccagaggaagcccgagcagaagccaaauggcaugcugaccuuuuccugaaaaaauccugaauguaauaauauagaaggagauuaugaacacgaaaaacaauugcauuugcuguucuaggaagaaauucacuggcuugauggaauacaaaagcuaaucaguuggcuauuuguuaauaagucuagaggcuagaaaggaauaucccuaauaauuugauuauuuuguuaugcaagaagguacacaaugcacagugccugugccucugaccauaucuuuaccagggcagccugaggguccccgucugcccuggcagcuuaguauguugguguguagcagccauauucagcucugcagagugacauguucucaaggucauguggccuuugauagauaagauccggggauagggaugaggauggggugguaaguagaauuugaaaugggagcuggaaagagagaagggaucagagcugcaagcaaguaccucuaguuugcauuuccugagcuccugaaugaccauucugguugucaguuuucuccccagcuuacuuucuggaaagucucugacacccagaaaggcagguggcaauuuguggaccuucugcuuuugcucuuggcagcgccuccugugauuguguuuucugggcauucaugcgagagcuuuccagcuugcccccuuucccuucuccuccaguuuaucacaguucagugaagagaacaugauggaccccuacaaccucgccaucugcuucgggcccucgcuaaugucagugccagagggccacgaccagguguccugccaagcccacgugaaugagcugaucaaaaccaucaucauccagcaugagaacaucuucccaagccccagggagcuggagggcccugucuacagcagaggaggaagcauggaggauuacugguaggggggcuugggacgggaggaggggagggauucacuagcacacacuggcaugggagccagauggccacacgaaaaccaaagggaaacacccagauccucccaacuccucacucccaggcugcuagggucuggggaugcuauaggcagcccccaccucggccccacccacagacuaaaugccacuucuugccaccucccuuuuugaugaguucugaguggcaagggacuauucugaaagauauugacaacauuaauugugauacuaaucucuaagaaaggacuuuuuauaaaguugcaucuagaagugaucuuuauucaucaacagugucucuugggcuucuacucugugcucuguauucugagaaaaaccauccugggucccagggaauucccuuccuuuugggaagaguuuagauaaaaggcauaauuuccugaccgugaguuuguaagcuggcacuucagaaugauuuuagaaauuugugaagagaaagaaggguaagccuuguuuuuggcagguuagggacaguccuccccugaagcagcauuccauucuguggggccagguuuuccaugaccuagcuucggaacagagaucuaaaaggaaucccugggauauauguuugcuagaccccucuguuugacaaagaacaaaucacuauuucuauuuuauggaugaaguagcugcaacccagaaaggccagugacaguauuuuaggccacucuagugaugggaauuuaaccccaaucucaucucuuuguacaggguacaguccguuaccccaugccacccgccaugguaccauuuacagcgucguuuuuucacuaaacacaaagacaacugccucucucuuuuaaucccuaacgucccuuaccucccccuccuccucccccucccuucuuccccuaaauaguauuucagccugagcugaaagcacaagccagcccaaaucggauucugucugaauucaacaucuggaaccaauucggccagccccauugcuaucgacugagguaggggaggacaggggagguuguuuacuuaauuagaggccaauugguccacgcuucucccugacccccacagaacagccucuugcccaaggagugaagaaaguggcauuuguguucugugaacuuaguaauaccagugacaucccuggguucaucccucucugcuguacugcagauuucagugucuggguccaagcuggaggaaccuaugcuggccagcugggagagaaagcuuuuugucaccgacagaugguugguggugacuggggagguuguuggucacuuuaggucucagccuacuggaugaugagcuccagggagcuguccuugugcaugugacuuagagcuuugguuuucccccuugcaugaguggugaaaagcuguagaauagcauucccuuccuucuaaagucaggcagaaccuccgcccucacuucucaaacaucaaaccacugcaggcucugguccagugcccggggcacagagaccccuacagcccuggccccugagucccagcccagugggucagaguccuggagggguguggcucacggggacaggugccuuccuccaguuuccuccaagauauucucccaaccuacccccuguuucuugugcacucaacauuuauuagcagccucuggaaaaaccacaagauuagucagggaacauuacuaccgcagacugugugggaggcuagaagcaccugaggaacaagagucagcaaccuuggguugagagggaccuucuaaccgcuggauucacacccaccuggaaggcucauggccucuccucucccuucuuugggaagugagagaagugccagccccgggagcuaaggcaguaaggaggugagugagggugguagaaggggagauagagcacuaagaagagaauggagaaugaucaggagacccaaacagccauggaaaggagagcaccaggccacauggccuccccacagcuguggagaggagagacaaauccauuucaccacacuuuccaguccugaaacuggaaccgguuuucuaggacuaccggcuggguggcaugguggacugcuccugagaccucagguauuuuugggucuggugggugcacaagagcaaaggcuggggauggaguguguuucaagagaaucauaggauuuuagggcuagaagagaccucagaaagcauccucuugccuuucucauaaagcagugguuuucaaagugaggucccuggaccaacagcaucugugucacaaaggacugguuagaaaugcacguuauuuggcuccacccagacccagugacacaggaacucugaagauggggcgcuguuuuuuaacaagccuuccauggcucgcugaaguuuagaacuguugccuuacuggcuggcuguguaaauaaacuugaagcccugagggaaaguuugccuuugaaccucucccccgccacccccaccaucucaaagguuuccagaacauuacaaaauucaucagauucaucagaugguuuuuagcccuagaaaacagugagaaauugugccuacauuuuuugacaaagaggaaucuccguuuauauucuucuagaauguucucuggagccugggaaaccuccuuggaagugacuugcucuacacaggacgaguucugaacuggucacccagucuuugaggaacuucccaggaguguaggauccaucccauggggaaagaggcuugaggguuccaagguggaaacugugcggccaggcugccaggcugagugggugauggugcuuucacacaacugccuggaaagccucaccuguuacugccuacuaccagaggaagaacuuuagaaaugaacaguuucucuacuuuucaggaaguaagaacuuccuggugcccauccucaugaguucugaaguccaugagccaggagaucaggaauagaaaugacuuuccuaguaaccucucuaucauuucucgauuccuuacacuggaugauuuuuuuuuuuuuuuuuuuuuuuuuagacaggaucuugcucugucacccaggccagagugcaguggcacgaucauggcucacugcagccucgacuucccaggcuuaaccaauccucccaccucagccuccagaguagcuagaaccacagcaugcacacuggcuuuuuuuuuuuuuucuuuuuuuguagagacagggucucauuaaguugcccaggcuggucccaaacuccuagacucaaaugauccucccaaaguccugggauuacaggugugagccauugugccugaccuacccugaaugauuuuaaauuucaugaauuauuucaagaacuugacccagcuucucuccccugcccuccaacccauaauuggauccugcccuguagcccauagcagauuauuccuccccuacuuuuguuucccacccucuccuaugacucaccuuccacuuuuucaccaguucacagucugaacugcaaagcaaccuagaggcaucaagcaaaaugagaaagaaggaaagcaaguacuauuuauuaaacacccacucugugccaaacuugugacuaaauuacuuuauuaaauccucacacagcugaggauauagaucuuuaucuucaguauauagaugaggcagcugaggcuuaaggagauuaaauaacuugcccaggaucacacagcuaccaaguaucagagcugguuuucgaauccaguuuuaucugaugccgaaacccaguguuucccuuccacccugcuuccccuuugaaaaccaggaaugaauucacauagagaaucagaccuugaggaguugaguuguucucuauuuucuaaagaauuuaguuuauaccuucaaaagggcuucccuuugucuugagauauucuaaguuccaaguagucucaagugguuuuuguagcaggagcuagacuggaaaaacucuagagcuuuguauuucauuauaagcauuugucuauugugugcaguuaggauauagagagcauaagauggauucagugcccucgcgccagggaggcuguaugaaggggaagacaagaauuguaugagcacauguuaaugucccugucacucuugcuucuguugcagugauagcccucauggagagacuaccucgguugaagacucaacccaggaugugaccgcagagcaccacacgagcgaugacgguacgaggcccugcuuccuggucaguggggacgccaggggugaggcagaaggaagcgauuauauauccugugcaucugaugaaccugucugcccagcgguccccugagggcaggcagagagcucccugucucaauuucauuuccuuccuuccuuggagagguagcccaccuucucaaauagaaucgcucguauuaaaccagaggugaggaacuaggccuuucauagcccuucaaccuucuugcuccaccucccagcuccuugucuggccugagugcagcaugauguuggucccuuaucauagccuagacuccugccagacagcuggagaacaaagugaaggaaaguacauuugaaaaacaguaagcaauugggugugguggcucacaccuguaaucccagcacugggaggcccaggcgggaggaucacuugaguucaagaauucaagaccagccuaggcaacacagccagacccugucucuuaaaaaaaaaaaaaauagccuggcaugguggugugcagcaucccuguagugccagcuacuugggaggcugagguaggaagaucccuuaagcccaggaguucaaggcugcaacaagcuaugauuguacuacaguacuccagccugggugagagagugagacccugucuaaaaaaaaaaaaaaaaaaaaaaaaaguaagccuggggugggaaauagcagagcugguugcccggaacccaauagaagcaagccagagggagugggaaugaggaugcagaaaccacaugcuuucacgccuaccgacuggaaaaacugacccuuuccaaaguacagacaugcgagugccgagcagccuggugggcgugcaucaaggggaggaaugcucagcugucauccucaggccccucagcagugcccaugcuuuaugagggucuguccagccagcacauuucccccgcuuccaacagcuccacaccuccucuggaucacaugggcucuggaagucucagcagcugacaaggggccucagaauuuucugggcacaagaaugaaauggcaacagucuguggaguuuucccuguucccugccuugcugggaauucugcaauucuaggccagcuuucaaaggagaaaaaaaaaaaauaggacugcuuauuuagauccugaugucauaaggauccauaugaucauuugcuacauucgaggaggggaguaggugaacuaggaaaaugaguaguggguuagagccuaccucguggccagcucugcuagagucuuuauauauguuaucucuuaaucuguagugaaaaagauauggccgcuauuuuacaguugagaaaaugcaggucagggaggucgaguaacguacccgaggcuguagagaacuaacugagguggguauauuuagacaggccuucucugaccagccuccuauagugaaaucuccaaccccuccugugcaggagcagacccaccagcuagggccaucuaggcauggucuuauuuuuaagcagccuuucucucugcuucccagaauagccgacuuucaucucagguuccagcuuucugggagccuucucuuugcucuuugaucucuaccugcagccuagcacagacgaagauaaugauaacaauaagucgugcacacauaccacuuacuaugggcgggacacuguucuaagcacuuuuacaaauuguaauucauugacucuucauaacaacuucaugaaaaagacacgauuauuaaucuccauguuacagaugaggagacagaagcccacacaaaaauaaagauagauugcauucguagaccccuuuuacuuuuuuagauuacuuucaugugcauuuuuuucauagguuggucacaaaauauauuuucauauuuugcuccuuggaaaguugauugggcaaguuauuuucucuuuauagagagacagaaagcucacauucuacuuacuagggggaauggauaacauaaaauauuuagaauacauguauguauucuaaaaaauguaugauacauuuucuacaauuacuggaauuauuauauaauuagaaaagaaauaaugcuuaaaaauauaguauggcaaguuugaugauagacgucaaggcaugaagaucuuuggaaacaccaaagaaguuacuguagaaagcaggggaugcggucgggcgcguggcucacgccuguaaucccagcacuuugggaggccgaggcaggcagaucacgaggucaggagaucaagaccauccuggcuaacauggugaaaccccgucuauuaauaauacaaaaaauuagcugggcgugguggcacacgucuguagucccagcuacuugggaggcugaggcaggagaaucgcguaaacccgggaggcagagguugcagugagccaagaucgagccacugcacuccagccugagcgacagaguaagacuccaucccaaaaaaaaaaaaaaaaaaaaaaaaaaagggaugcuugaguuguguuuugaugugcuucaucaggcagauaagagagaagaagauuccugguggagggaacagugugagcaaaggcagguaaaaggugauaccagugcuuucaggauaaugguauagucugcgugagaauuacuugcuuuauagaucauccauggcuucguuuucccacuaaguaauuuccuaccacuguaaguucagcuaauucagcuuuuccacccaguuuccugagucugcaggucccaagaacauguguuuacuucuuuuccacccuucucagaaugugagcccaucgaggccauugccaaguuugacuacgugggccggacagcccgagagcuguccuuuaagaagggagcaucccugcugcuuuaccagcgggcuuccgacgacuggugggaaggccggcacaauggcaucgacggacucaucccccaucaguacaucgugguccaagacacguacguugggcccauggcaucuuugggggugguccccagcugcucuaugggaaugagacuucauuucuggagccauaggacuaugagggaggccaaccccucggggguccagugcaguccugaggcucacacaguuccuugaagagcagcccccccaccccccgccccacucccugcacucaguggagaauuuuuuuaaaucucuccacuaucugugcccccugcaaaucacccccuaauccagucauuuuagaaaccugccagccagccagcacucauccauauuuauaccugaugagugauaacaagggguuuuuauuugaccaccuauauuucuuuucucgaaagaucaggcugggaaaacauuuuuguuacucucuuuuuuuuuuaaacaacuaugcucaccccaaccuguugagccacucuuccacuugcaaauuaaaaugacugguuuucuaggagaaauccggcuuaagcagccuuauggaagugaccuaguucauuuaaccgagaugagguugauauaggguaagaugggggaaggagggaaaaggaugucaaggaacaaaggaaaccugaacuggucccagagagaucucaucugauaggcuguugguugauucucacacuuugaagcaguugucccgugggcccacccaagccugcccccuguccguuugcccugucucuguccccagcuccccucccuuggauacgaugcugucaguguuuuuaguccuucccuuaauauuauuuuuuaaagguugauauccugagugagucugcacccucccagccucuucccggcucguucugcagggaaauccucccucuguugauagcaucgcaaaccugguggcaaucugugcguggacaggacccucccaaauuuagcauuaugacuucaccacaggaucaagagaagaugaauugugggggagaaggggcuuucuuugucaucaguagccagaggggccaggagagcaguggagagaccugggaccggcuuggaugcucugagcggggcuagaggcgcuacgacaguguguggcgguguccugccacgacgccgccgucuccagagccaccacacaguugacuguccuuacccggcagugcucaggaccucagccgauaaaccacaaccuggacuugccgccuccuucuccaggaggccgccccagcacggccuccccaggaagcagcaugggguagaaggcagaugccucgaauccagguguccccuagccacgcuuuccugaggagcugaggagcccgcagaacucagcggauuauuuauuuuuauuuaaacgacccuucaaaggcccuuagguuuccuugccucugcucacagaacuaguccagccaggugucgcugcugccucagagcuguguggggucgcguguaugucggggggccaucuugccgauuuaacgcugcuuuuuguguuguuguuguuuucccuccucccugccugccugccccuucucccccagcgaggacggugucguggagagguccagccccaagucugagauugaggucauuucugagccaccugaagaaaaggugacagccagagcgggggccagcugucccagugggggucauguagccgauauuuaucuugcaaacaucaacaaguaagcucugcuuuucauuuucugcuccccugaaugacuugcaacacccagccucacccucuggccuaacccccaucuccauuccugugcugcacguagggcucccagcucccccagccuaacaguuugcauguggucauugcugcugcaaggcggacagggcugaggaugcugcuacaagccucggggcagguccaggucuccagcuagcugcccucgugcuguggaagggugcuuuacuguguguucccgcagugucuguccacccagaccuuuguggcagucuuacagcuaaaacuuugaccaaagcuuuggucacuuuaugcaaccugguuuuguacuguuucucagaggugccuucuuuuuuccaauccauacucaaauaauagucuuugaugucugucuuccuugacccguguucgugcaaagauucagagucuguguguggcuucuacuaggcugauguuacaccagguggguuuauugagauaucaugugucuguuccucccccuguccugcauucacuccuguggaggaaaggaggccacgaugucccuaaggaaagcuuuguccugagcucuucauucauuggcuaaccccuagcucccuuuucuucugcccuuucacaccaggagaaauaauuuuccauuuuguuccuauugcuuuggccuuuuguauuauucuacccccuuagucccuuugcagauccccacuccugcucagcaggcucuuaccucugacccccagcuuucauuguggcuguuagcaacauccugggguuuaaacuccacccacgcccgaucuggcugucuagagggauucuacgccugcgugcugccgccuccccaagaggcauucagguuauuggagaacuaaucucaucucaaggggccagacaccaagucccaaagccuacagaccucuuuccgccaggcccugaaaccuggccccgugccagcaggaugacaagccccagggcgcuccugaugaauauggauuggagaugauguacaguuuuuauuccccucuggcuuuugaggaaugaaaugauuugcacuuugaaaaccuguuaaccguagccucuggacacugagacuggaaggagaauaaaggaugcuuguuguuuuuaaacuauaccagguuucccagaucucuuggcuuuuuuccacccagacgguagcagggggagugguuggggcacguggcucuuuuccaucucuuucacccucaaguuaguaaagucguuuauucagaucacuuacucaguguaguuauaauuuaauucagaccaguuaaaaaaaaauugagaaguuucuguuucccuccagcacacugcccugcugggagggcaagccaauaucaaguaacugugggcuaaucacauuuuuuuccuuauuuacaauucuguguuaaauuguaacccuacaaucaaaaggucgugauccuauaauuaacucagaaaccaaggcgggguugguggaggaagaguuagauaauuaguuaaguacauauuuuuaagccaucauauauuugaugccauuugugcauagaaauuguagagaguaauaacugaaaugguaaacagaagaagaaaaaaaaagaguaucuguagacaguuaaggugguucccuugaacuccuuguuugcuggugucaggagucuugggaugggguucuuggaggacaagccucaucaccuggugggugggugagcgguggccccggggcaugucuggcccuuagaagugagucggccuuugagucuuaccuccugccccccacgccacuccuccucccaaauuccuugaguuucccgagugcccagguucucuuucgccccugggcgcucacgccugcugucuccucaccuggucaccuccucaucucccuucaagacucaguccgaagacuuagcucuuuggggaagccauucugacaucccugacuuccccaggcugagugaggugcccuuaugcugcauuccaaagacacuuugaauaccuuuugguacucacgcuucacucagaucccccaccagauugagcuccuugaacccaggaacuauaucuuccuuuucuuuacauccccagggccuagccugggacauggcacaccacagccaccccauaaaucugucuucucagcaguuucagcccaugagucagcuauccucaagcagaaaaaggaaaucagcaaagagcuauuaggguguggcacuuccauuuaauucuacacauuuauuaaguaucuacuguugugccaagcacugcugguguuuauucagagauaaaaaagacgaggucccugaucucagagcucacagucuggcaagguaaagacccuauggacagguaacugacagguagcaucagaugcucugaagguacagaggagggagggguccauucuuccugcaacuggaguuaguggugcaguggugccagugcaguuggaguuaguggugccagggaaauccuugcagagaggggguucauuucagcagggccuuagaagacucugagaacauccuuuuuccacucgagagcggcugagucacaagccuaaaacugccgaguggacagacucacggagugacugauacaugccagguccugggccaggcccugcaggcagaaagaugaggaagaccucagcagugaacaggacuaggacuggcuuagagcacuguccccaccucacagaccagcuccuuaucuucagagucuaaccccuucccuccuuccaccucaacuccugccucagcccccaucucucuuagauucaagaucagagcuguucagcagccauccaaaucagaaguuucauugccucuuagauuagaccuuuucagaucugauuccaagacaaaaugaaauuauccagcagcaggcaacacccauguaacugggauucugccaagccauuuugucugagagcccuaaguggucugaaacaaauucgcccagauccaggguucagcccagugcugggugacuugggagucauguagagguauuuccacacuaagaaaacgcacaaacugggccccaacucugcaguguugcugccucuugaaaacuauucugcuccaugccuacagaauaagcaacaacagccucuugccagagcccaaaacaguuacagucuguuuggaaaaagagucaugcuaaaauuuagaaaaguuaacuauccucuuaccagcaaucuugaccucuuuggugauggugagacuucuucuccuagcuggggccuuagguuucuguucauggcaggucacagaaggggccuuuccaugaaucucuuucccauuagaaaccuucgcuuaaucagacauuuuuucugacagcaacuuacaucuugacaacacaaagcccgugaccaccaaguaaguauccauuucuccuucacccagcuuggggguggcaagggaaugaagacauggagaaugcaagagaagaugaagccgaggagagaacgaguucugugucccucuccuuccgaagucccugggugccaacaucugcccccucccacuuauccuagcuuccuuggagccagggcucccugaucacacugcccuuucuguuugugauugaaggcaaaggaagcguccagaaucugggagcauccggaaaacuuuucggagugacagccaugggcugagcaguucccugacugacuccuccuccccaggggugggggcuagcugccgcccauccucccagcccaucaugagccagagccuccccaaagaagggccagauaaguguuccaucagugggcacgggagccucaacuccaucagccgccacucaucccugaagaaucggcuggauaguccacagauccggaagacugccacagcgggaaggucaaaaagcuucaauaaccaucggcccauggacccugaggucauugcucagguaacugugggcuccuggacagacagcaugagucuacauucaucacuaccacuuagugccacccaccuaauuaugacaggacuugaaacagaaugauuauuuuguaugugauauacugaguauauguccacucuggacauguggacccaauaagacagcuuaauaaguggucugccugucccucucuccccaggaagaaccuaaagacagaauaaaagaagccuagcuucuugcucauacacuggcuauuaggaaggcuguuguaauuuuuaaagccgguauuaagaguauuuugaaagcccaaguuuugagucuaaagaccuugguagacuuuagugaaacugcccgacuguugaggaucagguguaauccuggccacauguuuauauugcugugcccaucaccaucaucccgauuccuaaggcuagucucugguaccgaauggguagaugaucaauuaagaaccugcaccugguuuuaaagaccuaaaaaauacucuggcugcagagagcucugguaaccaaaaggauuugcagcccaagccuccagaggcuauggagaugagcucccugguugcagggucuuccuucuguguaugcaccgcacugaugacucucuguuuuccaugaaauauuagagauccaaccccaccucuaaaaauccgacuaccggggccacuccaagcaguucacucagacgucucucccaacuauauaauuuucauuagaccagguaggaacuaagggcuuauuguugccuucuuaucucaacugaguugagauucuccuuaccccaucuuccagggggugauagaggcugggcauggucucucuuggcuuaauugugguucucugcuuacggagauguaccuggcaagcccaguauugagcuacaggccugagaugucuugcuuugcuagccuucuauucugugccucuauuuaagcucuuggcugcaaucuaccuugcgcuacgggaauccucccagcucccuccuuggccagguguuaauaggaaugucaggaaagguagacagcugggacagacuagcuguagagugcgacugaggagggagauggaguucuuccugagcauuuuaaagguuugagaaugucauagggaugagugaaacugaaucacugugaacagaaagcaugcaucggucuguacgacaaagaaaccuuaaccaaaggccuucgcuuggaauguguaaaaucuuuccaugugaaccuaaucccaagaagaaauccugugguaguuugggggugccagacacagguuuauggggagggagcggggagcugggaagucucacuggaaggcagcuggcuugcauacaaagguucuuugguucugccuugagucccugggcuaggacugcuguuggcuaaagaucuagaguguuccauugauuugcaggcaauugauucaccuaugugggcuuuggcuccccuuccuggucauucuuugguccccuugguggugauggcuggaaggaaaugguuucaaauuggacacugcccugaguuggggaggaggggcggggggaggcguauugggcuccugaaacuuuccucagccccugaggaggaaggacuaacccucuucaccuuuggccuugaaguccaagagaauaaagaucauacaucaucucuaccacuuuuuaaaaaaguguuuauuauguacaauuucaaaccuacccaaaagcagacagaacuggauaacaaauccccauguacucaucaccaaacuccuggccauucuuacuuuguccguguuucucuuccccacuagauuauaugucacuucgucgauaaguauuucaauaucuaucucuaaaaccuagggucucuaaaaaaauaucaauuacuuuuucuaaaggaaaaaaaaaaucucaugacagugaaaaucccuccgucccccuuucccuacuuccugagcauucauauguucaaagauuuaggccaaguacaauaaucuggacaucuuacggucauuuucuucaugccuuggccuguguuguugaaaccggcuccuuggggaauucuccccucauuugccucaccuccuccuuuuuccuguuuugcaggauauugaggcaacaaugaacucggcccugaaugagcuacgggaacuagaacggcagagcagugucaaacacaccccugacgugguucuggacaccuuggagccccucaaaaccuccccagugguggcccccacgucagagcccuccagcccucugcacacccagcuccucaaggaccccgagcccgccuuccagcgcagcgccaguacugcuggggacaucgccugcgccuuccggccugucaagucugucaagauggcugccccggucaaaccaccagccacacggcccaagcccacugucuuccccaaaacaaaugccacuagcccuggugucaacucaucaacuuccccacagucuacugacaagucuuguacugucugagggauaauaauuuaauuguucuagacaaggggacuauagggacugacuguuauuaaaaucuuccuauuuaacuagcuuggggacuucaguugaaaauuagguucuaaguuguucuugcaggaauuagccuccccgucucccaaaaccuugagaaugaagcccuugguaucgccucucccuucccacugcccucugcuucccccagucgucguaauucagccagcugcaguccguaccguucuuagguuagccagagacagguuuucauuaucaggucacugugaaaucugguaaggcaguccugaggacaugggcucaagucucaguccccucagaccacggugaugccuugaccagaugguuggcuacugccauccagcuuucaguggcaucuuguuuugggaacugauuauagagaaucauauauaguccagucuucauuuuacauacacacacauauuuuacacacacacacauuuuacacacacacacacacacacacacauauguuuuucuagucucuggcauguguagccucuccuggucauagaccagucucuuuguaaguuauuguggcaguucacacaguagccaccaggggucucuguuuccauuacaaacuuuguucugucugggccagagaaccuagccuuugaaaucucuccaucauaugaaacauaacgggaugggacaaucccguaaccuguuugggguugggggcuuucucucuguguucuuuccauugaugugaauuggucauugguguuugcucuugccucuccuccauccccuagaaguacacccccgucuuauuaaggagcuuuuaaaguuuuucugaauguauagacauuucucggguuccuaccuuugucucugauggaccauuuuccauuuaagacauuuuccuguauaagacaguuuuauagcugguuccuuuuaggguaaagagucuuaagagaguuuuauugugucuauggcagguuugggaaagguaagaaauggguccuuuuuccuccuaauguuuuuggcacuuaaaacauaaaauucauuauccuauuaaaaaauuaaauucagcuuugcuaauccagaaauuguucccaaaugaaaacuuguuuuaaguccaccccuuaguuuccuuauuuuacaaggucucucuucagggaccaacaggggcuuagagagccuuaguuagauuaaagggagacccuaccucuuaaaaccaguuuucauuuaugcaaacaaggacaauuaagggaacccugaccccacaggcucucaagucuucccaaggccagaaucgaaagaaaauuaaaauuugaaugcugaauauucuggcucuacucuggccuuuuuucugguucccuuccaaaaugcacaaaucauacccuugucugcuccaauucagucuccaaaccuggugccugugcuccuggccccccuagcaucaugcuaucccaggaguaucaggaccagacacauccacagccaggcucaugggucucagacagcaacuugaguuaaagcugaaacucauccuucuucucuguguuuucugguuuaaaagcugcacuuauauuuuagccuuauuauuuucuguaguuccggagagaugguggguugccauucugguaggaaaaucugaguuuucuuaucuuugaccuagaagagauucuuuuuggaccaaccugcgaaauugguaguuaggucuauggaaagugguaggauuuuuuuuuuuuaauccugugcaaaggaaaagaggugcuuugugggaaaucacuaaugagaaggcuaaccugcagcaccagagaaaccuuuccaagugcuaggcaggagaacugaagaacucuuucagugaagugagucagccuagaagaggcaacccacagucuugauuuuuguugcuguuuccugaccuguucuugccugucaccugggccuacacaggucccgagccaacggggcuuucauacccaaggaucuguuuccuugcugaaaaugaaacccuaucuuucacuuuacauuccuuucaauccaacugaucaaaacugguacccacacuugcccuuucucccucucuccagcacacuccccucuaagaaaguaaaagcaaagcuuucuuaauggcaacacuuugggccuguucuguugcuccugccuuauuucucuuucaacccuguacaugacucguguucaccauccccuugaucaguguccauccgcgcuaauuugcaucaugaacugaacagugugugaguggucaccuacuaaacccagcucugggggcagagcugucuuccccaucucuggugcuccuaacaccugugagaugguccugucgagaggacuaggaaccgauaggaggagaguccuucucggcagagcucacugcaaacaacuggaauugagguugcacacugugauuuuuacaccgaaaagccaaaaggagcuggccauccagggccuagggagaccagccuuccucagcuaugcuugccgaaaccagcaugaugcuucaaagagcccugcuccaccccucauggcauggauccuuuuccugguguggacucugaagggucagucuucggggaagagaggugggguggggcuacuagcaucccaauuuagaaaacagaggaguuuguagccagcagccuguaaacuggaaacacuggucucagccaaccuccucagggcgcccuggcuucuccccaaggagaugaggagcggugaugccagcaccgggaugcgcagagcacuggaagggcuggugcagaucuacuucccaugcagaagagaagucacaucuuccagggaaucgcaauguuguggcgucugacuuguaugucacauuuguguaaaaugguauauucuuuaaaauaguguugauaacuggaauauuguauguaugcuuggagaugcuuugugugaaccuaagacugucacucaacagauguuggauuggggaaaauccaaagcacaacuucaaaauaaaauacauuuuuagguuucgaugcugcaguucauaucccuucucuccucucugaaaucucugauucaggacuccagcugcccaggagggauuuugauucgucugugcuaacagagcccugccuggcaacagagagagcaacgagaugaccuuacagccagccaccuucucccuccccaccaaggcacagcacacuugcauuuagaaugggcgguuuuucccccagcauuuccauuuagccuguguguggauucucauagguuuuguagagagucuucccgcucaccauuggacugccuguugccaugagaaccguuuccuucacagaauccaccuuccuuguuuucaauaaggacuguucucauuucuaucucuagucagauuuccucacuucagggaguggggccuaagaaguugcuuagaaacuuggcaagcuacaaccaagggugacuagagauucucuuucuuccacaaccaaagcccugagucauucugcccuugacagcccucugccucugggagaaaagcugaccaauaugcuugugcuguuggugggagugggggauacaggugauguuuucucuccuacagauugugagucuagcagagcuuaaguucaagggugaaguuauuucaagguaacaacuucaaacaaauccuagagccccuagggccaacacuuauuuuuaacaggcuuguucuaauaaaagaugccccuggggauggaucacaucucuccaaguggguacccuauguucagugguaaugcaaggaauccuacccccagcucuagacagaacacuuuacaaccccuucuuagguuuaucaucccuauccguuauucauauaucuucuauucagcucugcuaugcccuuccagccuacugucucuucccuuccccuguuuucauggaacagcuacaucuugagcuucucuugcugggcccuuggccuuggguaagucaaggccaaggcugcugugccacucugugguaggaaugaguucucccugacugcagggagaauggggauggccaggagcaccccauaauagcugcgacauggagccaguuuguaggcugugagcaggggaccaaagagccccuuuucagaggguccugaggcaaaggcaggcuaugcuuuuuagguccucuuuauccauauaugguucuuuuuaucucauauguccugaugggggcuggauggaaacuaguggcaaugaacacugucaaaacacaaguccauuccuuccagauagaaaccaaaaauggagaccagauguaugugaauuuaggaaacagucuuuuaagacuaucuaaccuaaauguuuauaucaaacuuguccaacccgcagcccaggauggcuuugaauguggcccaacacaaauucauaaacuuucuuaaaauauugaguuuuuuugcaauuuuuuuuuaguucaucagcuaucauuaguguuaguguauuuuauguguggcccaagacaauucuuccaauguggcccagagaagccaaaagauuggaauccccugauuuauauucauagguauaugacguuuccuuuuacucaggaguuagcaaccuuggcauauuauauauacuaaagacagucauuuagucaaucaacauuaagcuucucucuguacaagcacugucauaugguacugaacagaaaaaaaaacagcuaauggagcuuucuaaugaggaaggacagauaaagaagcaaaaugaguauuacccugaaaaugaaacuaauaagauaggaguuguucaggaaaugaaguauucugcuugaucuggcaaggcugauaugacugguagacaucuaaguggaaauaucagguagacccuuggauguaugaauuuggaguucuggggguagauaauaccugaaaacguauuaggagcuauuacauuauagauguauucaaacagagauucccaggaagagcguggagauggaaaaaagagaaggucccgaucauuagaaaugcagcagagggggagggcgcaguggcucacaccuauaauccagcacuuugggaguccaaggcgguggaucaccugaggucgagaauucgguaccagccugaccaacauggagaaaccccgccucuacuaaaaauacaaaaaaaaaaaaaaaguaucugggcgugguggcacaugcauguaaucccagcuacucaggagguugaggcaggagaaucgcuugaacucgggagguggagguugcagugagccaagaucacgccauugccccccagccugggcaacaagagugaaacugucucaaaaaaaagaaagaaaagaaaaaaaaaaagaaaugcaucagaggaagggggccagcaaagaaggcagaaugagcaaguggcaaugagguagauggcugggaaagcacagggucacagacagcaggagaggacaaugcuucaacaaagcagggaaucugcuguugaaugccaaugggguaaggugaggguggcauagaaagggaaucauuggacaagagcauuuucagcagagggggaaugaguccaacuggaguggguuagguggcaaaugggaagggaagaggcaguaacuugacaacucguugaauggggagcaucgagagacaaggguaagaugggcagugcagaggugcauuuguugguggggugggcaggaugcaguagaacgggaagaaugaaugugcaggagaggagagggugagcugcaggguacaagcgggaggguuggccauggccacuagaagaggcucaagaagaggcacuuccugcugucgcgugggagggaaggcaggugaguacagacacagggcaggcaguggaugugggggaggaaaugagggggcucccuucugauugcuucuuuuaucuaagcgaaguuuaaggcaagguccuuagcugacaguguaggagggaacagugcagaggagguuugaagagugaagacaaugagagaaacacuugcuuuuccucgaagagagacgacgcuggcaccggcgccgauuuccuucaguggccuggaugcugccucacagcuugucccacugcuuggggccauagcagcaagauuggcugcaguguuugucccuccuucugcacccaaagcuccuagccagagcugaccccugaaggugacaaagagcugggcucugagaccucgucccucagcccuuugcccuugugacugagcacagcaaauacguauggccuggcaaugccccccagccucuuccauaugcaccccaaccagcacccgaguccuuuccccuccccuuuaaggcacugggccggcgagucaguugugaaaaacuggcucaggccccuuagagguggaaaaagaaauuaauaucuuuucagagcagaccaggugccaggagcuucaucucauuuuacuuucaaaccagcccuaugagaaacgucgagugacgugcuagggucauccacaguaggugguaaaaucugaacucaaaccuccauggcaauggagcuagccccugcccuucuuacuauacuuucagccucuuuguagaagucacaugagauuuucuuucugacagcugcugucaagggccgcccucuuccaccucugguccuugcacuacccuuggauugccacuucuauuucuaggacuccucagagccacuugggaacacgugguggggacucuuacagacuuccucuucccuucuggagcccgccagcccccugcaccuucucggaugcaaccggcugugcugcccggcuggggcacaggcaagacauugcuucacuguguccacacagaggaugugaccucacagaggaugcgcaaggaaacuugaucugucacggcacauggcuccaggccaccucuaccucucucccuuuucacagccucaguccggcucuucucaugcuucugugccucugcacaugugcccacagccuggaauuccauucccccagcccccucuccucugcccaacuccccuuuuccuaaagucuggccaagcaacccuucuggaaagcccuucuugaucaccuuccuccccgcugcgcgucugccacucauagcaucugccaugccauccuggaccuccaggcuccugaugggaugcccaccuuuacauccugagcacacagugccugccucauagcaggugcuagacacaugguaguuuccuuugaaugugcuaaauaugcugggaaagagauugacggagagaggaaaguaagagugcuggugaggacccagcagguucaucagggaaaaaaguggguaaacauuacggauugucuaaguuauguagcaaaccucggugcccuaaagcaacaaaggcugauuucucaccaaagccaaugucccuuguggaccagcaggggaacucugcucaggacagucacucaaggacccagacuaacagaaucacacugccagaaagcagaguucugggagggucuugcaucaggaaauaaaugcuuugguggggaacucacaugcucccccuaucacaaaguaacuaggaugugcaguucucccaugugccaggcaggcagaaaccugggaagacuaggcugggugcaguggcucacgccuguaaucccggcacuuugggagacugaggcagguggaucaggagguugggagaucuagaccaaccugcucaauccaccucaccaaccacacagugaaaccccaucucuacuaaaaauacaaaaaauuagccacuggcucacgccuguaaucccggcacuuugggaggcugaggcagguggaucaggagguugggagaucaaguccaaccuguucaauccaccucaccaaccacacagugaaaccccaucucuacuaaaaauacaaaaaguuagccgggcaugguggugcaugccuguagucccagauacuugggaggcugaggcagaagaaucacuugaacccaggagguggagguugcagugagcuaacaucaugccacugcacuccagccugggugacagagugagacuccaucucaaaaaaaaaaagcaagcugggaagacuggguggaacaugaggaucucaggcacucaggcacauuccuccugguccugaugugagaaguugcagcaacuccuccagcuggagguguuauggggaguucucuuuaucugagcacuaggcaguucucagcucugcuccuguucuagugucacugugggagggguggggcuggcggaggaaaccaccagguguggccaugggaaagucccuccaacauucuauagaaacauggaauuuccugguuuuaaccauuucauauccaacugccaucucugagcugaccagagcaggacagaccccuccagccuccuaggacauuugauguggggcaucgaguccuggcugggaaguuggcaccugggugccagccccagcagucucugaagagcauggguaaauuacugaagugugugggccuccaugccuucaaugccuuucuguaaaaugcuuuccaagcucccaaacaauuccaaauauauccaugucauccaaucaacccacagaguagcuguuacucugcgggugagugagcuggcugggaggggcugcaugcugugugcucaggucacacuggaaggcaucagcuggguccccgcgcuugcucucggaccucugcaggccuccugggaaggugacucagauccaacuucuaggacuggaucggcauagcucccacacuuccuugggguuccugggugugggagcauggacuucccaggcagcuuuccacuuaguuaacuugcccaaccugcucuguugacucugggaagagcccugaacuucccugcuccagugaacugugggagaugccaaaacagcacccagcugcccaucaagauuaccagaagggccccaguuccuggcuucucuguggcucacacucugguccuauugccuacccuugggaacucagagcauccucuuucucuuuucugcugagcugguggcugcaccgaguugccucugucucuuuaagagagaaagagagagcgagagacggaaaucaggaagugcgagagagcugagagccaggacucagugcugagcuuggugucccaccgccacaaggaggcagggaagaaacccacuagucccagcuccugggguggcacagacauugcaacuggcccugccuguggguccuaggggcccuuggcuaccaggaggcuaagaacacugcucaugaaugacagugagcccugaaagcucugggggugucacccagucccacaagccugcauccccugcaguggagauggggugagugugcagcgugcggagggggguggggguggaaugaggggccagacaaggggcagcugcagggcagcucagccgggugcaggggugugggcuuguuggcagcggugcucucacauagagcguuguguguggcauggaggugagccaccacgggccaaccacaagcccucccugggcucugcuuaccaacacccaaagccagcgaucagcacccagcgccugcccucaccuuucccggggucuuucucccuggccggagucucaggaguaggagacgcugggaaaggcucccugaacaguuugggaauagagcuggaaacccccagcccagcccugugggggaaggugacaaacaggaaaggguuaaagggcuagggccggcggccuuugauggaggcugagaagcaacugcacugaggggcgccucucauccgcccuccucuuuccgguguagcucagcuccuggacgugccacagacagaaagcauaacauacacucgccaggaagagccuuugccugacucagggcagcucagagugugggguaagugcacuuggccacagcagagcccugaggagggaggggaggggagagguggguggguggugucucacaugcuucacuguccacugcucauucauccaaccacuggcugagggccacugagcccuucuuugcaccaggugcuuggggugguggggggaggaucugcagagcgugcagaguuaagccagaugugccacaaccagagcucccgggcacagaauccaggggcacaccgcuugucugggggucugcgcuuugcaccucacugccuauuaucccagaguccugagcuguuccuugccccaguaucagagcccuuggccuugauuucagccugcugugcuccaaccccagccccagcccccagaccugcuggcugccuccagccucagcggggaaaaccagacccacucauucaugcugagcuacuguguugucuucaggaagccucucaguaccucaguugcuucuguguaauguccgcuccuaccugaucugaaacuaggaguugaccaccgaucucuucaaggggccucuggcucaaugaaaugacauuaucaaggauuugcauuuuuaaaaaagauuacacagagaaaaaguucagagcgaaggaacauaggauuccaggcauggcaacccucaguuugagaaccuguaagauguuagaacacgaagaugccuuuucuagucuagcguuauuuaaaaguauuuaaguggccaggcaugguggcucacaccuguaaucccagcaauuuuuuggggaagcccauguggccggauugccugagcucaggaguucaagaccagccugggcaacauggcaaaaacccaucucuacuaaaaauacaaaagacagccaggugugguggugcacaccuaugguccuaagcuccucaggaggcugaguugggaggauugcuugagcccaggggguggagguugcagugagucaugauuguaccacugcaccccagccuggaugacagagugagaccuuacgucaaaauaaaaaaaagaaaaaggaaaaagaaaguauuuaaaggaugguggcccuucuaaugcuucuguccccagguaucccaaaaaggccagcacuggccuuauuuuucaaagagaaauugaguuuaacuucugaggauacacuuucugguacuaauugcuuuaggagaacuaggcuuuggggaaaagaugaggacaaagaugggaaacagaguuguaggggguuucagauucucccaauggcugaaugaugaauuuugccuccccuauacccugcucucacacacacacccacacccuucuccccaacgcccuacacacauacacacacacacacucucacacacacacacacacacacacacucugaagcagccccaucucucuuggagcaguacuggcccggcugucagcucacagcagcaggaaguggugggccuggcaggcaggccagcgggggcugggggaguggcucuggacucauguugcaauccuggagauuugugguggugugggagaugcucccugacccugggcccuuccuccuauacuguuucuguuuccugggacaaucucaagccuggaugccaaaaccccagaaucuucagugcuggggagaggugguagagacaagagguuugucucugcagaaugaccugccucaggaggggcuucaagggaacguggggagccaggacaggcagcagguggaacaggugccggcugugggcugagggcucagugggggcccucuuguugugcugugcguccuuuuggggaaguuacuuaaccuuucugugcuucacacuucccccgcucccuugcuuguggaauggccacauggagcccuucuuaggguagccuuggggcacaguuacaggucaggccaccagcggccacccugugccaggaauggaauccugggcccccagcaugcucuuucucuaggcagaaggugaccagccagcucagggcaggagaugcagagcacagccaauuaccuguggcacacagaugaccugcuggggcagggggccacugccaguguguacaaggcccgcaacaagguaggaagcaacccuggccaggcccuguccagcccagccuuggcccccucaugccucagaagcuggcccagucagcccccagugggcauugaggguggugggacagggaccucuggauguuguguagcacacucauacuguggguuugagcagaggcauagggagcugaaaacggcuccuugagaggaugccucugucgggcacgaguuggagcaagagaacugugaaguaacaaggcaaacauccgaggaagguaacagcaaauggaaucuaggaauagcagaguggggaauuaggccuuguuuggauuuauccugcgagaauguaugagaugauauccacucugucuuauucaagagugguagccggccgggcacgguggcuuaugccuguaaucccagcacuuugggaggccgaggugggcagaucacgaggucaggagaucgagaccauccuggucaagauggugaaacccugucucuacuaaaaauacaaaaauuagcugggcaugguggcgugcaccuguaaucccagcuacucaggaggcugaggcagagaaucgcuugaaccugggaggcagagguugcagugagcugagaucuugacacugcacuccagccugggugacagagcgaggcuccgucucaaaaaaaaaaaaaaaaaaaaaaaagaauuggagccauacagaccagguuccaaucccuucccugcugcuaaccccagggaguguuagcugcccugugaugauugucaauagcaauuguaauaaugacaacaagccauccccugcagaagaucagagugucaggaucuugucaccucccagugcuggacucucuaccccuugagagggaaaggcggugcggaugggagcccccauccaaccaggcuaaucucugggguugggcuggccggagaggcugaauggaggcccaggagaggguggcugcuccccugugggagugggacaugugcuaaucccaugcugucucccacugcucccuccccaauggcagaaauccggagagcugguugcugugaaggucuucaacacuaccagcuaccugcggccccgcgaggugcaagugagggaguuugagguccugcggaagcugaaccaccagaacauugucaagcucuuugcgguggaggagacgguagguccggugcuuggucagagaauggucuuguccuugacccuuauggucuggggagaaucaggccacaugauaacagagauuuggucccaugcucaucagcaggucagagacagcaggcaaauugcag

SEQ ID NO: 12841 - RNA, 1029 nt, Homo sapiens
agacaauggaagaauacaugaacaagccuacauuuuaacuggaaaucuacuugaagacuccagcacuacauguuaugaagcuguaaauaagcaacgccucccauccgguuuuuugauggagccucaggcaccaugccaaaaauaauuuaaagggauucuuuguuaacuaacaaaguuaaaguuguuuaacauauuuauaauuacuaugugucuguauuauuaaaaaaaauuaugugucuguguuauacuguauagguacuuguagcucuaaauguuuaaaguaacuaccaccuaacccaacagacaauauuuguaauguauuaacuccauguuauguuuuuaagcugguuuagauacauuagcugcaauuuuuuuugcauuugacacaauauuguaauaauccaugauuuugaauguaaaguauauaugaugucauuaauacuuuuucuaaauguuuaguuuucuaaauuguauaauaauucaaaauuauguuaauagugcagaguuuauauguaaugcuagacauuuuucauacacuuaauaguacuguaacugcaauucacauacaaaaugucugauuuuaaugugcugaauucauuuauuuuuuuuagaauugggauuaugaaaauaaccaaagaguauagaacuuaauaaguguuuuugaugccuuagaagcugcuaucuugacugagguuuuaauuuaucuuuuaauugaauauaagggacauuccaauaagguuuucuaugaacuauauauuuauuaagguuuauagagaccuagagauacagcaucuaugacuuccuuuauuauucuaaaauaguaugauaagaauuaauagcaauaauaauuauugcuacuauuuuuuaaaauucacguuccaagcacucuuagaugcuggaaauuucauuucaaauauguuuuaauguaucucuaaugcauuugaagacuuauuacauggcuuacuuagagcauuuaagauuaucacagccuauaugguagauuccuuuccuucuuuuuucuuuucuuac

SEQ ID NO: 12842 - RNA, 24707 nt, Homo sapiens
ccaucuaaauaaacguccucuuuauuuuaccaaauauaauuuaucaguuaaguugacauuugucaauucaguuauaguaacuauaaauaauucucuuaagacacaguucuguaacuuuuuaaggauacgagaguaaaccaauauugcuccuugcagccaggccaaaaguacaugcaguugguacaaucggggaaaagaaaugaaacuuccaugaaagucaccuucauuuucuuucccucucacccuacaguccuccucugcucacucagggccuggggcaugccuaucugucugcuuuuuaggcaaaggaggucacuccagagucuucugggacugccuggccaaauuccagagaugaggaaggggcgagugacugggguagggguggcuggagaccacagggacacagccuuaggggcagaggaguugguuuugaugccuguacaagaagaaucuguguguaaguauuuuuugagguggaggaaaagaugaaaaaaguccagagggaggaggaaaaacaagcccaggcugguguuaaugaauucuguuggacacaacuccaacuagaaaaccucuaaaauuccuuccaauucuacgguucuaugauuccagaaggaggccuggaggucuggguagaaauggagggagagaaaauauggucucuggaggucuagggcagguuccugggauaaggugcaguguugguagaaacaggaucauugccuaagccuucccuuggaggugggcccuugaggcuacagauggaaggguuucuguagaagcuucugagagagaaguuagaaaaagccuacauccaaauccccagaucuguacacgugugacugcggauggaggcuccaguuuucucccaauuuugugcuaggcagagaaaaguagaaacaaccagaugauguccacccugcuaguucuaaauccucuuuugggugcuugguaaggagagguggagggaagggaaugugaggaagggucguuuagggaaauaaauacugguugagcaauggggcgguggcucuagcuguggucagcacugcacagaguaggggucuggaaaggagaaagaggcagaagaaucuggcuugaaguagaugcaaauacuuacaacgaggaaacuuucucugccagauucaaaggggcacauggccuuuguaaccuggagaaugaggugagguuagagcuguguuucccuuaccacuggcuuaucagugccuggcacaguaccuaacacauaguaggcacucaauaaauauugcucaaagaauguuucagaccaugcuugucugcaggagagcucaucuugcggaggcugcauauuugcuaaaugaacgaauaaaugauuggugaauguuuguggguagaagccaagaaagaggaaaacugaccucuauggcaugacagaacgaguaauuuuaggaagugacaggguccaaggugaccaagugauuauguccucaggagaaauggcagcaaugagacaccugugguuguccucaaccuccaaaccauucuccacauacccaugaccugacccuaaucucaaaacccaaccuggcaagcucuggggaagguagugcuuagagacaauuugagaugaagguugaagagagacaaagaaucugggcccagggagacaaagucauuugggcccagggagaauguggauuuuggggaaccaauagguggacaugggucaacagggagaagagugcacuguuccauuuuuuccuggauaugacaaucaacuggaaaugaucagagggagggguuguugauguugaccaggccauugaacaagaggcaugugcacaaauugaaaagucaguccaccuuacucuuucugcgagugggaacgcuuagguccagagggcaagagaacagaacugggaucacaggggccuggagcaggugucuccuguccagagcuuugaaguugguccacuucuacaaaaguaugucuguguuugggaguguuacuuauucuucugucccucuguucaaccaaaaccaaaaauaaaacaaaacagauaaaaagaaaacaaaaccaaaaauccagagcccacuuacaaaggguuucucauuagggccaagacagguugcuaaagccaaaccccauguccccagauuccagacaaaacuccccugcuccaguccacaucaccuggaggcacccaccaugaaacugcacuuggugauugucucaaaaaccuacuuguacugcuuaucucaggccaucuguguuucccaaauucuugcuauacaaacuuggcucaauguauaaaaauucccauugaaaauaaugagaauuugguaucaaagugaaguccuagaaagaggugggagugugggguggaggagggacaggggaacaaaagaaaaauuucaaauagaaagugcagagggauggggaaaauguugagugaccaagcuaguccccgacauccgugucucgguccccuaugagccagagaacauggaagcugagugcuaggagcccagugccaagcaggucccccagagcagucaaguaugggauggagaaguuguccggguccaggccccggccccacauccagugcaccauccagucugcgauguacaggagaaucagcaccuggggagacaaaagggcccagccuauagccauccucucucuccagggggagccagaggccacaugaucagacccauucagugcaucacagggcuuggcuggccauaauccuuacuuuuuaaucuuccucuuuccaccccagcaaccucucuguguuucuccaccccacaauuaccacuuugagcagacaacaggcacaauaagagcucuuuagaaaggaagaugcugcuacgacccagggucacccacaucagcauuauauucugcucccaaguuuaccaaacaaggagcuuccugaccuaaauccuacuuguugcagaaacucagcccucuugccucuaacucugggucaccucauucuggggucacuccaauuccugccauguuggccuuuccaggagcauggcagggggcuggcugcuggagucagcuuuuccuaaagggaugucuucucucggcagagugguauaaggauaguguuugaagcugcugcuggcgguugucuuaaguaacagaugaucaucccaagcuggcuuccuccugacccuuuucauucuguuguuguggcuuuucauuccauucuuuuccauuguuugggcucaaagaaugcaaguuuauuuuaacauuaguccuaauaaaguugaauugugaauaagucaccucaauauuaauauaaagcagacaaugcauaccaauucaaaauacauuugacaugaucuguggcuuugauuuuaucuguguucuugcuuaccuucuauuaauacagauaauuaagaaugacucagaucagaaucucgcuagugggcccaggaccagcagcaucaacaacagcugggugcuuguuagaaaugcaaaaucucuggaccucuugagucagaguccgcauuuaacaagauuuacaugcgcuuuuaaguuggcgaugcccuugaucuagaauaccacgguggggcaggccugaaucuccuagaaucugcacagugccugacauuugggcucccuaaaugacugcaucugcgugagaaugaaacagauucugacggucaagcucuaauacagucagucaucugggagguuuuacccuugacuauacuuuguaaauacugugguaugaaaauucugcccuaagggauccagaugcgggaaccacagcccuuaagggauccagaagccagaacugauaccuauuuuuaggcaaucuugguugcucuccuguccucucucuuuuuuuuuuuuuaaauuuuaggcucugccugagagaauccugcccucucuccaaggaagccagagaugacucuucacauucucccuugcucugcacacagcugucuugugcuaccacggccuuggcuccccuaccuuccauaacuucacacccuuuccagcagcugcagaagggucccaaauaaagagcauggccaggaggccuuugggacaugcccuaggaagggaaugguagcagcuguccucacauuccagcuucuugagcaggccccaggacacacagcugggaggagguggcaaagggaucaauaagagccuuuacaggggaucaagugucacgcucuggcccuccacagaucuagagaggacagcagaggcaagaaugucuccaggguauucaucaugggugauggcacugaggcucauccuuuccaauucaggccaagggaugagcugaaaaccuccaccacagaccccuggcauauccacccccaucuucccaccacgugcugcacuggaacccacuagcaauggaauguggcagcuuggcuaacugcugcagggcaacagcauauggcugauucucagccccgccccugccaagauguccgaacacaaccuuucuaaagcugggggugagggggcuggagggauagguguuaaucaauacaggacuggcgaaauaaaauuauggucuguguaucacagaauaugauggagcuguaagaaaaucaggguguuguucucuuuauguauugauauggaaugaucucaaagauaaacuuaaaugaaaaaugcagggugcagacaguguguacaguauacuacauguguguaaaaaagaggaaggaaauaagaaaaauauauguuuacuuuuauaaauauagaauagguuugaaggacacacaagaaagggauaauacugauggucugugaaggagagaaacagauggcugugaagaagaggacagaaaagaagacuuuucacugagguuucucuaugaaccuuaaaacauuuuugaacuaugugacuauucaaaaaucaaaccuauaaaaauuuaaaauguaauaauaaggguggaucuagcuguaaagggauagcauaagggagccuuguggugaugaaacaguuuucuguauuuugguuauagugguggucacacaaaucuccacuugugauaaaaacugcauagaacgaacacacacgcacacacacacacgagugcauguaaaacugguucaaucugaauaagcacugcagauugcaucaaugcuaauuuccugauuuugauacuguccuaaaguuaugcaaaauguuauuuucccauggagggaaauuggguaaugguauaugggauuucugaaccuuuuuuuugagaacuucuuacaaaucuguaaugauuucaaaauaaaaagcuuuuacaauguaauaauacaagaagggagaaagugucaugguauuauggaauggcaaggcuacacaggauccgacagauuaucuagugcagugguuuugacaguuuuucaagcuaugggaugcuuuaugcaaaugaauuucuugagaaagcucaacaugcaaaacagagccauguggagcucuguggccagugggguuggcaugcaaaccccacaggcucagcauccuacaaccaccugcaugaaaacuaccaccccugguccauuccucucaauuuacaacuguaucgcugaggaucaggguaguaaaagaacagggucaaagucacacaccauguuggugacucuacuggaacuaccaucuguucuccugcacccuugucugguguuuaucagcugcccugacacagagaaagaggagguugagugucuaagaggccaagucuggccuccucucccaucccugcagggcauccuggcuccuucccaugccccugcuccugccacuuuguaccuggagcagugcagcugucauauagaagaugaugaagaugagugugaggguggugugcccgcccugcauacagcugaugguguagaggaacaccagguguccugggaccacgaggaggaagaggacccgggcugagcgagaauucacaucuggaauuggggaaaagaggguguaaagaggaggggaggagaagaccuggccccagaaggccuuucaaagucaggagggacggcaccauaccccagggcaacagacagaugaaugucucuacuucugcauccuguggucuccaaccccuagggugcuccaggaaaagacagcccuccugccugggcucugcccuucagaacagcuggcacagcccagcagagaaggagaaccuguggaucuggggccccagcugucucuuaagugaagcucacugacaguaggcccacuccccccagggcugggaggcugggaaucugccguuaccagggcugaagaaggugguacaaggacugggacagcggcgaggagcuugcucagaguucucuccgggcauuccauucaugugcaggaagguggagaugcggcuggccugcacugccaccagauugcccccaacaccugcagagacacauacgggcuuagacacagacagaggucagagggaggagugggaacaaaaugaucuucucacucuuugucuucuaucuauagaggcacuguccucugucuuaauuuagggucuaugugggcaucacccauucaccaguccccaaaagaagaguaaggcacuaagaaggaagacaaagaccccugcuuccagugcaucuuccagccucccccauccuccccucuauggagaugcagcaguuccauguuccccuggcaaagcugugacagugccggaaaggauacgugcagaucugcagacucagagagccugacuucuccaccaguagagcaugggcaccugccuuccuacacagcugaggggaugaagcccugccuugccucaccgccucaccuccucuccaaugcucugagcagacccaggcauccuauggucauaugcugauucugguaaccaguuucaaggaucagguuugagcuccaaacucuggaaucugguaucuccgccaggaccugugcugauuucucuguugcccucacaucccaaccugcucccugcucuucucagccuugcucugagcucugggggacuggucuccacagacugcauuacccagucucccuugcuggcugcuuccacuguuuguucagugggaggcaacagcaggcaaccagagggcagguggagagagagaucagguauuucuuucccaaucccucccugcuuuucagcauuggcuuccccauguugggggcaaagacagagcuuucacuggacuccuauaaugcuauucccucguuacuaugguuugaauauaguuuguccccaacaaaacucauguuguggcuugguccccaaaugugguggugggagguggugccuuuaagagugaauagguuauuaagauggauuaaugucuuucuugggaaagguauaguucccaugagaguggguugucauaaagcgagguuugccucucuuguuuugcccauuuugcacaugcccaguuuuccuucuguuucuccauuuggauguuuggaugcagcaugaggcccucacuagaagcagcugcucaaucuugaacuucccagcuuccagaacugugagcuaaauaaacuucuuuucguuauaaauuagccaguuucaaguauucuguucuagcaacagauaauggacuaugauacuccccuugacccuuuaggaguagaggcuucccauugcugcuaaucucucggugccucaacaucccuuaucuguccuuuuacucugcucccaccucuguaagcagucccuucauuaaggucuugaaccaucugagcuagauucucgucugcuggaacccugacugauacagaaaccaaccccuuaaguccucuucuccugucccuuuccuucccccagcccugcccucugauagcugaugcccagaccucaccauuaaucacaggcgugaagacagccaucccagcaaaguuggggucugagacagucuuguccaagaugaggccucccacacuauagagacauaaagacaaaaugacgcaaagaccacugaaggguucugccuuagucucugggaugagagguccaggcccaccuauccuuggagaugaagggaagcaccauggcucucaggaguuccucaccauccaguccuugccucccuugacaggauuaggugcugcucauaacauucugacugggcacagugacuccagaacaagcuggugguacugggucaggcaaccaccuccuguaccugcccucuaaguuggccggaggagcagccugcaggacuaucugccucugaggaccucuguuguucugcccacucagcauuuacuucccuuucuggugauagcacugggcuccuccacagggaaccaccucucucaagcucagugacuguggcucaggugacaaugccucaaugauagcuaggcuccagguccauccaaucagaggauugcagccccaaggccacgcugacugguuuggagauaaucaugucaccagaugagaagcaguggaacucuauucugggacuuuguggaacuguugggggaagaaucucucuucccacuggaauuuguaggaguaagaaaagcauaaaccugggcuguaggccaugacagagaagagcagagcuaagagucacagaguacuggggcccugaucuuagguaugucgcugaauucagcugugccuuuuugguucuccaggccaauacauucugccuuggaaugaaacccaguucagaugguuucugucauuuucaacagaaggacaugugacugaaacacuaaugaacacauuucuagggucugacccccaccccaucucuccaggguuuaaaaagaagucuguggaaggguuggagugggguaggaguggauacucagggccccagccuaccugcugauggccauggcaaugauaacaggcucccagcccgaguacaacaccucccuuguggcuggacuucgucgggccagcaccacccagacaggcagcagggccacaaagaaagcacacaccaguggguagauguaucgccagugaucugagagggcagaggucagaaggagauaagcacuguguuucccuacccuaaguuucucccuggcucagccugaaaaugucccaacagaucaauagcaagacuacacuaaaugccaguaaacacauuaucccauuugaucuucacuggcagcucaggagguaggugggacaagccuuuuccauuuuauggaugaggaaaccaagggagagagcuagccaggcacugagccaauuagggacagagaccagaggacagagacucuaggucucuugauuggagcccagaaaacaccaucucccacccgcuucuucauuuugcaagcagaucuaagccucugguuccuuuccuuuacccuuuccaccucaucccuccaagagaaguaagaaucugcaggaccacacaggaauauacuucugauacuuuuccccugccccugaugccugcuugaauuugagaucaguacuuagcuucaaaucucuaagaucaggaauuauuacaaccuguguucaaaccaaauaguuuaagaacacagaagaaacucuugcacauuugcaaacuacuaccaucucucccaaccccacccaggacuccaagaagccacacucuugguggcucacucaguuccagguagaguccccagcugaugccugagagcagcgccaaggugaugaggucgcccaggcuggcagcaauggguguggccacguugucuggguugaucccaaucuugcgagagccaaugaugacuccaaucaugaucauaccuggugagcaagugggaggaggggcaggcagggugagaagagauaaaggagucucaacaaacaaaaagagagaguggaagugccaggugcaguguucucuggggcggcacuccuuacuccucuaugcccucccuuucuuacccaguaccagggaggcaaugaaggcuguggccacgcugcuagcacagagcaggaaggcgugcggaauacugaaguggccaucagggauccagccaaagacgacggcugcgauggacgccaggaagcccaccaccguggccugcaccuggggacaggagugguaacucagaaagcccugagagcagugggcuuccuaagcugaggucauaagcaucugggcagaccucuuccuggcuggcaguagccccaggaggcaggcuggacugcaugguccaguccucccaggcuggaaggaugucuuuauuuauuuagguucacaccagccacuaguacugggcagugcacucugcaggagcccagaacauguuacuggcugaaugagugugccucuggggaugggagugagguucaacagagccggagacuuccacccagagucaaggccugggccucaagggggaaggcucccagucugaaccuguguggucucauggggagaugggacagcaguggcacaggacaucucagcacuccugagucugcucauauugccaggaucugcugggacucaaaggcacgugcaccaccaagaacugagaaccagaaugggugaugcugggcccuccucaucuugggcguuuuccuggguaaccuaguuaccuccuagagcuacucugggggaagccagcucagugggauacuggagauucacucaggagccugcuggggcugaccuaagccuuucagagauuccugacuaaggggaagcuuagcccacccucucuggucccugccuucuuaccuggaugagggccauguucccagugaucauccgccagagcuccuuggguguguccauguguccaauguuggccugggaaagggagggcaaggggcuggagcuucaggcuggaaaaggccugaagcuccauccauuaggcuccugccuagaucaugaggcaguacauguggccuaagacucugagagcaggaccugacagucccggaaaggugaagcaggaucagggaaacugaggugaaagggaaggagcuaaagcugggcuccugcagcugggugggggguuggaaggggguccccuaggcagucgccucucuuccucucaggacaccagcugagcagaggcaaauucuauccuuugcccugcuuaucugggcagcccauuccugcaugggucagaacaacccagucccugacucugaagccagccugcgaucccagggaaggaaaggucagcugcuggugcaggacugaggcuccaagaguauuugggaaggaguggguggcaugggccagaagucggguauggcaagucaggguggguuaacuuggaugccacuucugucugucaccuucucuagacucuugacccugcagggagaucccuggccuccugaguuuuaucaucucccaccuccagcccagggcccuguaucuguucaggcccggaaucgucacggcucacaacugugggagguaggaaugacgagcagcuccucucugucuguuuccuuaaagaagagcaagcugccauggguaaagggaaugggauggccggggggcugggggugcugggagggccuggcucugcucccgcccagcugcaaagcaggggcuggagaucagaggaggcccccaucugugcggguggaggaaccagcaugaugccugccugucaaagcugcacaaacagucacgaggugguugagagguaggggguggggcaggaguccagggguggcugggacauccagaaaccaagccugggaaccacuuugggcagggagccccugcccaggagcaggacacccagccugggaucucccuacaccugcccagccaggcccucccuucccaccccagccccacacuccaggccugggcaguggagaagggcucguagcccucucccagucucuggcucugugcugcccagaguccucucugugccccacuccucccagccaggauacucacugcaguggaaagccuugaugccagggucauuuccagguucccuuugagccccagcagcgcaggcacuaggaugaagaccucugucaccuucuggaagacuucccagugcuacgaggugaaaacagaacccaggaauuucagugccccaaagggcgggcauugagguucaacagguagucugagaucaggggcucgaggaggaaauagaaucagcagggagugagcacgccagccaccuuuccuccaagaaccuuggaaccaaaccaagcccaugauucuucaaacaacacaaccccccuuccugccacccagaaccagggagauggagaggguuucugccgguugggagacucucagucuggcccuaccuuuucuguuuuccuggagguggguggggaaggguaauggggacccacacagcugagcugcccugggcugccugacaccccagaaauccuuugcaauccccccucaaauugcaaucccuggccccuuugccuucaguccaguuucucuguugucucagcugugaagaguugggcuccacagggcuggggccgaggcuggggagauuagagaguuuguuugguuucuaucuccaagggcuuugggccucagccacagcaacucuccuucugaacaggcucugaauuaagacuguggccccuaaaccucugaaugcuggccugcaagaggcuuuuuauuucucugugcacugccuuacccccacacaccuuccucaaucucucagcuaggagaagcaaguguacuccuguaggaagagcccuggaccgggagucaggagaccugaguucuagucccaagacaaucaauccuggcucuccuaccaaugucuuugguuaacaucuauuaaggacugauugugugcuaggcuaagugcucuccauguauuuucucuuuuaaucaucuuaacaacccaguaagguaggggcuauuuuuauucucauuuugugaaugaguaaacugggguucagacaguauuccacuaguuagugcuaagaggacugcaggaaccaggacuggcuauuugaaagcuacuuuacuugcaauugaaacugaggacuugcaaaaagguuuaggauugugucucccucccuggcccuaacaggguaggugguuucuuuuauuuguuuuaagaauggaaagccuccagguuuggagagggaggaggaggcaggaggccaggcggauauauauggguuggucugcguaucauggcugggaggccaagcacuauguuuggcaagggcacuggaccaagagccuugggucuccuacaggagacagcagggauggcccccugcuuaucuccccaguacaccuccucacguagaccggcuggacaccuuagacaaguuacaagggccucaagcucuugaaaaauguucaauucagggaccagaucagauggucuuucaaggcaauuccaacacccacacucugucguuaaagaugagcaguggccgagcgcagcggcucacaccuauaaucccagcacuuugggaggccgaggcgggcagaucaccugaggccaggaguuugagaccagccugaccaacauggagaaaccccgucucuacugaaaauacaaaaauuagcuggucgugguggcacaugcuuguaaucccaagcuacucgggaggcugaggcaggagaaucgcuugaacccaagagguggagguugcagugagccaagaucgcaccacugcacuccagccugggcaauaagagugaaacucugucucaaaaauaaaauaaaauaaaauaaaauaaaauaaaauaaaauaaaauaaaauagauaaaauaaaguugagcaauacuguagauuaguaagagaucaccucacacucauuaggaugguuacuauuuaaaaacccagaaaauaaucaguguuagcaaggauguagaguuugggcugggcauaguggcucaugccuguaaucccagcacuuugggaggccaaggaaaguggaucacuugaggucaggaguuggagaccagccuggcaaacauagugaaacccuguuucuacuaaaaauacaaaaauuagccgggaaugguggcgcacaccuguaaucccagcuacuggggaggcugaggcagaagaauugcuugaacuugggaguuggagguugcagugagccgagacagugccacugcacuccagccugggugacagagcaagacuccgucucaagaaaagaaaaaagcauguggagauuggaacccuugugcacucuuggugggacuauaaaauggugcagcugcuaugaaaaacaguacggugguuccucaaaaaauuaaaaauaaaacuaccacaugauccagcaaucccacuucuggauauuuauccaaaagaauagaaagcaaggucuugaagauauauuaauaugcccauguucauaguagcacuauauguaauaaccaagagguggaagcaacccaaauguccaucaaggaaugaauggauaaacaaaauaugcaaagugugguacauauauaccauggaauauuucucagccuuaaaaaggaaggaaauccugucauaugccacaacauggaugaaccuugaggacauuacucuagucauaaaaaacacuguaugauaaaacacucagauaaaaaacacuuaucugagguauccaaaguagucaaauucuuuuuuuuuuuuuuuuuuuucuugagacacggucucacucuguggcccaggcuggagugcaguggugcaaucauggcuucgggcuccagccauccucccaucucagucucucggguaguugggacuagaggcaugcaccaccacaccuggcuaauuuuuguauuuuuuguagagacagggguuucacuauauugcccaggcuggucucgaacuccugggcucaaaggauccucucgccucgaccucccaaaguguggggacuacagguaugaggcaccgagcccagccuaaguagucaaauucauagaggcggaaagaagaaugguggaagcaaggcgcugggggagcagggaaaagagugaguguuuaauagguacagagcuucagcuggggaagaugaggaguucuggagaucuguuguacaaugaggugaauauacguaguacuauugaacagcacacuuaaaaaaggguuaagaugguaaauuuuauguuacacauuuuuuaccacaauaaccaaaaagauaagcaaggcuaucagaggggguggggcuagggcuugagaccaggagaggcugggcgcuggguggcccuauaaggcaagaaccucucuuuuccugucggagcucucccugugugaauggggugggaggccucacaggauccuggggaaggacucauuucacuggggcuggagcauacgcuugccugagcuucuggucuggccaagaccugggacucuccuuagggaagccccaccguagggacuaacaauggggaagagacugccccccaucucaacaacaguuacugggcuuccaggcagccaaaggaugagccagcccucuccaaacacugaagggaagugaaucccuucccacccuaagaccccccagagagaaggcagccccagugagccccaucugcccuggagcaacuuggggacuguuacucuuggacacggcugguacauaccacugaggcuccagcucccugcagucuggccuugcucugcuucgccuccugcuuccucccaaaccagcuccagagaggggaaaaaucccccucuucuccccucccuugcgggcuuucaaagcuccucucagagcacagccucagagcucaucuucaccccaaaacaccagcuccacccugcuuccaagcugccagcuccaugaaaaucugacuucuacagguagguguauguaauguacauguacucauagaaagaaaaagcccacaagaagacuccacauguaugcaagcaauguuuucugagcuguuuguaaugaauauugcuugcuuuuauuauuauuuaagaaaaauguauaaagcucagcuaaguuccucugguugcuaccauaagcaccccaaaucucucuaccucccagcacaaugcacccucuccuuauagcuacaggaggaucuacaaaguacggaguguuaggagcagugggauaagagacagacaggcaaggagagggagcagucacaguaacagccccuaugcaaaagucuucccgacucuuacagaauauagccuggaaccucaaacgaccugaccccaggccagcaaagccccgaguuggcacuugggucagagaagccaauuccuacacacauacuuucuucacccacaaacccucucaaagcugcagcucaggcagaaagccucugacacaugggcaugcauaggacucuggaaagagaugcuggaggcuggagauguggagccagcccaggaaucaagguggccuuaagguuaggaguagacaggaugggcaggggcagacagugaguagcucuucuuccuccuuuggccaaauucagccccauccuguucauccaggcuaggaguaucugccccugaagucacacccgucugccaagcagccacccacgccuuccugcucugauggggaugaaaaagggcauguuccaggaagugcugcccugcuuggaggugaggggagcaucuagauuuuaacuacuucucagaaaugcagcuccucaucucuuuccuucucuaaccuuggugugaggggcucauggaucccugguauucugcaggugagggaauagacugccucccccauagccaaaaugaauccugaggcacagcaaucaccuuaagucucgauccucagugguccugccaguaccucuuccuugcccuuccaaugcgccucuuccauccuucaccuacuccaauccaagcucauacacugacccugaccugccuucaaggguucuggccugagccaccucaggaggguagcagcagggaagaaagucagagccaggaaucaagacauuaagaagacuuaaauucccagauacaagcuuuaggcuccaggcuggggagaaucugggcuccugugggagaagcugggcuggagcugaucuuuuaggguaaggacugggucagaugagauuacaguaaccccaggcuucaccugucugaggcuuuuccaaaaggcauccucuagguguccaggaaagggcuuuagggcaacaccuggauauacggugcaggacaaagcaggagcaaagcaaaugggucccugacagcaggcaggggacagagaugggaaaagcagaagggguggucaagugaagcagauaagagugucccgcccagggaugcugcggccacaggagcaggccaggcacaggaggaauacuuccuucccacucuacuuccccaaggccacgcuugccaugcacuuucaucguuguagacuucuguauacacagcaggaucuacuuuguucaagauccuuagcaggugaguagugaguuaaaauaaggaccugucuuaaccuagcugggaauuaaagugcagaugggcacacuacuuccugucaccccaucccucacaaaggcugacagauaaagggagugagacauccggagcagccuaggaccaaacugggcagaugggcacaaggcuccugcagugaggaggcucccauaucccaacccccuucagaagccaacaccaggccccagccugcuucccuuccagaugcugcaggaacuuucagccaugguugggaaguuagagcagauggagguccauuuauccuuuuccuacuuugggccagcaccagccccuuauuucacugcagaugcugcugugcacauuuacgggagggcagauaagaggaggcagaaaugacccuucuaggaagagaguggguuuucuuuuucuuuuaaauuaaaauuaaaauucaacuuuuuauuuuuauuuuuuuugcaucucguuggugaaaaagaaaccaaguuuucuacagcagcaaggaaagaugggggcccuggaccaaggagacaucugaaccaggcccaauauggacuccugcucaguugcuccaagaugcuggggacacuccauagccagcuucuccagauggccccauggucuuggggcacuuucagauucucuuacugaaguccaucuuagcuuaugaagggguaauauaggugugaauccuuagaaaccaucccgcucuuccugaaucugagauugucagucccccuuuuacucccauggauguggaauaacaaucucccuguggucccaugucucggucccucugcacucacccccuccugccaucucacuguugccaucugcagggccugcuccagcccagcuguagcaggaaggcugggggaggaggacauggacaaaccugucauugucauccacaccaaguggacccuagcucugaggugagcugaggugccacacugagagcagcuccaaagguucccuacccaggccucucaaugucuccagcucaugggccuggaguggggauggggcaacacaucagaaacuuuggaaucuaagugugugggauggguaggggugugguguguaugcgggggucccucccuaccccaucuaagaacuuuuauucuugcucacuucagaagauaacgcuaauuaauccagauucuaauccacccaguucuucaaggaaagacaaagaaaauaggcuccucguagagucuuuuuuuuuuuuuuuuuuuuuuugagacagcguuuggcucuguugcugaggcuggagugcagugguacaaucauagcucauugcgacuucaaacuccugggcucaagugaucacuccuaucucagccucucaaagugcuggaauuauacgagaaugccaccaugccugacuauuuuuuuuuuuuuugguagagacaaggucucacuuuguugcccaggcuggucuugaacuccuggcuucaagcgauccuccugccucagccuccaaaagugcugggauuacaggcauaagccaccaugcccagccagaguuuuuuuuuuuuugaguuggagucucgcucugucacccaggcuggagagcaguggcacgaucuuggcucauugcagccuccacuucucgggcucaaaugauucucuugccucagcuuccaaguagcugggacuacaggugccugccaccaugcccagcuaauuuuuuguauuuuuaguagagacgggguuucacuguguuggccagacuggucucaaacuccugaccucaggugauccgcccgucuugaccucccaaagugcuaggauuacaggcaugagccacugagcucggcccccucuccgaguuuuuaaccaacuggugaaccauggccauggcgaaggccacagggguuaguggugugggcucuagggucagaugaccagggacaaguuaccuaaucccucuaagcuacaaguucccuaccuacaaaauggagaugauuauggauccuaccucaugggccuaccgaagagccccccaaaugcuuccccacuaccauuacuauuauccagaaaauaagacaacucucuucaguucaccucuggacccuggcucugcaacccuuuguagguaucaaaccagaaugcaacaacuucaagaaugagaacugaggccacaggaaaggaauagaagaggugaagaaaaauguuacccuagucucuuucuccuccuccuacugucccagucccggcccuagggggaggagcagccccuagcaggaggaacccaaagcuccaggcuggcuucccaaccuccauguaggaacaaccuucaagauaacaguuuuggggaaaggggaggcagugcaaggcacuuuggcaugacuuaaacagcacucucaugagcaaccaaaggugcaggguuccccugaagggcucaagucaaaguucuccaugugcacacacuaucaagaaccaacccccuucagucucccaggacacaggcauggugagaccuaccagcagaacucuauaucacuauggucuguaggguuggcuuggcacagggaaggugaugcuaagcuucguguccuucugggagauaucacagucagggaacacugggggucccaaaaagcaaaggccagaucuccuccugccuugguauuaauauuucucugaguaccuaggacagaggccagcauucagcaggaauuugauacacauugcugaauuacuuagguaaacccagcaccuucaaaaaguuuggugugccacacugugccuaaaaaacuuuuaucuaaaaacaaaacuuuaacucuuggaccuggagguucuucauaaguccugacucacaauaaauuaacauggcacaucucuggcucuuagauuccaugucccaccgacucucauccuucauucuacccaauguccucaaaaagaacccucuuugcccagggcagguucagaaugacaggugaggagcaaagaggagagacaguucugcccaggccuaguuacauuuuguccccauuuacagcagauaauuagcacauuugggucuuguuacaccaaaucuccaaaucaugcaucagacagcaagugcccacccccaccccccaaggggauuaugccaagguuacaggaagauaagcaacacaaaaugccuucaagagccuuccuacuuaauuugagacccucuuggcagcugaacaaauuccugcccaguagggggauggaggagaggcuugaaacugagcuuucuacuauggguauccuugaaaccccaaaugcaggggacaaaaggcauaaagaggagacccuuguaaaugucuccuacugagcugggcucggcaggacugcuugggagagauggcaagcaacgacccuguuccaucucuccucucccaagccugagcucgggagccaauucuguuucuauuuagcaauacugcccugaucaccuccccagggcuacucgguuuccuugaggcuucuguagaaaggaacuagaccaagaagaaaccgaggacaugauccaaaggaaaacaguauucuaggaagcagcagccacuucugacagggagguagagaggaaguuccaaguuucccagcaggcaaagguggcccugggcucacagucaagagcugcccuacucagguccuaccugcacgauguccaacaccaugccagcagccacggucccaaagccugccaggaggaauggaaacaguacuugcagcccgauggaaaaggaggucuccuugagcggggaagguggcgcagggccacggucugugcugacgucgucacuuucguugcucuggcucccguucuccagcagggcguccuccucccgaacccccuuggcguuggcccgagacucaaucaccaccucuaccccagccccaucaggccccaggaacucugaggucccagccaagggcucucucccugggccaucugaagagcagggagaggcagaagggccagucccguucaguugguggacguccuucggcucuggcuuagaggacaugacaggcacggaggaggggaagggagaacuuuccucucuucuuuuugcuuucucucuucuucucuaacuugggaaagaacuuagucuuggggugaacccaggcuugggcgccgcaggaccucuucccacggcucuccacuccuaccaggcacugcaaaaacugauccaccaacaggcagccccaucaagcacugaagccgcaagcugggaagaaacaagaaauuccucaccagacagccacuaggggugcagaugccugacuccaacccaccagcucugugcuugaagaaaaaguaucuguccucuuaucuucuuugguucucaguggcaggcuccucagagcagggggcauccagaguagaagagcucaaccaaauucuggggugcccucugaaguggccccucuuccguaaaaagcagcuugaguucaaaucuuucagaacacagugccagccuggggcugcggcuccuucccgcuccuuuggcugggcucugucagcuucccacagcuccucaggcucugcuggucccagcgcagcgucugccgucuuucccuucucuuccagaaacuuccucccuuccugggaagagcuaauaccucuucaaaucccugguccuuaaagucacgagaaucaguguggaacaccuuaugugggaaggagaaagaaaagaaaaagaacauuacacuauagcaaaggacagcuuguacugggagaauuuccccccaaggaaguuaggaguucaucauauagcuauagaguuugcuauuugccucccuuuuuccgcaaaaauuacucaguccugcacugcuccaucuggaggcucagcaggagcuauccccgccauccuccccaccagcaacccuccugagggaucaccaccguggucaccagcaaugagaugugaccagccugggauugggaagaugcugugcagaagcccucugcacuguuuccucagcaacuggggguggguagguguguccucagcaagaccccuucuugaaugcccauuaagaacccugcauuauuuaagugggguucaguuacaaauucagucacaaacucccugccacacagccaccccuguauaaagugacugcuuaucaucacaagacagcaacagaaagacagccacacagggcaaagaaauagggagaaacugauugcugagugaagucccccagaccccagaucguucuagcuucugagaaaacaaaacaaagcuaggaggacucccugggcaguggggcaagccugccagaccaaggccaagagccagaggccuacccacuccugcccuugagagucaacaguguuacaaagagcucagacagcugacucggauccaggccucugucucuccccgucucccccugcucuuggcccugugagcuugucagauaggacaagggaguuaucucaguuagaagggacagagcauaaaacgauugcuuauuacccacgcauuucaguuaauuaggcuccuccuguuccccaggguuacugagaguuggauauaguggaauucuuagaaacaaaaacaaaaaaacaaaaguagcaauaaaaaaaacccaaaacaaaaaccaaagcaccguaagccaauaugcacuugcuccaaaugcaucucuuuagcuguaauggcuccacuucucugccuaaaggaauccccaggcuuccuaauuccugauggacucccauccuauuccauuucaccagaagagcucuuauucguaaaaaauaaauuuaaagagaguuccaccagguaagaggaacagguccuuaaguauuccaaacacacacaauuagucaaguucaguuuaggaaaggagguaucaaaccccaggaacuggcccaggagaacuguuuccucuaucaauucagucacccaccaggacucccuuuuccaaucuccuuaaacacaguacugugguucuuucaaacucccucaccagagauccaggaggaaaccucugaguccagugccccuaugccagaaaaguuucugaguccgcuaaaagcugacacccccgccucccuccuguguuccuggcaggccacugaaccugagagggggcucccaggaggggaagccaguccucccucaccacucccccuguaaagagacuucagacaggccuaaggcccugggacgaaagaagcaaaagugaaccaggacgcccuauccccuccucccaggcggggacaaaaaagacccauuuuaguauccccaaccccgaggagggagagaaaguaacuggguggccuccucagucucuccaccacucagauucagcaaaugcgcugcgcgccaggacugccgcccuccaccacccccuccccgccccaggaccccacaggacugaccugccccucgccugggaggaaggggggcgccuggcaaguggcagcguggcccguggucucggggggugcagggcacccccucuucucaucacuccuccucgacaguccuccuuggcccccggcgugcccccccacacccccagccaaggcgagcguccagccgcgacacccggcucgcuacauuucgcuucugcguuacagcgaggccgccgcuccgcuuccacgcgggggagguggccggggagggcaggauauaucgcuucgggcccggcgggggggcacccggacgggggaccggggagccgagcucacgcgcccccaaucgcuucuugcccgcggacucgggcccaacugguuggcugccgguggcaaacgugaucuggggcagacuggguggcaccccccccgcuccaucaaaaauagauucucggauggacaacagcagcagccaaucagggacuggggagggggcgggaucaaccucggcccggcccccuuccuucgcuucgugcccaggaggcggggcgccggggaaacgcaguaggaggagugacgggaaccgggagccggcuccaugcgccuggagcgcgcgggucccagcgcccaucggcccgggguccgaggggcccgcugcccgggcucgcugcguggugcuaccgcccccgggcccgcugcgccgcgucggagccccagcagacuuugagaggcgugugcgacagugcgcguccucuccugccucuggauguuuccuuggagccucuggccuucgggaagaccgguaaacgucccuguggagccagccagccagccaccucugacccccgggcucaagcagccagccgcgugcucccuccucccacuugguacccggacagaacagucccuaccuugcucuucucccgccggcucgucacuuuaggcucccuccagauuccgcguuccuugagcaaauggcucaccccugacgaauccggccuuaaaaaaguccc

SEQ ID NO: 12843 - RNA, 1881 nt, Homo sapiens
ccuuuuccccuaguaucuucguccccaagacccaagccagaauugggaggggagggggcugaggccaagccggguggcgggggaggggaggggcggggcggcgcggccagccggcugguguccccugaugucuggagccgaggccccgggcucucggccuccacgaagcgaggcgagccggagcugugcggugaaugcaaagagccgggagagcucccagcccggcgccgccgacggcguccucagccacagcccaaugagaagagagcagauaauuuauucucuaaucccgguucggguacccggcgcuggcgaguggcggggguaggaggggugggucuccucuuccuccguccccucccccgccccugcgggcucccggccgcacacacacacauuuccugacaauuagcgaacacaccuuggccgcgcggccuccggcggcggcgccgcagcuuuugucucccgcccgccgggcugcgaggugcgggcgcuuaggcgcgaaguugcagcuccgacgcgcugcuccggaaugccggcugaccgcggccgucggggggcgcggagggcggggugggccgggcacgccggccccggggcuggggggcugcaaaagagagaagagagacaaaaguaaggcagcgcuggccccucuuccuuuguuauaacccugagugugugcgggcgugagcgcgcgcgggagugucugugugcgcgagggugugcauaugugugugugcaugugcgugcaugugugugcgcgcgugugugcaaaugccugcauaugugugcgggucgggacuggccgggggcggcaggacccgaaggcgcuaggcggauucaccggauugggaguugaaucgcgucccggucuuucuagcugugcccggaaaucgggcgugcgggcagguagccgucccgcucucgccaguuccuccgaguacugagcucggaguuuguucacaggcugagcccgugcugggggugucgcagcuugggcccggccugcaggggugggggaggaagaagcuccggcugagggucugccccgaccgcagagggcgcacgagggggucucccggcaccggcgcggcgcccacgccacuacaggggcccccugaaacccggguagaagcuugugauaggcguugcgaccccgggaaggcgcgaggcuguggagguggcucguggggccauggagggaguggggggcggcgagacggaguccgucuaaaugccaguucccagaaguucagcguaucgauuauuuccuaccuuaaugcauauuuaugccgcgccgaaauaggcuucauaauuaacucccggagucauccgcagagguuaaagggaccccgaagauuugugcauugauuggguaccucggcggggugugugugcgcgcgcgugugugcgugcgccccgugcuaacccauugaagaauaauuauuuuucuccacuggaagcuacagcagagaaucggacaaggagggaagaaagagauuggugagggggagagagagagaaagagagagagagacacaaaggaagugagugcaagaggagccggcuuagcaucuaaacugugaguacugagcgaaaacaaacaggcagaaagugccgcgaguuggcgaccccuuggccggguugggggcccgagugcggcugagggggacuuuccuccccgccccgggcuuggcugggcgaagaggggucccuaaggcaugggcgggaugcggguucaggcacucaccugaaagcugaccggcggcgggcugcgucagccgccgcccuaggucgaccaaagaggaagcccccuccccgcccccauugccuuuguuccuuuuaaaggauuuugccgcuggugggauuggggggagugug

SEQ ID NO: 12844 - RNA, 3355 nt, Homo sapiens
ggaaggugaauucauauuuuaauuacugagacgcggugcuaagggagccggggagggggcggagggcucagcuuuguucuagaggcgucgagggcacacccuccuuacugggucacuucucuuuugcccuuuaccuggggugggggguggcggggaguuaagguggggguugccuugcugagagugccucugcucucugccuugggagaugaagggaugggucguggggggcgcaauaucccucuucuuguuuaucagagaauugcuggcaugccccagcacuuuuaaauagcuuccuagccuuccacccccgcugccgcccacucugaugaaggacauugccaaaauucgagacaccuaggaguuuguggucugcaagccuggggcccuggauuucucuuuaucuuacuuucuggccugcucugagucuccucuuucucuugguucuuccacauguucaugcugucucugacucacugccccauuuuugccagaggugcaaggguuggaggaccccaggagaguaucuggcacagagagaugugggggucaggccaagggaaaggaucagcagggaggccgaggaaccuccuaguggugggggaggacggaugcucuauggauuggcaucucuucugcuuggcucccacaaagcuggcugggcagggcaucgucugugcccccagaccguaaaccaucuuggaccugagcugggaaaaagccagagaggaggauggggaagaagccagggccaacagcuugcagucagaugcagccaacugugugguagcaggagguuuguccaguguccacccugccucuccauccuauucugggcuucuguuuuucugggggcuguuuuuccauuccuuagucccuccuggacuaugggcauggaaaaggagggggaggaugggaggggaguucccaugaugagcucugaugaguggggaguggacccaggugcuaguccagacuccucccccucaaauagacgcagcaaggggaccugacuucagggagccuccagcugguacuggagcccucugccaagggugaagggguaaagucagggaagagagucgacaggacuccugcucgagcaaagcagagaggagcagagaccacagccuggcagagggacuccccagguaccugcugcuggggacucugagggaggagugggguucacagcgggcagggauacggaaauggguuggaauucucugccccauguccccccacuucaggggcuggcccggcaaucugcaugcugcagacagagcccaggcagccuccggggcauggaguugugcaccuuacagugaggacccuuuuagagacccuguuagagaagaggaaggauaaccagagcacuuuagagcaaagaucugagcagaauaaccaggcccuguuuaugauacuuucuacucuuagauacaaggacccaggaaucccacugaggcagccagcccucgaacaccucucgggagccaggcuacagccccuagcccagcuccuggccagcuucauuagcucuccuuuccucugauguguagguucugguuccugugaccucacuccccauccuucccuacagugacaagcugagcaaaaaaagccaggauuuucuuaaauuccccaaaggacccuggggaggaacgggucauuuaaggggguauauucugcuguuuuuaagaaagaacagucauugaaaaggaaguggggugaaaaggaaaggggaucgaugcacucuggggccagagacccugagcugcaccuugaccuguuuguggggcugcuaccugccuggcuuguuuuaguugggaguuccuucccagauuagccuuguugugccugucaauuucuccccauguauuuuucaauaaucaugggacugcuuuguugaucauacccuugacuuauauccccagcaagagaagugcacgugugacaauaacugauuacacgggaauccaccugcccucccucccuccuuccggaucaaguuaggauuccagccccuuagguuuggggucuuaguguuaaaucuugccuaaucuccugguacacugaaaugagguaaugaaggcccagagagauguagccacuugcuuaggaugacacagcauguuagcaucagagccaggaauagaacccaggccaccuaagucccagauuggauccccgucucucucuagguuugucacaggagggauccagagauagcugcaggggauagaucuagaaauauaguaguugugucuuggcucuauauauauccuggagguugcucucugcuaacuauauauacuccaccagaguggguguguaaaugaugcuggaaaucggguuauuaaauaaccagccuaccuacccaugcugacucaagcugggccuccugcccauccagcuggccaguggaaaugcauugcaccuauuaauuacagcuauuagcuguauuaccgggacgcugagaggcugagggaggggagaaucuugacaggacuuggauccaccgggcacugugcuuggugugggccuuggcucugucuggagaaacacgaaggaaguuuuuccaaaagggcaagguuguccagaccaguggaacuguccagagagccaccaucugggccaugccacauuccucaaaggcagugaaaccacuuugcacaugugccuugcugggguaacccaggacauccuaugcaaucucuauugcuugaggggcuggagaagggaggcgccucaugcuucccuauuccaaaccccuuccgcauagcccugugccucccuccuuccccgcagcacuugggcuucacucaccugcuugcccccauguucuuccuggagagaggagugauucagaccaggccccggccugaccuccacgcagggcgcuuuccuuccuuuguucucagcuucuccgcuugaguggcuugagugcacuucugcucccuuuccauaggcccaggggcagaggaagggcagagaggugaacuggaaaaaucugcaggugguuaaggcuagggaaaccuaaaugagccuuuggagaaagggauacucuugcagacugaagcugagcuccugaagcucccucucuuccccagccagacugcaacagauaccagagcggccccuggcuccugcugagggccgggucagccagaggugggggacagcguguccagcuggggcagauccagccucagccucuaccucagacuuaugugccagggaagaaaccaugucuuuacccuuuuguaucuaccucucaacccuuugcccagcauaggugcuaaauaaaagagccuguuggcuaaaagaacccucuuugcugucucuucucugcaug

SEQ ID NO: 12845 - RNA, 3355 nt, Homo sapiens
caugcagagaagagacagcaaagaggguucuuuuagccaacaggcucuuuuauuuagcaccuaugcugggcaaaggguugagagguagauacaaaaggguaaagacaugguuucuucccuggcacauaagucugagguagaggcugaggcuggaucugccccagcuggacacgcugucccccaccucuggcugacccggcccucagcaggagccaggggccgcucugguaucuguugcagucuggcuggggaagagagggagcuucaggagcucagcuucagucugcaagaguaucccuuucuccaaaggcucauuuagguuucccuagccuuaaccaccugcagauuuuuccaguucaccucucugcccuuccucugccccugggccuauggaaagggagcagaagugcacucaagccacucaagcggagaagcugagaacaaaggaaggaaagcgcccugcguggaggucaggccggggccuggucugaaucacuccucucuccaggaagaacaugggggcaagcaggugagugaagcccaagugcugcggggaaggagggaggcacagggcuaugcggaagggguuuggaauagggaagcaugaggcgccucccuucuccagccccucaagcaauagagauugcauaggauguccuggguuaccccagcaaggcacaugugcaaagugguuucacugccuuugaggaauguggcauggcccagaugguggcucucuggacaguuccacuggucuggacaaccuugcccuuuuggaaaaacuuccuucguguuucuccagacagagccaaggcccacaccaagcacagugcccgguggauccaaguccugucaagauucuccccucccucagccucucagcgucccgguaauacagcuaauagcuguaauuaauaggugcaaugcauuuccacuggccagcuggaugggcaggaggcccagcuugagucagcauggguagguaggcugguuauuuaauaacccgauuuccagcaucauuuacacacccacucugguggaguauauauaguuagcagagagcaaccuccaggauauauauagagccaagacacaacuacuauauuucuagaucuauccccugcagcuaucucuggaucccuccugugacaaaccuagagagagacggggauccaaucugggacuuagguggccuggguucuauuccuggcucugaugcuaacaugcugugucauccuaagcaaguggcuacaucucucugggccuucauuaccucauuucaguguaccaggagauuaggcaagauuuaacacuaagaccccaaaccuaaggggcuggaauccuaacuugauccggaaggagggagggagggcagguggauucccguguaaucaguuauugucacacgugcacuucucuugcuggggauauaagucaaggguaugaucaacaaagcagucccaugauuauugaaaaauacauggggagaaauugacaggcacaacaaggcuaaucugggaaggaacucccaacuaaaacaagccaggcagguagcagccccacaaacaggucaaggugcagcucagggucucuggccccagagugcaucgauccccuuuccuuuucaccccacuuccuuuucaaugacuguucuuucuuaaaaacagcagaauauacccccuuaaaugacccguuccuccccaggguccuuuggggaauuuaagaaaauccuggcuuuuuuugcucagcuugucacuguagggaaggauggggagugaggucacaggaaccagaaccuacacaucagaggaaaggagagcuaaugaagcuggccaggagcugggcuaggggcuguagccuggcucccgagagguguucgagggcuggcugccucagugggauuccuggguccuuguaucuaagaguagaaaguaucauaaacagggccugguuauucugcucagaucuuugcucuaaagugcucugguuauccuuccucuucucuaacagggucucuaaaaggguccucacuguaaggugcacaacuccaugccccggaggcugccugggcucugucugcagcaugcagauugccgggccagccccugaaguggggggacauggggcagagaauuccaacccauuuccguaucccugcccgcugugaaccccacuccucccucagaguccccagcagcagguaccuggggagucccucugccaggcuguggucucugcuccucucugcuuugcucgagcaggaguccugucgacucucuucccugacuuuaccccuucacccuuggcagagggcuccaguaccagcuggaggcucccugaagucagguccccuugcugcgucuauuugagggggaggagucuggacuagcaccuggguccacuccccacucaucagagcucaucaugggaacuccccucccauccucccccuccuuuuccaugcccauaguccaggagggacuaaggaauggaaaaacagcccccagaaaaacagaagcccagaauaggauggagaggcaggguggacacuggacaaaccuccugcuaccacacaguuggcugcaucugacugcaagcuguuggcccuggcuucuuccccauccuccucucuggcuuuuucccagcucagguccaagaugguuuacggucugggggcacagacgaugcccugcccagccagcuuugugggagccaagcagaagagaugccaauccauagagcauccguccucccccaccacuaggagguuccucggccucccugcugauccuuucccuuggccugacccccacaucucucugugccagauacucuccugggguccuccaacccuugcaccucuggcaaaaauggggcagugagucagagacagcaugaacauguggaagaaccaagagaaagaggagacucagagcaggccagaaaguaagauaaagagaaauccagggccccaggcuugcagaccacaaacuccuaggugucucgaauuuuggcaauguccuucaucagagugggcggcagcggggguggaaggcuaggaagcuauuuaaaagugcuggggcaugccagcaauucucugauaaacaagaagagggauauugcgccccccacgacccaucccuucaucucccaaggcagagagcagaggcacucucagcaaggcaacccccaccuuaacuccccgccaccccccaccccagguaaagggcaaaagagaagugacccaguaaggagggugugcccucgacgccucuagaacaaagcugagcccuccgcccccuccccggcucccuuagcaccgcgucucaguaauuaaaauaugaauucaccuucc

SEQ ID NO: 12846 - RNA, 1710 nt, Homo sapiens
caggugcuucagaccguggccaaacauggagcccucugacagcugcuggauuuucuuaagggggagagaugaagaacccuggugaguggaaagcucuugauugccuagucaguaggagggugaaggugaagggucuguccuugguagacuggcauagcuaaugcagccaucugaaccuggaagaucucuguggauggcccgucgugcauaaagggucaguuugcgaaaagguggcaacccagacccauccuuucauuccgaaagaagugugcccccacgguuuuccacgggacauuccuaaucaaaaugaagguucagaguuucuaggaaugaugcucucagggcuucagucuggggcuuaauggcauacacagguagcacuuggcucaugggguuguaucccucuagauugauccccacccccaguccuucccuccuuccaaguuagacgacccuucaagcuguacuaguucuuucaggccaccaagcaucgauuuccaaaguugccuaauuccaacauucccccaguaaaaucagggucauacaaucaaguuauacuguuguagcagacacugcuaauugccuacccaauaucuauuuuucuuucuuaccaaccaaacugcaaggacuuaacucaccuugcuaaaaauuccugcuucaucagacuccccuugcagcuaggaguagccacaugacacaguuugggccaacgaaaagcaaggugagagcuucugggagcacuuuugcuuuccugauaaaggcacuggcccuucccaaaucuucccaucuggaaugggaacguagugccuggagaugcaguggccauucugcaaccacaagaugacaugguugacgaugagggucugcacacagaugguggagcccaagggacaggccugggaacuugaaggucuauggagccaccaaaccaguugugaacaucuauccugggauucuuguugcaugaaauaaacccaucuuugucuacacaacucuaguaugauuuucuguuauuugcaaccaauuucauuccugauaugguuggcaaugaaauaaacuuuacuucuaugagcaaaccuugugacauaguaaugugaccaauucuuuagcauacacaucagaacaagcuauccaaaugagugucuuuccccuuagauccaaagcauagaggcacugcaacccggugccgcccaggccacagccuuuccucuuagcccuguugcugagauucuccagcugcucuuccggcaagacugcucacagaggggcagcuggauggccugccagggcgagcaacugugguauaauuccagacagcugcuucugucaggggacggcuuauccggccagguugagcccucuaugagagcuuuggagcuguuggaaggaggggugagacuuggaggaccaggagacaccucacauucugcagcuccuuagaggaaaacucagggcccagccauuugggacucaaugagccauagcaggauuuccugugaggaacaacccacaaucuuaccaggcugccucagucauuuaaaaaauguuccaaaaaauuacacagacuggauuuucuuuuuuuuuuucccuagaaacaaacuuacagagcagaaaaucuagaccauauagaaaccaagaaaaagcaaccugacauccucuaaaugagcugaccccacucuuagguuacuuuacaacucagccuugaguuug

SEQ ID NO: 12847 - RNA, 1710 nt, Homo sapiens
caaacucaaggcugaguuguaaaguaaccuaagaguggggucagcucauuuagaggaugucagguugcuuuuucuugguuucuauauggucuagauuuucugcucuguaaguuuguuucuagggaaaaaaaaaaagaaaauccagucuguguaauuuuuuggaacauuuuuuaaaugacugaggcagccugguaagauuguggguuguuccucacaggaaauccugcuauggcucauugagucccaaauggcugggcccugaguuuuccucuaaggagcugcagaaugugaggugucuccugguccuccaagucucaccccuccuuccaacagcuccaaagcucucauagagggcucaaccuggccggauaagccguccccugacagaagcagcugucuggaauuauaccacaguugcucgcccuggcaggccauccagcugccccucugugagcagucuugccggaagagcagcuggagaaucucagcaacagggcuaagaggaaaggcuguggccugggcggcaccggguugcagugccucuaugcuuuggaucuaaggggaaagacacucauuuggauagcuuguucugauguguaugcuaaagaauuggucacauuacuaugucacaagguuugcucauagaaguaaaguuuauuucauugccaaccauaucaggaaugaaauugguugcaaauaacagaaaaucauacuagaguuguguagacaaagauggguuuauuucaugcaacaagaaucccaggauagauguucacaacugguuugguggcuccauagaccuucaaguucccaggccugucccuugggcuccaccaucugugugcagacccucaucgucaaccaugucaucuugugguugcagaauggccacugcaucuccaggcacuacguucccauuccagaugggaagauuugggaagggccagugccuuuaucaggaaagcaaaagugcucccagaagcucucaccuugcuuuucguuggcccaaacugugucauguggcuacuccuagcugcaaggggagucugaugaagcaggaauuuuuagcaaggugaguuaaguccuugcaguuugguugguaagaaagaaaaauagauauuggguaggcaauuagcagugucugcuacaacaguauaacuugauuguaugacccugauuuuacugggggaauguuggaauuaggcaacuuuggaaaucgaugcuugguggccugaaagaacuaguacagcuugaagggucgucuaacuuggaaggagggaaggacuggggguggggaucaaucuagagggauacaaccccaugagccaagugcuaccuguguaugccauuaagccccagacugaagcccugagagcaucauuccuagaaacucugaaccuucauuuugauuaggaaugucccguggaaaaccgugggggcacacuucuuucggaaugaaaggaugggucuggguugccaccuuuucgcaaacugacccuuuaugcacgacgggccauccacagagaucuuccagguucagauggcugcauuagcuaugccagucuaccaaggacagacccuucaccuucacccuccuacugacuaggcaaucaagagcuuuccacucaccaggguucuucaucucucccccuuaagaaaauccagcagcugucagagggcuccauguuuggccacggucugaagcaccug

SEQ ID NO: 12848 - RNA, 2607 nt, Homo sapiens
cagcuuuaaaauuuauuaaaugcucguugucuccuaaagauaagauguuucacaaagucuauguaagucuuugauuuuaaugucaaauuugagggucuacuuauuaaucuuaugugauugagaacuccaucuuugacaucauagcuguuucauagcaaccuugaccuacgugaauaaugagcucuauucuguaggauaaagggaguaggccaagagucagggagcaucaugcauccucucacucaaaauauaucuucaguauccuugggaaggaagagugccuaaaagggggagaggagcugccuuuaacacaaccuuaaacauucugauuugaaaaggucaucuuggcccuugucuuuaugaauuuccauuucuauuuaaaauuccuuacacauugaacaguguuucacacuuuacaaaguguucucacauacaguauaucauucagugcucuaagugaccuuccucagauaggcaaggaggucuuaaguuacaaaggaggaaacagaaauucaggaaggguaaguuacuugccuccuaguccagaguucuuaauccuuuuuauaggaaguuuaggaacauuaaaauaauucaaguuaaucuuccuuuuuuuagacuuuaguauuuguuuuauuuggugacauuuaacuggggcuuuugaaacccuuaauuuagauccuaguuuauagaggggaaggggaagggugaggaagaguguaacuucacuaugcauuugagguaaucuggaaauuuacuucaguuucugaagucuuuucuucuuugucuucccaagagguggauuuaaagucauuaagagaacacgaaaacggccagcgcgguggcucaugccuguaaucccagcacuuuggggggcugaggugggugaauugcuugaacccaggaguuggagacaagccucgacaacauggugaaaccccguaucuacaaaaaauagaaaaauuagccaggugugauagccugcaccuguagucccagcuaccuaggaggcugagguggcaggaucacuugagccuaggagguugaggcugcagugagcugugaucauguuacugcacuccagccuggguugacagugaggcccugccucaaaaaaaaaaaaaaaaaaaaaaagcgugaagacuaguagguaaggugguuauuuuauuaacaacgauaguuaguaaagcaacaccauugugauuuuuuuccugccuuguggccucaccuguuuauaaggacuggacuuuuauuuauuaaguuguguuguuuuauugacaauacaugcaucauaucuuuugacuuugaaggauaucucaugucaaaggaaucaaguuaugauuuauagaggauucagcuggaauaccuugugggugcuggcugaggguggcaaaacgccuaccgagacaugaagguuuuagccacuaguuuuguccuugggagccugggguuggccuucuaccugccuuugguggugacuacaccuaaaacacuggccaucccugagaagcugcaagaagcuguggggaaaguuaucaucaaugccacaaccuguacugucaccuguggccuuggcuauaaggaggagaccgucugugaggugggcccugauggagugagaaggaaaugucagacucggcgcuuagaaugucugaccaacuggaucugugggaugcuccauuucaccauucucauuggcaaggaauuugagcuuagcugucugaguucagacaucuuggaguuuggacaggaagcuuuccgguucaccuggagacuugcucgaggugucaucuccacugacgaugaggucuucaaacccuuucaagccaacucccacuuugugaaguuuaaauaugcucaggaguaugacucugggacauaucgcugugaugugcagcugguaaaaaacuugagacucgucaagaggcucuauuuuggguugaggguccuuccuccuaacuuggugaaucugaauuuccaucagucacuuacugaggaucagaaguuaauagaugagggauuggaaguuaaucuggacagcuacuccaagccucaccacccaaaguggaaaaagaagguggcgucagccuugggaauaggaauugccauuggagugguugguggcguguuggugaggauuguccucugugcgcuaagggggggccugcagcagugacagcuucaagaacuuaacagccuugcuccugaagaacuggcugcccaggaagccaagcuagcuuuuuaggggaguguuccagcugcugguaguggaucagcuuagagggaacacucccacagccaaaagaaugagugggagaaauggaggggacaaucuccugggagcuaugcgcaguaaccuaacuuccuuaugucccauggaucucuuccugaucuucccugcccauuggguacccaggaaacugcaagcauugccuguguuccugggaagaguucuaagaagcuugcauucauuuucuacccuuuaugacuuggaugccuccccaccuccauuuccccucuucugagcuguguauucauguagagggauguauucagccuuuuuagugaacauuuuuuuucaauaaaaguaauucacaguagcuguaugga

SEQ ID NO: 12849 - RNA, 1779 nt, Homo sapiens
auauauauacuuucaaaguaugucaaaaguuuuuggagagcagaaggacuucuaagaucugugugcacuggagagcucccugugcagccacuuuuauuuuuagaggcugcccucuuuuuuuuuuuuaacucaggauaauuugugacuuuauugucaggacuucaguuuuaaaaccucuugaacuauauucucuugagaaccacagcugaugauuccuuucucugaaguuuugaagcaugcuuuguagaagucugacuuuguauucucaccuuuucauucccuggauccuaucaacucuaaaauucuguaguggcuuccucuggaggcucugaucacuccccucaacaaucaguucucuuuuguuggucagaauuaaguccagaacagcuuuuguccaugggcuuucuuugcuuuugagcuuagaugucagcugggcaagucaggaacucaucagaggcuuaacgcugagcucagcccugcaccaagcaagugccuagauggcaggagucgccccucacugcuuccuaaucugcaugccuauuuuacagcaucgaugagaaaacauggucuccauggucuccuucuagccaagugggccaugucauucucauacacaauguccucccaagccauucuccuuuauccucauccaaaugcugcuucugccucuuauugaccuuccguggcccuguuacagacaugaaucaguacccccacccuccaccuccaccacauacuccaaaccuuuguguuucccucaguuccuuuaucuacagcccccagccaaagaacccuccgccugguuguagaaauuuccagucaccauaguuuccuacucccaccuucagugccacugcacacuuaaagagaccugguuuguguugcuucuggaugucucagagcucugaaagagccauuguuugaaaauggcaacuuccuucaugacagaacacuaguagguugggagaacgcuaaggagcuauuccucaacuuuuaguugccacccuuaugaaucaaaagggccaggcugccagccugcaaggaaggaagaaagacccagacucaaccuaugugaaaaggaucauguguggucuauuuuggaggauggcuaaguucauugauagugaccuucucacuugcucuuaguaauagcucaguaaguuaggcccaacagauauuaucauccucauuuuuauagguaaagagacugaggcuugaaauauuuaaauaacuuacgaaggucacacgacuaauaagguuagagcuggaguuagaacccagguccucucacuccgaauucccaugcccuguucaguuaccgcacuaccuucuacauaaagaacaagcauguggaugguguguacuccucucagggguguguaacacucaacagaaacaaucaggggcuaacuacagaggauaaagaagagauggcaucgcuuacgccacuggggauuauaggagcugcguguguggcaggcaggagcaagagcccacaggguggucccaggaugcauggggguggcacugagcuaggcagaggagccacagcugagugugugcuucaccauuccaaagcucuaagaccauugaucgguaaaauccaagcucucucagcugaagccagccucaaggagacaucugguuuaggccccuaccuucuaauggcucaaauaccauuaccucuauucauuuuacagugagugauggaggaggaacuagaacccaggucuccugacucagggaagggcugaauuaaggaucacuggaagacaggug

SEQ ID NO: 12850 - RNA, 647 nt, Homo sapiens
caagagaaagcccuaccacaagaagcggaaguaugaguuggggcacccagcugccaacaccaagacuggcccccgccgcauccacacaguccguguguggggagguaacaagaaauacugugcccugaggcuggacgugaggaauuucuccuggggcucagaauguugugcucauaaaacaacgaucaucgauguugucuacaaugcaucuaauaacgagcugguucgucccaagacccuggugaagaauugcauugugcucauugacagcacacuguaccgacagugguacgagucccacuaugcgccgccccugggcugcaagaagggagccaagcugacuccugaggaagaagagauuuugaacaaaaagcgaucuaaaaaaauucagaagaaauaucaugaaaggaaaaagaaugccaaaaucagcagucuccugggggagcaguuccagcagggcaagcuucuugcaugcauugcuucaaggccaggacaguguggcugagcagauggguaugugcuagagggcaaagaguuggaguucuaucuuaggaaaaucaaggcccggaagggcaaauaaauccuuguuuugucuucacccauguaauaaagguguuuauuguuuuguuccaaaaaaaaaagagaaa

SEQ ID NO: 12851 - RNA, 8670 nt, Homo sapiens
cgaguaaggaagccgacagggaaaucuggcaaaaccaaucggcggccacacggaagugggcggaaaggcccgccccccggggauuuugcgagugacguugggcggcgcggcgcuagggacguagacgcccaacaguccugcgucucuuccggcgucuagggggguguccugccggcgcgcgggcccugcggccauuuugggcuucgcuuccaccgcaccagccggccuacccaguccuuccgguaucgcguugcucaggggcuuuucaacccucugucagucggaaaaccaucgccgaggccguggggggacuccuauccaugguguugaagcgucgagccgacuagggaaccuccuuccccgccaggauggaagucgcaucagucgccgccuauugcgcgggcuguucuucccuguguucugccgcccgcugccgcauucgcugcccucuguggcuuuucugcuggcucgaagaucggccuggagcagcgacgccaccgcugggcaaggccgagacucuguaggcuuccuccgaaucccgucgaccuccagccgcugagcgccgcggcccuaccugagagacugucaagaaaaaggagauggagccggggacaggcggaucgcggaaacggcuuggcccucgggcgggcuuccgguucuggccacccuuuuucccucggcgaucgcaagcaggcucuucuaaguucccgacgccucuuggcccggaaaacuccgggaaccccacacugcuuuccucugcccagcccgagacucgggucaguuacuggacgaaacugcucucccagcuccuugcgccgcuccccggauugcuucagaaggugcuaauuuggagccaacuuuucgguggaauguuuccgaccagauggcuagauuuugcuggagucuacagcgcccugagagcccugaagggacgggagaaaccagccgcccccacagcgcagaaaucuuugaguucgcugcagcucgacuccucagaccccucggucaccaguccccuugauuggcuagaggaggggauccacuggcaauacucgcccccagaccuaaaauuggagcuuaaggccaagggaagugcuuuggacccugcagcacaggcuuuucucuuagagcagcagcuguggggaguggagcuguugcccaguagccuucaaucccgucuguacucuaaccgggaacuuggcucuucgcccucugggccucuaaacauucaacgcauagacaauuucagugugguauccuauuugcugaacccuuccuaccuggacugcuuuccuaggcuagaagucagcuaucagaacagugauggaaauagcgagguagucggcuuccagacacuaaccccagagagcagcugccugagagaggaccauugucauccccagccgcugagugcagaacucauuccggccucguggcagggauguccaccucuuucuacggaaggccuaccagaaauucaccaucuucgcaugaaacggcuggaauuccuucaacaggcuaacaaggggcaagauuuacccaccccugaccaggauaauggcuaccacagccuggaggaggaacacagccuucuccggauggauccaaaacacugcagagauaacccaacacaguuuguuccugcugcuggagacauuccuggaaacacccaggaauccacugaagaaaaaauagaauuauuaacuacagagguuccacuugcuuuggaagaagagagcccuucugagggcuguccaucuagugagauaccuauggaaaaggagccuggagagggccgaauaaguguaguugauuacucauaccuagaaggugaccuucccauuucugccagaccagcuuguaguaacaaacugauagauuauauuuugggaggugcauccagugaccuggaaacaaguucugauccagaaggugaggauugggaugaggaagcugaggaugaugguuuugauagugauagcucacugucagacucagaccuugaacaagacccugaagggcuucaccuuuggaacucuuucugcaguguagauccuuauaauccccagaacuuuacagcaacaauucagacugcugccagaauuguuccugaagagccuucugauucagagaaggauuugucuggcaagucugaucuagagaauuccucccagucuggaagccuuccugagaccccugagcauaguucuggggaggaagaugacugggaaucuagugcagaugaagcagagagucucaaacuguggaacucauucuguaauucugaugaccccuacaacccuuuaaauuuuaaggcuccuuuucaaacaucaggggaaaaugagaaaggcugucgugacucaaagaccccaucugaguccauuguggccauuucugagugucacaccuuacuuucuuguaaggugcagcuguuggggagccaagaaagugaauguccagacucgguacagcgugacguucuuucuggaggaagacacacacaugucaaaagaaaaaagguuuguuucuugucuuuuaacaugccugauauguucugacuguuuuuauaugcuuaaauauagcagcaugacuuuggaggcuuaggagugcauguauuuuugaggaaggccucuaaauucauauacuuggauugagaaauauguaaaugacccuucuccuccugucccucaccccccaccccaaugcacauuguugcuguccaaaacgaacauaccaguguguagauguuagcaggaaagugccauuuuuauuuggguugguaguucuggacuguuuccuuacaagcuucaauuuuucacacuuuuuaacggacuauuaaacuuuguguguacacgauuuaauuuuucuagagauugaaaagguccuguuacagccauagaguuuuaaaaugauuuuaaauguauguugucugcaaauacuuaauauuuuuuuugcauauaacaagagugucuucauuccuguccauuacaacccaaagggaugaugauaucaaguagcaagucagauuuaucugguccaauuggccaugaaauuaaauaguaauuucacugguuuugacauuacaugguuuuaauugaaagucaaagccaguacaggaagugguauugccuuuucuuaggaaugcaaugcuaguuaucaguggucagcuacagguuaauauuaauaauaaacagugauggccacuuacuugguuuaucuugacuaguugcuuccuuuucccaggcuagucuuaaaacuucaugcagcauuuuacgcuuuaauuacauugucagguuaaccuuauuuugggagucuuuagaguugguuuguuuuucuuuauaguugauucaacuaaaguuauuaauugaacucuucuccaaacucaaaggugucuauuauuguagagggaacguuuuuuuaguuuucuauaccguuacuuggagagagaaguuagugggugaguuauuauugaccucagauucugccucacuggggcguuucaaauggacaguaccauaaucucuuggcuccacauggccagcuuacuacuuugaaauuauuccuggguagaaaaugucucaaaauggugauaaucuuacgucuuaccuuuagggcagaauaagucauguuaaagauuaaauuuuaguucacacuuuguaaaugccaucucucuuuguccuuuuaaggggccccugacaaaaugaccuauuuagaaugaauagguaagaaacaaaguggggcaauggaaugagcacuuggcagcuggagcccuguguucucuacuccucagugguuaaggcgcagagauuuggaaggcagccagaccugggaaguugcuugacucucauggccucaauucacucuuacuugauggguaaaauaauaauaucuauuguacaaguuauugcaagauuuaaaugagacaaguaaauaaaacucagaauuuauugccuugccuuuaaaugcuagcucuuauugagagaccucaggccagucucaugucuuguuuuagcuugcucguugaguaaaaugaaaugaguggaguagaugauacuauugacuaugaacuagaagcagaauuuauaaaugauuaugucugaauaugauauaauuauuugacagccuuugacuaccugccauugguauauauggggaaugguguauggaauauauggaguauauaggaugauggacagugagucuaaaaaacccuucuaccucuguuuucuuaucgguauaauggggaugauaauaguccauaccucauaggguuaaugugaggauuagaugagauaaaaauguaaagcucuuuaaaaaaagccugguauaugguaaacacuguacguuuuuauuauuuaucuuaaugacacaaugaaugaguaguauucaagacuagaaugcaauaacuaguaagguguuacauaccugcuaauuguccucaggggcaucccuuggcuugauguaaagggaacgaaaguaguaggccacauugggguuagcugauguaacuauuaaacauacuugaaagcaaguauuuacuuuuggaguuugauaucuuagaaagaaacuucauuagaaauuaaguagugauuaguaaugaguagggauugucacucauuacaugucauuauguauauuagaaucacaauuucauauauagugauagcauauugaauacaaagguuuuuaaaaucuuaacuacaaaguuucuuagaguaacacagcuuuaaaaauacuaauuuugcuauacuuuguuuacuaaguaacuuuuucucuucuguauuguuauugccaaaguaaugauacaaaaauaguacaacauguugauuuaaaaguuggaaagugaaaaaaauuuuuaaaaggaaaaagaauagaaguaagcaaaaauauuguuaaagccuuuaugcagugauaaaaacagugacuuccagggauauagugguuauuuucagaaauauuuugcuugucauuuugagggaaaaauaucacagaacuguauuucccuaaggauuaaaaaauagcagggguuaauaacagcaugaaaaauucaauucccuaucuggauucauuuuauuaacaccaaaagccaagggcuggugggggauuggggggggcagacgacuguguguguauauuaugcagauauagauaaaugaaguauauauagaugaaagauauauaucucuauaugaaauauuuaggugacauuuguucacuauuuuauccaaaugccaucuaaucugaacuuuuuuuuuuuugagacagaguuuugcucuuguugcacaggcuagaguguaguggcgcgauauuggcucacugcaaccuccaccucccagguucaaacuguucuccuaccucagccuccugcguagcugggauuacaggcaugugccaccacgccuggcuaauuuuuucguauuuuuacuagagacaggguuucacuguguuggucaggcuggucuugaacuccugaccucaggugauccgccugcuuccgccucccaaaaugcugggauuacaggcgugacagaacuuuuuuuuuaacuucaaauauagcugggaccaaauauuccuaauaauaauauguuauucuuaguugggaauauucugaaagaauugguagcauaaaggguuauugaccucaaugcugauuguaagauccuagacaguuauuaaaauuagucuuuguuuuuguagguaaccuuccuugaagaaguuacugaguauuauauaaguggugaugaggaucgcaaaggaccaugggaagaauuugcaagggauggaugcagguuccagaaacgaauucaagaaacagaagaugcuauuggauauugcuugacauuugaacacagagaaagaauguuuaauagacuccagggaacaugcuucaaaggacuuaauguucucaagcaauguugaguuggcagccuguaguccuagcuagcauacacuaccucuuaccugagaggugucuuuuaaaaacaaaucuuggcagcuguccuuugacauuuuuuuuuuuagaggaaauguaacuuggaucuaguuuaauuuuuuuuuuugcaacauaucccacucagaaacauucagguuugaagccagcccugauaaugaaggaugaacuagugugauuucuaauccucccuuuuuugauuuaguuggaugugcuuuuaaauguccuuugccugcaugagguggaaaggggaccuuuuugaguugucauuuugcacuuucaaaacuuauuuucuuggaaaacaauauuuauagggcuuaaagcccauuuucauuucuaaucuaaauuaugugugccuaucugaaaacuuugggcucuuucuuguuucuuucccaaaauucagaaguuaaugggcuuuuauguuuuucuauauuuuuuuuauuucaaugauuuggccugucuauguuaggcuaaaaaauaaccuuguguaugcuaccaacuuaaagugcauuauuuugugucacuuuuuuuuuucuuguaaaaaugacuuggauugaaaauaugugguagccuuuuuauuucuacauuaaguucuaccuaggauauuuccaaggacugccacaaaacccauaugugcaguacuuuacuacuuugggaaagcugcaucuuucuaccacauuuuaacaucuaauauauuuaauuucuuugaagaggguucuguguacguuauuguaguucccaguuuaauauaguucuuuguaucucuuaacagguugaaguuauugcaaaacacucuggaaaguaauaauuacaucauaaucauuuauuuuuuaaacuuaaaagccuagaaauuuccuagaaagaaaauaggagacaucucagagcaauuugguuuugguguauauguucucaacagaaaaccaguguuaaugaauaucaugccucagcacugucacuuuuaaaaccugucaggaucccacuguaaaauuggaaaugggcaguucugaauuuucacguuugaaauguaaaauauaaacuucagucaauauccagguuuauuguguccuacuauuuaauaaugagagaaguaauggcaaggccuuuacuuucaggaaaggauagaaguauagauuaaugacuggaaaguuuuaauauauuuagcccaaagguuacuuugaauugaagucuuugcauugacuguuuguguuugguuuauuuguuuagcuuuacaagguacacauaaguuagguugagggguuguuaacccuuccguggucugcuuucauuccgugugcuuccugucacagguaauggaaaacauaaguagaauaggugaccucuuaguuuugaacuuauuuaaguguggggaugaauuuuucaucagaagugcuuacaggguuacuaccucaguuuacaaucuaccuggucauuauuuuauuucuauccaguucuaagaacugccuccacuguuuauauauucauaauuaaacacauugagaaugcaacacuauaaaagcuggucaaauuuuugcagagcccuuauucuguguguuuuuuguuuuuuucuuuuuuuuuugagacagagucucguucggucccccagcuuggagugcaguggcgcgaucucggcucacugcaaccuccgccuccuggguucacgcgauucuccugccucagccucccgaguagcugggauuacaggcacacaccaccacgcccggcuaauuuuuugugucuuuuuaguagagacgggguuucgcuauguuggccagacuggucuugaacugcugaccucgugauccgcccgccucggccucucaaagugcugggauucuguguguuuugugcaccuccacuuuagguaaucauagggagcacauuuacaggauggucuaauaacaugaaaacaggcuaguuucaagcaacagcaaugucgguuggaaagcaggcgucauuugccuugaaaaaagccuuuugacaacauacaggcauucuuuuaaaaccaggcugaaacauuuuauuuccgagacuuaacguuguguuuccuguuucuuaaaccuagcaccucuguguauuugaaaauaaugagacaucuuucauuggauuuuggaaaauuguuccccaugggauucuaaccucacuaccaaaugagugaaagcuugauuaagaguucuuccauauacuagccuccuuggaagaagugaucagaaggugauaagaaggacagaaaggacuauuuuaaaguuggacugaaggagaaaaaagcaaaauucuuguuucaucccaauucuaguuagaacaaaguuaaacccccguaaucuuaaagagaaaaucuuuggagguuuuaauuaaacauuuuauacauuuaaagucuuguuaauggugcuuuaagugucaauguagcauguaaaaggcuuuguacagacagguaaaaguuccauuucugagugaugaaauguaacacuucuucaucuuuaacuugaaaucaaaacuaucagauuuuauuuuuguauaauuuaaggaagguaaaguuaggggacuagaagacucuaaauuggcuucuacagaucaauaauuuaaauguaacuaguugggauuuuauaguuaaaauuauauuuguguauauaacauaacuaaucuguaaauuguaauaaauauauuugcaauuauuaaauguuaagugauauuuugguucaacuuuauauuauauguaucauagu

SEQ ID NO: 12852 - RNA, 8670 nt, Homo sapiens
acuaugauacauauaauauaaaguugaaccaaaauaucacuuaacauuuaauaauugcaaauauauuuauuacaauuuacagauuaguuauguuauauacacaaauauaauuuuaacuauaaaaucccaacuaguuacauuuaaauuauugaucuguagaagccaauuuagagucuucuaguccccuaacuuuaccuuccuuaaauuauacaaaaauaaaaucugauaguuuugauuucaaguuaaagaugaagaaguguuacauuucaucacucagaaauggaacuuuuaccugucuguacaaagccuuuuacaugcuacauugacacuuaaagcaccauuaacaagacuuuaaauguauaaaauguuuaauuaaaaccuccaaagauuuucucuuuaagauuacggggguuuaacuuuguucuaacuagaauugggaugaaacaagaauuuugcuuuuuucuccuucaguccaacuuuaaaauaguccuuucuguccuucuuaucaccuucugaucacuucuuccaaggaggcuaguauauggaagaacucuuaaucaagcuuucacucauuugguagugagguuagaaucccauggggaacaauuuuccaaaauccaaugaaagaugucucauuauuuucaaauacacagaggugcuagguuuaagaaacaggaaacacaacguuaagucucggaaauaaaauguuucagccugguuuuaaaagaaugccuguauguugucaaaaggcuuuuuucaaggcaaaugacgccugcuuuccaaccgacauugcuguugcuugaaacuagccuguuuucauguuauuagaccauccuguaaaugugcucccuaugauuaccuaaaguggaggugcacaaaacacacagaaucccagcacuuugagaggccgaggcgggcggaucacgaggucagcaguucaagaccagucuggccaacauagcgaaaccccgucucuacuaaaaagacacaaaaaauuagccgggcgugguggugugugccuguaaucccagcuacucgggaggcugaggcaggagaaucgcgugaacccaggaggcggagguugcagugagccgagaucgcgccacugcacuccaagcugggggaccgaacgagacucugucucaaaaaaaaaagaaaaaaacaaaaaacacacagaauaagggcucugcaaaaauuugaccagcuuuuauaguguugcauucucaauguguuuaauuaugaauauauaaacaguggaggcaguucuuagaacuggauagaaauaaaauaaugaccagguagauuguaaacugagguaguaacccuguaagcacuucugaugaaaaauucauccccacacuuaaauaaguucaaaacuaagaggucaccuauucuacuuauguuuuccauuaccugugacaggaagcacacggaaugaaagcagaccacggaaggguuaacaaccccucaaccuaacuuauguguaccuuguaaagcuaaacaaauaaaccaaacacaaacagucaaugcaaagacuucaauucaaaguaaccuuugggcuaaauauauuaaaacuuuccagucauuaaucuauacuucuauccuuuccugaaaguaaaggccuugccauuacuucucucauuauuaaauaguaggacacaauaaaccuggauauugacugaaguuuauauuuuacauuucaaacgugaaaauucagaacugcccauuuccaauuuuacagugggauccugacagguuuuaaaagugacagugcugaggcaugauauucauuaacacugguuuucuguugagaacauauacaccaaaaccaaauugcucugagaugucuccuauuuucuuucuaggaaauuucuaggcuuuuaaguuuaaaaaauaaaugauuaugauguaauuauuacuuuccagaguguuuugcaauaacuucaaccuguuaagagauacaaagaacuauauuaaacugggaacuacaauaacguacacagaacccucuucaaagaaauuaaauauauuagauguuaaaaugugguagaaagaugcagcuuucccaaaguaguaaaguacugcacauauggguuuuguggcaguccuuggaaauauccuagguagaacuuaauguagaaauaaaaaggcuaccacauauuuucaauccaagucauuuuuacaagaaaaaaaaaagugacacaaaauaaugcacuuuaaguugguagcauacacaagguuauuuuuuagccuaacauagacaggccaaaucauugaaauaaaaaaaauauagaaaaacauaaaagcccauuaacuucugaauuuugggaaagaaacaagaaagagcccaaaguuuucagauaggcacacauaauuuagauuagaaaugaaaaugggcuuuaagcccuauaaauauuguuuuccaagaaaauaaguuuugaaagugcaaaaugacaacucaaaaagguccccuuuccaccucaugcaggcaaaggacauuuaaaagcacauccaacuaaaucaaaaaagggaggauuagaaaucacacuaguucauccuucauuaucagggcuggcuucaaaccugaauguuucugagugggauauguugcaaaaaaaaaaauuaaacuagauccaaguuacauuuccucuaaaaaaaaaaaugucaaaggacagcugccaagauuuguuuuuaaaagacaccucucagguaagagguaguguaugcuagcuaggacuacaggcugccaacucaacauugcuugagaacauuaaguccuuugaagcauguucccuggagucuauuaaacauucuuucucuguguucaaaugucaagcaauauccaauagcaucuucuguuucuugaauucguuucuggaaccugcauccaucccuugcaaauucuucccaugguccuuugcgauccucaucaccacuuauauaauacucaguaacuucuucaaggaagguuaccuacaaaaacaaagacuaauuuuaauaacugucuaggaucuuacaaucagcauugaggucaauaacccuuuaugcuaccaauucuuucagaauauucccaacuaagaauaacauauuauuauuaggaauauuuggucccagcuauauuugaaguuaaaaaaaaaguucugucacgccuguaaucccagcauuuugggaggcggaagcaggcggaucaccugaggucaggaguucaagaccagccugaccaacacagugaaacccugucucuaguaaaaauacgaaaaaauuagccaggcgugguggcacaugccuguaaucccagcuacgcaggaggcugagguaggagaacaguuugaaccugggagguggagguugcagugagccaauaucgcgccacuacacucuagccugugcaacaagagcaaaacucugucucaaaaaaaaaaaaguucagauuagauggcauuuggauaaaauagugaacaaaugucaccuaaauauuucauauagagauauauaucuuucaucuauauauacuucauuuaucuauaucugcauaauauacacacacagucgucugccccccccaaucccccaccagcccuuggcuuuugguguuaauaaaaugaauccagauagggaauugaauuuuucaugcuguuauuaaccccugcuauuuuuuaauccuuagggaaauacaguucugugauauuuuucccucaaaaugacaagcaaaauauuucugaaaauaaccacuauaucccuggaagucacuguuuuuaucacugcauaaaggcuuuaacaauauuuuugcuuacuucuauucuuuuuccuuuuaaaaauuuuuuucacuuuccaacuuuuaaaucaacauguuguacuauuuuuguaucauuacuuuggcaauaacaauacagaagagaaaaaguuacuuaguaaacaaaguauagcaaaauuaguauuuuuaaagcuguguuacucuaagaaacuuuguaguuaagauuuuaaaaaccuuuguauucaauaugcuaucacuauauaugaaauugugauucuaauauacauaaugacauguaaugagugacaaucccuacucauuacuaaucacuacuuaauuucuaaugaaguuucuuucuaagauaucaaacuccaaaaguaaauacuugcuuucaaguauguuuaauaguuacaucagcuaaccccaauguggccuacuacuuucguucccuuuacaucaagccaagggaugccccugaggacaauuagcagguauguaacaccuuacuaguuauugcauucuagucuugaauacuacucauucauugugucauuaagauaaauaauaaaaacguacaguguuuaccauauaccaggcuuuuuuuaaagagcuuuacauuuuuaucucaucuaauccucacauuaacccuaugagguauggacuauuaucauccccauuauaccgauaagaaaacagagguagaaggguuuuuuagacucacuguccaucauccuauauacuccauauauuccauacaccauuccccauauauaccaauggcagguagucaaaggcugucaaauaauuauaucauauucagacauaaucauuuauaaauucugcuucuaguucauagucaauaguaucaucuacuccacucauuucauuuuacucaacgagcaagcuaaaacaagacaugagacuggccugaggucucucaauaagagcuagcauuuaaaggcaaggcaauaaauucugaguuuuauuuacuugucucauuuaaaucuugcaauaacuuguacaauagauauuauuauuuuacccaucaaguaagagugaauugaggccaugagagucaagcaacuucccaggucuggcugccuuccaaaucucugcgccuuaaccacugaggaguagagaacacagggcuccagcugccaagugcucauuccauugccccacuuuguuucuuaccuauucauucuaaauaggucauuuugucaggggccccuuaaaaggacaaagagagauggcauuuacaaagugugaacuaaaauuuaaucuuuaacaugacuuauucugcccuaaagguaagacguaagauuaucaccauuuugagacauuuucuacccaggaauaauuucaaaguaguaagcuggccauguggagccaagagauuaugguacuguccauuugaaacgccccagugaggcagaaucugaggucaauaauaacucacccacuaacuucucucuccaaguaacgguauagaaaacuaaaaaaacguucccucuacaauaauagacaccuuugaguuuggagaagaguucaauuaauaacuuuaguugaaucaacuauaaagaaaaacaaaccaacucuaaagacucccaaaauaagguuaaccugacaauguaauuaaagcguaaaaugcugcaugaaguuuuaagacuagccugggaaaaggaagcaacuagucaagauaaaccaaguaaguggccaucacuguuuauuauuaauauuaaccuguagcugaccacugauaacuagcauugcauuccuaagaaaaggcaauaccacuuccuguacuggcuuugacuuucaauuaaaaccauguaaugucaaaaccagugaaauuacuauuuaauuucauggccaauuggaccagauaaaucugacuugcuacuugauaucaucaucccuuuggguuguaauggacaggaaugaagacacucuuguuauaugcaaaaaaaauauuaaguauuugcagacaacauacauuuaaaaucauuuuaaaacucuauggcuguaacaggaccuuuucaaucucuagaaaaauuaaaucguguacacacaaaguuuaauaguccguuaaaaagugugaaaaauugaagcuuguaaggaaacaguccagaacuaccaacccaaauaaaaauggcacuuuccugcuaacaucuacacacugguauguucguuuuggacagcaacaaugugcauugggguggggggugagggacaggaggagaagggucauuuacauauuucucaauccaaguauaugaauuuagaggccuuccucaaaaauacaugcacuccuaagccuccaaagucaugcugcuauauuuaagcauauaaaaacagucagaacauaucaggcauguuaaaagacaagaaacaaaccuuuuuucuuuugacaugugugugucuuccuccagaaagaacgucacgcuguaccgagucuggacauucacuuucuuggcuccccaacagcugcaccuuacaagaaaguaaggugugacacucagaaauggccacaauggacucagauggggucuuugagucacgacagccuuucucauuuuccccugauguuugaaaaggagccuuaaaauuuaaaggguuguaggggucaucagaauuacagaaugaguuccacaguuugagacucucugcuucaucugcacuagauucccagucaucuuccuccccagaacuaugcucaggggucucaggaaggcuuccagacugggaggaauucucuagaucagacuugccagacaaauccuucucugaaucagaaggcucuucaggaacaauucuggcagcagucugaauuguugcuguaaaguucuggggauuauaaggaucuacacugcagaaagaguuccaaaggugaagcccuucagggucuuguucaaggucugagucugacagugagcuaucacuaucaaaaccaucauccucagcuuccucaucccaauccucaccuucuggaucagaacuuguuuccaggucacuggaugcaccucccaaaauauaaucuaucaguuuguuacuacaagcuggucuggcagaaaugggaaggucaccuucuagguaugaguaaucaacuacacuuauucggcccucuccaggcuccuuuuccauagguaucucacuagauggacagcccucagaagggcucucuucuuccaaagcaaguggaaccucuguaguuaauaauucuauuuuuucuucaguggauuccuggguguuuccaggaaugucuccagcagcaggaacaaacuguguuggguuaucucugcaguguuuuggauccauccggagaaggcuguguuccuccuccaggcugugguagccauuauccuggucagggguggguaaaucuugccccuuguuagccuguugaaggaauuccagccguuucaugcgaagauggugaauuucugguaggccuuccguagaaagagguggacaucccugccacgaggccggaaugaguucugcacucagcggcuggggaugacaaugguccucucucaggcagcugcucucugggguuagugucuggaagccgacuaccucgcuauuuccaucacuguucugauagcugacuucuagccuaggaaagcaguccagguaggaaggguucagcaaauaggauaccacacugaaauugucuaugcguugaauguuuagaggcccagagggcgaagagccaaguucccgguuagaguacagacgggauugaaggcuacugggcaacagcuccacuccccacagcugcugcucuaagagaaaagccugugcugcaggguccaaagcacuucccuuggccuuaagcuccaauuuuaggucugggggcgaguauugccaguggauccccuccucuagccaaucaaggggacuggugaccgaggggucugaggagucgagcugcagcgaacucaaagauuucugcgcugugggggcggcugguuucucccgucccuucagggcucucagggcgcuguagacuccagcaaaaucuagccaucuggucggaaacauuccaccgaaaaguuggcuccaaauuagcaccuucugaagcaauccggggagcggcgcaaggagcugggagagcaguuucguccaguaacugacccgagucucgggcugggcagaggaaagcagugugggguucccggaguuuuccgggccaagaggcgucgggaacuuagaagagccugcuugcgaucgccgagggaaaaaggguggccagaaccggaagcccgcccgagggccaagccguuuccgcgauccgccuguccccggcuccaucuccuuuuucuugacagucucucagguagggccgcggcgcucagcggcuggaggucgacgggauucggaggaagccuacagagucucggccuugcccagcgguggcgucgcugcuccaggccgaucuucgagccagcagaaaagccacagagggcagcgaaugcggcagcgggcggcagaacacagggaagaacagcccgcgcaauaggcggcgacugaugcgacuuccauccuggcggggaaggagguucccuagucggcucgacgcuucaacaccauggauaggaguccccccacggccucggcgaugguuuuccgacugacagaggguugaaaagccccugagcaacgcgauaccggaaggacuggguaggccggcuggugcgguggaagcgaagcccaaaauggccgcagggcccgcgcgccggcaggacaccccccuagacgccggaagagacgcaggacuguugggcgucuacgucccuagcgccgcgccgcccaacgucacucgcaaaauccccggggggcgggccuuuccgcccacuuccguguggccgccgauugguuuugccagauuucccugucggcuuccuuacucg

SEQ ID NO: 12853 - RNA, 54708 nt, Homo sapiens
ccucuaggcuguccagucgccucgcagcagcgagccgcgagcgcccuucuccagucccggcuuggaacugaacugugugagcacggguccuggaacccgggcccagaaccggcgagcccaggucugagcccagagcucagcggucagccucguaggcccugacucggaaucgagccgaggcgcugagguuggagccggagagcgugagagccgaagagcagggagggcgggccggcugcgcguccgacgagucgcagagcaggaccgcggaaggcagggagacggccgcaagcccagggcagagggcagagggcagagagcggccuggcucggcggagagggcgccgcccggccggaaccaagcucgccgcccgggacggcgggccccguggggcgcggacccaggguggccguggguccgcagcgacuccccggccgacggcggggggcgugcccccucccagcccagccuccccaacccggcccgcccgccgcgucgcgggggcaugugagcgggaagccuaggcugccagccgcgaggaccgcacggaggaggagcaggagcgcggagccgcgagccccgagccccgagcccggcgccuggcugaguaguaagugcaccccuccccgccaugaucgcgccgucgcgcccauuuccccagcucucugaaguuugacacuugcgccccuacguuucugggcacccaccggcucucuucccugcgaguuuccacccugugcaaaguuuuucgaggagagacggacccucaccuacccccaacaacgcugggcaguggcggcuccucccuggccgacuuggguccuuguggagagggauggcagccucuaaggcagugcguggcuguguguguguuuguguguguguguguguguguguguacgcgcgcgcgcgcgcgcguucaccacgcgggucgagcuuagggugcacccccaacccgcuccucgccgaccgcagaggacuaggucuuucucaucagcccgacuaugcgccuaguuuaaggauuucucagcgggaagccgaagcgaccugcgcgcguccugcguggggcucaggugccugcgacgaggcgcagagcuccuccaccaugguugcguggggugcugggggacagacgcgcuccccuugccacgguuucagggucguuccccagcggaccagaccagcgcggcauccuguuuguuuucugcuccggcugcuccugucccacccccacccccaccgcaggcugcuucuugcuacccccaccucccgcccugggauaucguaggugagccuuuucaucccgauuccgcugcaaacgcugaucgcgccuagggguagggagaugcggagcggguagucguucaguucccagcggcucgccauuguuuucccaccccgcgcguuccguacguaaacacacacgcacacacaagguugugugugugcgccggcucuggcugcuucccguccccaggcgcgcagggaucgcccgcgggauucgcucagcugcccgcaugggucuucaggcuggaggcgcuccaggacuuaacuggagcuggagaggacaagagacguggggguugccggacaguaccgggcggggcggugagccgggccugggcgggaagugaauuuugaacuucagcccuggaccuuuccgggaggaccccgagcgcuggagcggcggcucccgcccuggagggcccgcggcagcugcaaagacuccgcuggcgcucuuggcagccgccucggugacagaggcuuggaggaagccgaagaguuuuccugggaaguuugcuuugacucucugggaauuuccgggcaggacgccucggcgcuggcgcuggcgcuggcgcuggugaaggggucuggccaaagacggccagagacgaugcugcuggcucuugaccacuaggcuguacuuggcucucagcaguccaaguaggugggucucuaccucccggaguucaugccuuccaaaccaguaucccccaaaggaucacgacaugccgguuucaaagaugggugcauaacucugcucguuuuggaguccagggaggcaagcucgguuccagccgggcggcgcucuccgucgagccaggccgcucucugcccucugcucucugcccugggcguggggcugucucccugccuaccgcgguugugcuuucggacucguccgacgcggcgccagcccgcuaccucccgcucucccucucccccgcucccuggcuccccggcucccugacuccguaaucugcgccucggcgcaguugcgagucagggccugaggcugaccccuguuuccacugugcuucauuagaaagcgcuucacaagaugcugggauucagcacauuuggauuccaguuccccaucgaugagcagcguggguuuggacuuccccgcaugcgaaaugggcagaguuaugcacccaacuuugaaacuggcaugucgugaucguuugggggauacugguuuggaaggcaugaucuccaggaggguagggacccaccuaccucuggaucauuaagggccaaauauagccuagugguuaagaguccuggagcuggaguuagaucccggaugccacuggcggugugacucugggcaauuuaacuuaaccucugugccucaguuuccucagccauaaaauaggguuaauaugaacgcuucaugggguugucuugaggauuaaaagacuuaauaaagugaaacugagaacagugccuggcacauaauaagugcuagguaaauaugagcuauuauugccauuauuacuuaacugaccuuguacagagcccagaagagcacuuggugauugugcucaacuaaucaauuauaacauugcccacuucuggagaggaggagaucuuguacucucucccacccuugccugauuccagccccucagaucaaacguauccuucuuacuccuugucuagugccaucuucucgagucuuuuuucuuuuucuuguuuccuuccuuucucccucccuucacaacuuuugugaaagcauuucauucccuccuuuccucauucuuaaaaaucaaucuuggcucaacugcaguguucucuccauggaaaucaggucccaggaaggaauugucuccaaaagggugucccuugagcguccucagccugggcugcuggaucaggauuggaugugcauuugugucucuggggcagggugaauuuccagagcaaagagccugucaggugucuggggcccaggggaagagucagguggaaugggcugggacugucccaggaggagcccugcucccuggguagugucugugucuccugcugcugggcucacuugggaaccuggaauagcacagcugcuuggguagacuggaugugggauuuggggugaggggcaaaagugucaccuccaacuuuccacuugcaguuggaggauuuucuaggaauuuggguuugucacaaguuccuugucugauucaggacucugcaaaugcauagcacagguaaggggcgagcugagcaaccaggaggaagaacagggugcugcugcccagccacacugccuuggacaacaggcuccuguccuccuuucucagacccuccaaccuccaccccaggcaugggggaggauggccagaagguugcuucuucauguuggagauccugcaauuggcaguuuuuagucauuaugacaacuggcacugcagucaccccauucauuccuucaacagaaauuguugaccaccugcuaugugccagggccugugcuacgcagugggauaacaggggagaacaagacaggcagcgugccugccuucaaagaggcuucuuucuauuguggggagacagacaguaaauacuuuuaaguaaccaagacuaucagauuaugacaugcaaugggaaagaaauaccacagggugaugugauagaaaacauauguaggucaggcagugguggcccuagauugggaggccagugaaggccacccugggggagaggauagcucagcccaggccuugaaggcugaggagccagcugcauaaagaccuggagacaggggauugcagguagagggaauagcaaaugaaagccccugaggccagaacaggggcaacagcuauguggcuggagaggagagacuggagaaaucagaggagagccaaagccugguaauacugguuagaagccuggauuuuauugcaggcgaugcauccaucagagaguuuuaagugggggagugacaugaucugcucuaugauuuuaaaagauuauuugggacacaagaaacgguaaucauaguugccccaagggagggaaaugguggcugagggaugggauggagaaaagauuguuuuugcuguagacccuuuuguccuuucugaauuuaguaccagguggguauacaaaccaucccccaaaaccucccaaaaacgugguuaacaaagaacaguuuauaaccuggaaaauuacauaagaagugaaaaaaucaggauauaaaacuacagaguacaaucuuaaucuuguacagagaauuguaaguauacacauggcuaucaugcacacacgcaaggacagaaucugggaggaugcaucagaauauuuacagagguuagcucuggauacuggacguauggaugguuuuaauuucuuucuuuaucuuccauuuguuuuuucacuuuucuacaauggucgugaauuacuuuuguuuguuuguuugcuuguuuguuuguuuguuuugagauagacucuuacucugucgcccagacuggagugcaguggugugaucuuggcucacugcaaccuccaccuccugaguucaagcaauucuccugccucagccucccgaguaacugggacuacaggugugugccaccacaccuggcuaauuuuuuuguauuuuuaguagagacggcguuucaccguguugguuuggcuggucucgaacuccugaccucaaauuaucccgcccuccucggccucucaaagugcugggauuacaggcaugagccacugcccccggccaauaccuuccucuuagaacuguugggaggcuaauggcugaugaugucugcggcagcagugcuccaugaaugguaagggcucugggguuuucuguugccagacaagugucgguugagcuaggccuauuccaccaagggaucuagguguccuugcccuugagaggcugacacuggauucuacaaagauuuucuccucucugggggugcuuugagaucgguccuuauugggcagcuccccuggguaagucuccaggaagcugacaccaccggaaaaaguggaauucaaaugcagcugugcuccugagcccccucccccagccacauucaggggugaagcugaguguuugaaaagggcucugugcugggagggccggccaggcacacaguaaaucgugcuuugaaugggaguuauuuuugugcccaguguuugcuuaagagggcucgcuccugccugaacucguugcgguccucacccuuugcuaguccccuuucuggaacccggaugugucagccagggaggccaucacagugccuuuuaccagauggggaacuagacccauggaggauugcuuucccucuccugucagcucccugccccgaagcaggaaggcaugcucuagaugguggucuuugccucggugacuaccccccuuuugacuggcccuuccuuaguucuugggaagacuugauucagagauugcuauaggccagcucagcaggguuccuccgaccucugucagcuucucugauaaagagugacugcuuuuuaaaaaaugcaaauacuuucucugaggagcagagauaugguaguucccuccuaagagcacuugcuguaugccauggacccagcuuaaagccccauggugaugaagccuuugcagcuccccuaggaaaagauuucugggccgggcacgguggcucacgccuguaaucccagcaguuugggaggccaaggcgggcggaucacgaggucaggagaucgagaccauccuggcuaagacggugaaacccugucucuacuagaaauacaaaaaauuagccgggcguggaggcgugugccuguagucccagcugcuggggagguugaggcaggagaauggcaugaacccggggccaagaucgagccacugcacuccagccugggugacggagcaagacuccgucucaaaaaacaaacaaacaaaaaaaagauuucuguccagccuguggugugguccacagcauagaacauuuuuuuuuuuuuuuuuuuugagacagagucuugcucugucgcccaggccugagugcaguggugcaaucuuggcucacugcaaccuccgccuucuggauucaaacaauucuccugccucagccuccugaguagcugggauuacaggcaugcgccaccacgcccggcuaauuuuuguauuuuuaggagaguugggguuucaccauguuggccauggcuggucucgaacccccgaccucaggugauccgcccaccucagccucccaaagugcugggauuacaggugagaaccaccgagccuggccucacagcauagaaccuuguagcuaccaccugcuacuccagguggcucucccgccuuaguggguggcaggggguccuuccugcuuuaggaaugcccugaggccugccucccugcucacuccuggcaagagcacauuguggugcugucagggaggaccuccauggucucagauggaacagcagcaguggucagaccuccuagaggcugugaggugaggaggaaguggcugagguuuccccugccuccuccuaaggucauccaugggcaaaccaaagcugcaggaugugcuguguguguggccugguaucucagaguccugggugugcacagggugugcacagcuaggagacgucccgagaucuguacccacauguugagggcuucagccagggguguuuuuugggggagcggaauuuguguggcauaguagaggaaaagaaggaagaaguggggacaguaucuccagcugccaccuuucuucccaaauagcuuuggauacccaggcccuuuuggucacaggaagucugacacugggaagucaucaaauuuggaauucaguucccuccacucuccccccagcgguggccuuagcauuuaaauagccuuggcaugaagcccuauaaacugcccaagggauuggggcaggguuagggggagggguauugguguuacccccaacauugucccccugugucuucuggggacauguccaagcuagggugucaguguuuuggcuugagaggagagaggggaaggggccacagacugggcaggagcccuccuggcuccccucccgcucuggugguuuugaucguaaucccugccugccaagccuggagcucccugggggauccgccccagaggaggcccgacuguucuccuccccucugccuuaccucccccaguccccgcccccugcuugacucagaauggaaugugcagccuguggaacaagauggggugagaacuaguucccagagggccuuggucccgccccucccaucccccaacaaagggggugaggaaccuggaggcagggccugcucccagguauggcugguguuucccugaugcagacucagguccugugcugaguuggugcagaggcaggcaggugcuguggggguccaggacuagccauuugaagguuuucauauaaguccaccaugcggggcaggugcugaguuagagaaagugcagcaggcagagcagcuccaacuccagcuucuguagcuggggguggucaauauccuuuguugacuuuuuuuuuuuuuuuuuuuugagauggaguuucacucuuguuggccaggcuggaguaugcaauggugccaucucagcucaccgcaacauccgccucccagguucaagcaauucuccugccucagccuccugaguagcugggauuacaggcaugcgcgaccaugccuggcuaauuuuuuguauuuuuaguagagacgggauuucuccauguugguuaggcuggucucgaacucccgaccucaggugauccgccugcuuuggccucccgaagugcugggauuacaggcaugagccaccacucccagccaugacuucuuucuuuuuuuuaaagaucguggcucauauucguuuucuuauuucuguagucucuaagaguaauacaacaauguguaucacuuucgucaucaggaugaaaaggauuuaaaauaaaucuaauauuuccagauagugaaacagaaaugucaucaguguuuguuuccacggaagaccaagaggagucacgguuugaccagcgcuaagaggggauguggcaggaagagugguugugcaaaugugucagacugggcugaugcccuuucacgaugacaacugagugggccccacggacccccuggcgggcucuggggguggggguugggggguugccugggacucauggggccuccugcuuuggcccuggcgccuaggaaaggcuagacagggaggggagccuuggcgugagcugcccucacacugacuuaaaagcauuaacucuugccuggccacacaaggcaggaccuggcacuccucagaguggagggugaggaggguuuucugucuuagcccucagccugugugggguaugaggucccccacccucaugcgaacaaccucuccccacccuccagcccuacugaaggagucugaagucacucaaccauccuugugagguuuugguucuggccuguuccaugagggugggguaggguggggaaagaagggggaauaaaauguaguggggagggguggaaggaagccugugugcagguacagccguggcucagaggcagguggggugagggcaguggggcuugaauagggcgcugucgaaagcagagggaguggccccuucagccccugcuguuucucaggcuugcccggcuccucuuuucuuggcuggugguggggugugugugggggggagggaagcugagugugaugugugugugaguguaaugugagugugauguguguguggguguauguguggggggccagguguguguguguuugugaagggcugagcgugauguguguaucuaugagugugauguguguguguggagggccagguguggugugugugugugugugcacauaugugugcaggcaggcaggggccugugcucuggagacccuggccaggcuccuccaacccaugggaaccaggcagggccuccgagaacuccagggagacagugaggacauuagacggaugucaagaaggaagggagaguagaauggaagaaaaaggaagagucagaacagccagcuucuggugccccaagcacguugggguuucaaucccaguauaccuggggaggagcaguagugggcuaucacccccuucccuccuuuugcugucaacuuuguuuccggggcagucauggaaccccagccaucccccucgcccgggagcacuuaauaugggagugucuggccagggcaaggggcugaggaagagaaaggagagguagagaaagacccaauggugggcucccuaacuggggcuuguggggcagggagaggaggccucuccucccuauccaguaaacuccuagggaccagaacaggaaacagggucagagaauagagaaaggggaccugugucaaaucuugacuuggguagagguggguagcaagagggcuuucuguuugauaucugaguagacaagggauggacuugacugcucucggccagagaauccuugaaauggguguacaagucuaggugaaugggccuuucuuagaguugugcagugcacagucuguacaacuguacacgauagccuguuggaacuggcugaaagcaucagggaccuuugguuuucauaauguaaauuccccuucucuucuacuggguucaccugaccuuagauccguacuucucaccaugguggcacccuccauuuggggcucauuuuggcuaucuguguuacccuuuucugggcacugauuaacuugaaguuuggagaaccagaauuguguguguaguggggaaggggguugugugugaguguugguguguuuggcaguuuagagagggucuguuggacuguugacacccuuuauugagccugaguccucuugggccaauuggccacagguguaaggagccuccugauuccugagucaggacugaugggguuuaggagcucucagauggggcagguaagacugaaaggaggcacguggggaagagaggaaguuucugccucaccugacagcaaccccugccccaggcccuucugcuuuuccucaacccacagggucuucuuuauaucccugccuuccucucucuaucucccaucaucuaaacucauccauuccuugcccuucgggauccgugcuccuugaucucuaaggagauagcuuggauagucagcuuuaccaaucuagguguguggacagauuaacagguaacuccagaagcacauuggccuuuuaagcagccgcggggccuuacuaauccaagaggugauugaaaagcaagaacuugagguggagauggaguggauguuggggacugcgggggccuucucugguccuccgucccugaggcagguauguagggagcaccugccuuguggcuaugccgggccacccugggcuggggcugaaagaccaugaagccagcauagcccugacacaacuuggagaaagugaaguaaguaacugauaccaguacugacaaacugaggggagggagggacagggcaggauguuucgggagcacccacgaaaaguucccugaaagacauaacauaaagaucuggaggguggggaggagaacaggucagagggaagaggaggucauaaggguagguccccuccacaucucccaggggccccaccugggccucuaagggcaugucagaugguccuauuccucacuaaggacccaggcacacuaugacuuugcgggaagagugagugcugggcauuugaagacaagguggccaggggcucccagagcucaggggccuuauucagcuacaagucgugugugcaagcacggggcagcauggguuuuggugugcacuaccauacgugggggcccugccugugguguggugcuguggguucaagcaggacuugggcacucugugguguguggcccaagcugccaggggauugaaaccccaagccucucccaggcagcuguggggggugcaggauugcuagggccaacugcaaauuagccaggcuggcauuaaaugccuuugcugccucucuccuccugucccucccuacccuccugaaaaucaacaacugugucaacagcagggugauugugcuuggccagcagccuccagggcugccaggaccaggcaggugcuggcaggggcugcuggagccccaugcugggagcaggcugggccuagcugccagggcugcaggauaaacaaggccgcacacaggcucagccgggagggaggccacaggcaggcaggaggcgagaacaggugucucaggagcucuguagacacaaagggccucuugucuccuccucccuggccucagggagccagccccuuccucccuccucucaggccccgcccagagaucagugaccaggucagccaggggaugcugucuuccagauucacccccuugccucucaggguuuguuguugcuugagacagaggugagacuagaccaugugggggugaggugcauuagccugagagguaggaaaucugccucugagcgaauccaccagcccugaggucucuguguguuucaguuucccugcuggaaagacagcaagaucucucccacugggacacccaaacaugaaauggaugggagaugggaaaagcaucuggagauuuggggaagaaagacguggugaaugucaggagugauggaagcuaagaugagacuuaagggauuccaggugggauuuagggcaggagguggccaggguguggcaacccuccuuccuccuuaccuauuucuaaagcagaccuuuacagagcaccuacugugugccagccacugcacuagggacuggggaggacauggagaauaauauaguaccagcacagacagacaggcagcuucuggagccagacugucugugugaucuuggguaaguaaucuagccuaaccauagagaugauaacaauuguaccugccacaggcucauggggcuauugugauggugaaauguaaagauguaaaguauagagaaaggauguaaaacugcccgacauauaguaagggccauuuaaaagaugccuguuauugucccucuucuugagagcauauuaagggcucaaaucuagccagagucuggcggguacagagguaaacaaauaauggcagguugguuaaguacuggacaccagugauguccaaggucucuaggaugcccuggagaaauaaugaacucuucuaagauuguuuggaagggauuuauaaaggacaucuaggcuggguuuugagugagguaugggaguucgcuggucaagaauguaggaauuacaaaagcagaaagugcauauuuaaaaaaaaaaaaaagauccaggccugguggcucaccccuguaaucccagcacuuugggaggccgaggcaggugggucacgaggucaggagaucaagaccauccuggcuaacacggugaaaccccgucuguacuaaaaaaaaaauacaaaaaaauuagcugggcguggugccgggggccuguagucccagcuacucgggaggcugaggcaggugaauggugugaacccgggaggcggagcagugaucgugccacugcacuucagccugggcaacaaagcaagacuccgucucaaaaaaaaaaaaaaagaaaagaaagaauguaggaagugccuucuagccuucuaggcagagacaccaugugagccagaccccggaggugugaaaguaugaguauguguccuaaguacauguuugugagcacagcuggaggaguggccugggccagguguggagggccugugcagccuggaaaggaguuggggcucaucccaagcuccuugccgguuccuccagggucgggugccagcuuuggccaucacugugucuaucuucccucccccuccucaguucacugcauuaugaauaacucagcuuugcacacucuggaguagccuucaacuuuuuaaaaaauuuuuuuuguuuuugaaauggagucucgcugugucgcccaggcuggaaugcaguggcgcgaucucggcucacugcaaccuccgccucccagguucaagagauucuccugccucagccucccgaguagcugggacuacacacaugugcugccacacccagcuaauuuuucuauuuuucauagagaaggaguuuaucauguuggccaggauggucucuaucucuugacuucgugaucugcccgccucggccuuccaaagugcugggaugacaggcaugagccacugcaccuggccugccuucaacuucuagaaaggcaggauaguuuagugacaacaucaugggguguuagagucagaaaguuuggaaguuucuggguuuugacucuaaauauggagccauuuaccuaauuucuuugagccauauuuucuuuauccauaaaauggcguaaugguucucccuuguggcagggugaugguacggauuagagaaagaugugugugugcugggcucacaguaaaugguagcuauuagggucccucugugaucuggcucauguccgaagccugucugggccuuggucucuagaucuguaacaaggagacaauggucuuucuccuuccuuuuuuuuuuuuugagacggagucucacucugucacccaggcuggagugcaguggcgcgaucuuggcgcacugcaaguucugccucccggguucacgccauucuccuaccucagccucccgaguaagcugggacuacaggcacccaccaccaggcccggcuaauuuuuguauuuuuaguagagacgggguuucaccguguuagccaggauggucucgauuuccugaccuugugaucugcccgccucggccucccaaaaugcugggauuacaggcgugagccaccgcgcccagcuuuucuccuuccuuccaugacuucugcagaggcaaaagggccaggcugcccaucaccuggguagauaagucaggcugggaggccuaggacugcucgccuuauacagaggggucaggugccugccuucccaggggcaccagcuggacccugcugacuccaugguggcugcagcuaucuguuccaggaccuuccuguagcuucccagggccugcucccugugcaugaggcaguaggccccccugucccaccuuuucuuaugggagcacccugacaucuccccuuucugucugugcugguguuuccgggaggugcugggaccaccagugcuaaggcccuggucuagcuucuacugcuaauggcuuguaugcccucagggcugucacuuagccacuuggagccuuacuuccuccaucugcaacuugggaaggagcauuuugaguucucuugcuauaaaguaagaauucugguuugcuggaaauagaguuagaugaggaugaugacaaccacacuggcaguuuuugcugcaguuucaaagcccggauguggagucagacacuuugccacagccccgcacaggaugcuucugugaggcuugucucggguaccucauaaaaccuucuaguuuggaagggcagggagcaucuacuccucagauuuggcagaugaggauauuggaaauugucuagguaguggggcuuccagagucccaccuggcuguggaucugcagggaugaggcuggucuaugcgguaugucugacucuguucagaacaagugacagcccacacugggaucuugcuuuagagucccuuggccuccugcccuggcaucuugccauugguuuuggggaaauggugaugggaagggcccauugggucuccagacagucacagggaaccauccugagacuggaucuggaaggaugugugcuuguagggcccucauuuaccuucuccucccucacuucccaccuuggcuguggacguagcccuguuuucucuuccccuguggucauguuucucagauagccacaaagugggcugagaccaaggagaggcauuggugcaaaggggaugcuggucgauucggcuggggacacuacucuggguucuccuagccagguggucagaugacucccuacguagccuuggaaacugcccaaauaagaaagagagcgaggcagaaagagcagcagggacacucggauuuuuccaggggcuuuguccauauuuacauggcauuugcauauaaccaguacacuaaacauaauuuuauaaucuauccccaggcacauucagauuugccuuuuacucuuguucuuuccagagauggcugguucugccuuuuugcaccugucugugccuucucacuccugucccguuacccccacucccagacuggggguaggugacugggaacagagucagugugggguaggggucauuccugcuguugaacugaucugauaagaugagaucagaccugaccucucugggcuuagcacagacggcuggaugcacaggcccagccuccccucugcaucccaccccagcggccaccaccucgccucgucagggaucaggacaccaugccuggcacucagcagguacccauuaaaugugaagugaaagcucaauuagaguucggacaaauacauacugugcaggcuccucgggaccuggcuuuugagcucaugaagggagaugcugguggguugaggggagccuccagugguccagagggugggaggaaucaauuucccucucagcgauugugaccagggaggcauuucuuucucugcuuggccuugcaggaaacaguguugagaaugagaggagcagaaaggaagagcuaggccuuguauuaauuuguuuuucagauugagucucuguuacuagcaauuuauuacauccgggucuccagccaagcacauucuguucuccaguguugggggaagaugcauggggggguggggaagaggcuggacaggaaagaggagcagaucaacaauuuuaugacugaguguguggugucuuggcgugcgcuagaggacgguuuuagcacagggcauuuugagcccagccccguguggggaggcacuccucuggacagcauggcauucccaugcgagcccagacagcccuggggagcaggaugaaugggcuucccucccacucucaugcccgccggccucaggguccagauuucucucugugaaaugaggucaggacagugaugccuggaacaaaaucauaguuucuugaggcagcggggccuggggagaucccuccgaggaacaggggagcagcugugugaggggaccccggaagagggguagcaggcaaggcggccacccuguggaaagaauggugcacaagcaaaacaacccccucucugcaaaagugcugagcugguggaauuucacuuggcggcugugagaucagggcaguagauagagcccugcgggcaccagggcugugugggugcagggggucccggaagagagggcaggggcagcaccuguggcacccucuccccugagcuggccuccacauugcccagggcucaucacugguccccauuccuggaggugcgucccuuaucucuauccaccugucacguaaguuggucucauucuucccauuuucccucauucucuucccaacuguggcuuugacuagaaguagcuacaucaucuagucuucaaggggccagcauugcguagagggccauggugccagagggcagggaacucugguaggaggaacucucuccgaccaggauggugguggcugaagcccccggggccucugccuuauggcugggccucuggugggagcccaggcugcuuaggggagagugaacccuucgguagugguuuuuugcaucccagccacaucuucaagcugggugccauuggaugguuguugaagggcagauucacuggaaggauaagaagcucuggugggacucuggguagagccagcacagagaauguguguguugggcagucggggagagaggguguuaggcagggagagcaugggccugguuuccagcugugagguuugaacuauuauuauccuccacacugagcugauggccacuuaacccugaggcugguuacuuguucucuguucucuggguugacugccuccucccugacuagcucaagacuucuucuucuucuuuuuuuuuuuuuuuuuugagauguagucucacucugucacccaggcuggaguauaguggcaugaucuuggcucacugcaaccuccgccuccaggguucaagcgauucuccugccuuggccucccgaguagcugggauuacaggugugcgccaccacacucggcuaacuuuuuuguauuuucaguagggacaggguuucacuauguuggccaggcuggucuugaacuccuggccucaagugauccacccgccugggccucccaaagugcugggauuacaggugugagccaccaugcccggccaagcucaagacucuugccaaaggcucaggaaaggaugaacucaaauucgauucagcacgggugaauuugguaaguguguauugagcauggauucugggcccaguguucugcuaagaugagcaucuguagggcaccuuugcaccaggugcuguaaggaacaccggugacuuacagaggcugaggaggcccuguggggugggaagggaugguguuaguuuagauugcaguuaggcggagaccauccagguuagaaggaaccuuggacacgggccgaggagcuaggacuuuguugacaauggggaaccagaggaucugucagagaacuuucagaauggguggcucauucauucaggcugaagcugcucucucauuguccugcaaaaaauuccaacagaacacuguucuuuuccuuuccauucaaagacauuuuugcugccuuccguauugaacugccugguaacugagacaacuuucccuucccugccagggcuaguggguucccagggcugccacccugggaaaaagacaagucgcguuuccucgucugcccugacccaugcugcucacggcuuuggucccacugggacccaaacgaaucaguguggccagcuuuccugggauauccagcaugugcaguuuccagcaugagcaugcuuauauuguucaggaucgaggaauauugaucucuagaugucuuuuuaaaaccaaugguuugguauauuugugaaugaaugagauacucauccaauggauaagcuuuaccaagcccucauuaugugaaaggcacugggcaaggcuaggggugaggggaucagaccccacccucagggaugcucuaaucucucuggggaggugaaacaguucauugugggaacaaagccucuuucccaucucuguagccuuggguuggaaggcugggggcaaggugaaaucagacugggguuugaguccuggcucugcuucugagcccugugauuucuggcaaauaacagaacuuuuuucguuuucuuugugugcgugugcguguguguguguguguguguguguuuguguuuuagaugggggucucacuauauugcacaggcuggucuugaacuccugagcucaagcagcccucccaccugagcucccaaagugcugggaucauaggcgugagccacugugccccaccucuuucuuagcuuuggcucuuucuuucuuuguuucuuugcuuucuuucauuuguuuguucuuuuguucauucuuucuuucguucucugucugccuuucuguccuuucugucuucuuuuuucuuuccuucgcuuuccuucuucugucucuuucacuuuuuuucucucuucuuucuuuguuucuuugauguagggucuugcucuguugcccaggcuggagugcaguggcacgacccuagcucacugcagccuugagcuccugggcucaagugauucuagcugugacuuaggcaugugcuacuacacauggcuaauuuuuaaguuuuuuuguagaaacaaggucuugcuauguugcccaggcuggucuucaaagucugccuuggucuccugaagcacgcuggauuauagguguaggcccaccacaccuggcccagaacuuuuuuuucuuuuuuuuugagacaagguuuugcucugucacucaggcuggagugcaguggcaugaucauggcccacugcagccuugaccuccuaggcucaagcaguccuccugacuuggccucccaaagugcuuggauuacaagugugagccaccacuuguggccucagaacuuucuuaaacccuaguuuucucaccuacaaagugggaaaagaauaacaccuacuuugagagauuaaaaggauuuaaugaagugauguauauauuauggcccuuaguauaggaccuggaguauagaaggcuuugguaagugggagcugauauuagugugauggcugcuguggaggugguuguugaagucuguccugggguggggacaguccagcauuccugggccuacuuggauuuagggggcugcuccuccuagggucaugggcauggccuuuaugggguaugggaaaggaggggaaucagcuucccggugugugguggggacaggcacugucuccuauaacaccuccuuugguugcuacgugcagauuugcugugcagcacgggucaaguuacuuagccucucuguguuuccgcuuccuaacugaaaugccauuaaucacaaugcucucacuugagaagagagaacauuagaagggucacaugagaagagucuagaauagugcgugggaaucuuauccagguguuggcuauuuguugcugugauuauucuguuuuuggagugacccccauucagucaaagaagcaagggugagagcugcugucccaaguguaucagcauagggacguggggacgugggggagguggacuggggcauggaccucgcuaugcuggccccagggagcagccuagagaaggaaagaaacuguuucucgaaugcuagcuguagguagggcguucccaggugugacugaaaugacagucuggcucagagcacacugccuuuucuucccaccuuaacugguuacuaaggggacaguucuacacuacacaggauugauuucugugaaaucuauggaauuuacauauaguuuugaggggcugcuuugaggcaugaagccaccguauucacaaaacccagcugcgggugaauugcaauuuauaauaauaaacagccuguaccugaccuuuggacccugggugcucaggaugaugccuguggggccugacaggaagugaaggcgguggcauggguguggggggccaccccucccucugaccaugguggcggguggcauccaggcccagagaagccuugucacuggcuguccccuuggcacccagcccagcaggcggagaggguuaauugggauuuggagugucuguggaaaguagccucuucucaaauaucuugugcuaugguuuggaacuuuggaaucaggcauaccgaaaguggaauucugucuucaaguaagccucaguuuccucaucuguacaaugaguuuugucccugaagaaaauccaccugugaagugcuuagcuugugaucacucaguaaauaggcacugucauuaucuuucugaugaggggcuuccauaugugaccugcccugggcuacaacucgaacauggaaaucagaagcuuagcaacacuauuauuuccacugcaucaaaggccugggagcccuccccugccuauacuuuugucucucagagaagaaguaauaauucacuccaugugcaaauggaaaaacugagaccugaaagguugagugguuugucccaggccccauagugaguuaaaggcaucaaaaucccuuacacauguauggggcuuuauaaaccaucaaguguguaaaggguguugacauuuagaaaauaacugugccgagucuccuagggaucugguacauguauuuugacugccaguuuacggaugggaacgaugagacucagagaacuuagaugagcccaagauuguacauugaguuuguggcagaguugacgcucaaacucgagcccucugcucuuuccaccgcacacgcagaccucucaccugggcccuucuagacccucucugcaauuauuuuuuccccuccauacagguagaucugugaagguggagagucaugagccagcagggacaggguuaaauucuuccuaagcaacagagcugguuuugagcugggcaccuucagugaccccauuguugacccccuucccucgggucaggacugcaggcagugggggaagggaagcacugcagggagcucuaauggcccaaugcgggcagagagagggccaggaagggaugcucaucugucucccucuuuggacagagaugaacaaagaugccgguggcuuuuucagucuccauagaaaauccccaaggcucccuuggggcgggcugccaucagcucuuccugcacucuuaaucacaccguggagcacgggcagcuccuguagacacagcaaacccugugauguguuguugguuaagugggaacugggauaauuuuugccaguaaagcaccaaaucagaaaauggaagcaucaaaugaaccuuagggcuagugggauuuuggggcuugccugucauucauucauugaaaaggaaaaggauggcuuggguggcccacagaagccagcaucugugaccucaaauggaugagucccugcaaacugggaaggcugcccaguuccucuuccucuucccaaguggcccccguccugccacucccuucuaugagcgcagaccuucugguuuagagcuucagucuggaccauugugcuguguccucuccaggcggggagggcaucaggaguaaaccuccuuccacggcccugagccguacaguaagucucccaggguuguacggcaaggcaggggcagagcuguucuguaaacaggcgucaguucaguugccuugaaaccgccaacucuaagauggacauccgaggggaaaggauuuccaggaaagucgaggaacugauuuuaggggaagacuaaaucucuuucucuauccccaucuucuugucgucugggucccuugaacucccugcugagaaauccuaaauacaccuugucucuggguugcgcauggaagccuuuaauuguuucuagaggcagugagggaaggccuucuaguuggucgggcaggucuggcacugucugggucuugcugcuucuagacacuucaauuagggauguuaauuauggccuugugaacacaggcucucccaaggcagccgcucuccagcccugcugcccccauguuguccccucaccagucagugaggcuauguuuauggucucgccucuguccaucugcagauuaaagaugcccugaaagcauaacuuauuagcaguuuuuuguucucuccaucuuuuaaaaaauuggauuaaaguagacauaauguaaaauuuacaauuuguaaauguguaguucagaggcauuaaguccauucacauuguuuugcaaccaucaccaccaucuguccauggaacuuuuucaucuucccaaacugaaacucuguucccauuaagcaauagcguccccuuccucucucacuccagcccuguaacucuauucuacuuucugucucuaugaauuuagcuguucuaaguaccucacauaaguagacacauacaauauuugaccuuuuaugccuggcuuauuucaguuaacauaaugucuucaauauuugucuacaucguagaugugucaagauugccuuccagcuuagggcugaugauauuccauugcauguauauaucauacuuuguugauucauucauccauugauggacacuugaguuguuucccauuuugguuguugugaguaauauugcuaugaguuuuggggguauauccccagaaguggaauugcuggaucauaugguaauucuauaucuaauuucuugaggacccgccaucauauuuuucuuuucuuuucuuuuucuuucuuucguuuuuuuuuuuuuuuuuugcgacagggucucacucugucucccaggcuggaguacaguggcaugaucacagcucacugcggcaucaaccuccugggcucaagcgauccucccaccucagccucccaaguagcugagaccacaguguaugccaccaugcccagcugauuuuuguauuuauuuauuuauuuauuuuugagacagagucuugcucugucgcccagguuagaguacagugguggguugucggcucacugcagccuccaucucgugggcucaagcaauucucaugcaucagucucccaaguagcuggguuuacaggcacccgccaccacaccuggcuaauuuuuguauuuuuaguagagaugggguuucaccauguuggccaggcuggacucgaacuccugaccuugugauccacccaccucagacucccaaagugcugggauuauaugcaugagccaccaugcccagcuaauuuuuguauuuucuguagagaugagguuuuuccauguugcccaggcuucuaucuguuuuucacagcagcuauaccacuuuucauuuuacauucccaucagaaauucucuacauccuugccaauucuccuccuccucuuucuucucuuuuucuucuucuuucuccuucuuuuuuugauaauagccauccucuuggguaugaagugaaaauccacugugcuuuuuaucuuuuaagggggaagucaaggccugagaaacacugauacgugccucugcauugcagagccccuugggcccaggcuuucuagccccauccuggcuuccauucucuguccuaaaccccuuugucuccaguccaucaagagagggcaggggcgagguccacugacuguuaggggcccugccuucccuccugucacagcagcagaguggcugugaccuggcagagguguugggaggguggaugucccuaggggucaggaggagguuucaguaaugugaaauuggaagaguugaaucauuucaaccacggggcauggggauaaaggaaaucaugaugcagccauagaguggaagaugugcagccauuaaauauggcuuuaugaauaauuuuuaauauccaguuuuugguaacaugaaaacugcugauguguacuauuaagugggagaaaauaaauauaaaaacuugcuuaugaggccgggcucaguggcuuauuccuguaaucccagcacuuugggaggccgagguggguggaucaccugaggucgggaguuugagaccagccugaccaacauggagaaacccugucucuacuaaaaauacaaaauuagcugggcgugguggcgcaugccuguaaucccagcuacucgggaggcugaggcaggagaaucacuugaacccgggagguagagguugcagugagccgagauugcgccauugcauuccagccugaaugcaacaaaagcgaaacuccgucucaaaaaaaaaaaaaaagaaaagaaaagaaaaaaaaacuugcuuaugaaugaaaaacaaaaccaccuucagaaaaaaagauuugauagaaauaggccaaauuguugucaauggccaccuccuggauggaugugaaaugggugauuuuuaaaauuguuuucuuauuuuuaaauuuuaauuuaaauuuauuuuuugagauaggguguugcucuguugcccaggcuggagugcaguggugugaucauggcucacugcagccucaaccucaagugauccucucaucucagccuccuuaguagcugggacuacaggugugugccaccacaccuggcuaauuuuuucauauuuuuuguggagaugggauuucaccauguugccuaggcugaucucaaacuccugaacucaagcaauccacccaccucgaccuuccaaagugcugggauuacagaugugagucaccaucgcccaaccuguuuucuuuauguuauuuaaaauuuugcagauuggcugaacacgguggcucaugccuguaaucccagcaccuugggaggccaaggcgggcagaucaccugaggucaggaguucgaaacuagccugaccaacauggagaaaccccaucucuacuaaaaauacaaaauuagccgggcguggaggcgcaugccuguaaucccagcuacucgggaggcugaggcaggagaauugcuugaaccggggaggcagagaaguuguagugagcugagauggugccacugcacuccagccugggugacagagcgagacucaaaaaaaaaaaaaauuuuguuguuguuguuguuguuguugcugauuuucuacaguaagcacacacuccuuuuauauuuaggaaaaaacugauaaaauaagagugacuacgacuauucauuaggcauauguguugccagggucuacugaacacucagcucugcuugaugcuauugaaaguucaggaaugaaugcgaagcuaacagggaggugugggguuaggugguggggaggacuggccagaacacagaggggugaugaauguaaggggagucagggucugggcagccuggagcccuccagaaugcugccuuuguucaugagaagccucauucauggggaagauaccguggguaggacucuggccuugagucaccuugucucugcaaguggcgcaggcaggcuccauugagcucuucacccauguucaccuggucccuuggcauagcuggcaggagugagcgaagcuuguagccugugaaaccagggguuuuccugccccagguugacuauuacuucccuugcaucauccguaccagggccaagggccugguucccuugacuuccauugugggagcagcacuggcccagcagaggugggacagugggguuuccaggagauaaacuuccauggcucuugggaccucugacuaguagaagagaagccaguauaauccaacacuuaaaagaagagacucauuagccagucucuggguucaguuucuuggucacuacucacuggcuaugaccuugggcaauggcuuagccuccuuaggccucuguguccucauaguagcuauuucacaggacuaaugaaggaauuaaaaggcuaaauccuuauagauuaugcuuagcauguaaguaguugauuccuauggucugacugagagguggauucugaugcuagacugccugggcucaaaucauguuggugucucagugucuuuuucuggcuuuuuuuuuuuuuuuuuuuuuuugagacagggucucuguagcucaggcugaagugcaguggcaugaucauggcucacugcagccccaaccuccugugcucaagccauccucccgaguagcuugggcuacaggcaugccucaccacaccuggcaaauuuuuguauuuuuuguugagauggaguuucaucauguugcccaggcuggucuugaacuccugggcucaagcaguccucccacuucggccucccaaagugcugggauuacaagugugugccacugcgcccagucggcaucucagguuuuucaucuguaaaguggagaugauaauaugaucuacuucagaugauuauuaugaagauuaaaugaauuaauauaaguaaaagugauucgaacagugcuuggcacauaguaaaugcucaauaaacguuagccauaggcugggcaugguggcuuaugccuauaaccucagcauuuugggaggccaaggcaggaggauagcuugaggccaggaguucaagaccagucugggcaacauagcaagacccugucacuauaaaaaaugaauuagcugggcaugguggcaugcaccuguaguuccagcuacuugugaggcugaggugggaggauugcuugaggcugggagguugagaggcuguagugagcugugauugugccacuguacuccagccugggugacagagugagaccccaucucuaaaaaguaaaguuagccauaauuggggucuuucaccacauacuagugugacucagccaguuguuuguggcuggcaacugccaauucaucugauugucccaagagccucaguggauuggucagugcccaugacucccuugcuaaauagucuugaaugucaccauuauucauuacuauuauuaguauuguggguuccacgugucaggaucccuuccuggguuguauuucaucuuaccccuuugccaagucuugguugaugugguccugccucaguuuccaaagggugcuggugauggaaagcggggugcugggcagauuggggugaaagcuggcugcuuuggggauuguuugaugagcauuauaguagauuaagcugcuucuccccuuccuucccugcccuuauugaaaaggcgccaaagccaggaaaaacaaacagccacccauaaauaaagaggaccaugaaauaacaaaaucgaaaaagaaaacuugcuuuaguggcgggcuuggcugacgauaggguagauaaugggagaggaaacgcagccuuuggagagaaaaagaacggaacgcguuguucacuggaagaaugaaugcugccugaggaagagcugcuaaacugggguguccgaugagcgagccuguguuaggggagcugguggugauuaggcuuacaugaggcaugagugucauuccaccaagaaccccugggaugggggacaccuuaggcuuaagcgggcugugccaacgggaggccggugugccagucuggccuagagccuuggcugccaugaucauagagcugcugcucaccuccucaagggcuggccaagcugggagcuggaugcuugaaucucuuagggagccccuagaccuucugucaagguauauauuuuuucuggaguguuagggagacaaucccagggaggagaggaggaggccaaaguuguuugcugacuguuugcauucaaggcugugcuccugucaacacugccugguggcuuucugggugaaugaaauuuacugacuucucuuccuuucuuguaccacuuacccaucuggaucguggacccauuucuccugccucugcaaugaguugggugccugaggugggaaggggagagaaaccuuuccugagcccuugggaucccaggaugcuguguggaagugcccacuuugggagugggcugugggcucacagauggguagaggcugauauuugaaaugcauuuaagaagggccuuagauggcugggcgcgguggcuaacaccuauaauccuagcauuuugggaggcugagacaggaggaucacgugagcccagcuguucaaaccagccugggcaacauagcgagauucccucuuuauuuaaaaaaaaaaaaaaguggcaggaggccuuggaaacauacugguuuggggcugaguggucuggcugguagagguuuccuggaaacacaguccuucauucagccaccacaauacuaagugccaaucugcuuugugccaggcauugggcuaaguauuuucuauauaauaacuuaucaguucucuagcaagcauaagagguagguauuguuagcccccauuucagacaaugaaucugagguguaaagagguuaagucucaaguauucacugggcuaccuagagcccagcugcuucccaauuuuccacccuucaccuccuaaucuagaugacaaugguaaaaugcccauuacaguuguucaucacggcugugugccaggcacugggcuuugccuguguuaucucguuuacucuuugaaaccccacuagugaguauauauuacuauuugccccaguuacagauaaaggcaggagggucauuugagcccaggaguucaggaccagccugggcaacauggugaggcugagagaguuaaacuaguuggcuaguuaagacggaugcuggguuugaaccaaugcugcgugucucccagagccucauuucaccauguacuaugagggcuuagucuacauggcuuagacuugucacaaagcaaaagccgauaaugcccagcccaccccaguacugggagaaggaguguuuggcaaaggugagauuucaucagccuggcggguaaacauggcuguuugcagacuaguugcgcuuguccuuuccgcugucuguagucaucccuaugguccccaccuuccucucccucugggguuggcaggagaacgcaaggguuaaugauauagcacuucacccuugugggcuccagaggaaaugagggagcucaugaguucugcagagcuuuugugucaucagccggggaagggaaggcaccguggcuuggccagauaagcgguggcgcugcgaauguggggcuuccuuggcagauuuguagccuuuccgccuguuugcacuguggggcaccugcuggggcuuccagggugguuggggacaucaacagggcauucagaaaacugauaaccuaggcuagggagggagaccuacauggagcagauggaggaggaagaggguggcgggcccugguguucugcaggugcaugucuucugcuuguuugaccaugugggggaaggggguggcggugggucagggagcaaacauuuuuuugauuuucacaaacaccaucauauucagucuucucuaucucuaugggguagguguuauuuguucccauuuuagagauagagaaacugaaacuuccccauggccacacaucuagugguauauaauagagccagucuucagacacagguccaugugacaaaguccuuuuuccauuagccacaccaggaugccucccagcaaugcugggucaucacacccacccaccugccuccggaagagcugggcuggcuggggaggagaauagggugugaguccuucucccccuugcccugggggcagggagggagagggacuccuuccugcuuuagggcucuuucuccuuaccuccuucccugaacauauauucuguaccagauucuguaauuauaccuuaucucuuacucacaaaauaguucuuggaaucucuauuuuacacaugaagaaauggggguuuugagaggugaagucuuucccccaacuugccagagcugccuggguuucuuuugacuaaguuuuccuuggcuaugacucaagucagaaacaacugcaauccuguaagaggugaagacaguggccauucuaucucugcuggaccagagccuguuauuuugcaccgaggagaguggccagggcaucagcugauaaaugaaaggauguggauuuagacaucagcgaggccugaguucaaaugcuacuucugcugggcccucaguaggacguucuagcccccgagccuuagucuuuguaguguucuugugaggauuaagcaggaaugugaaugaagagccuuucacuuagugcuugcagccaaguaagugcuguagcauugcaugcuugcuuuuugccucccauuccuuuggucaguauucagggcuaucccccaaggggccuuugacauggccagucagccucagcugcacaauuucugcaucucccagcccuaggcugggcacugucccugcaggaagccagaugugcucaccuguccaggacacaggcuuggccuugccauugggaaacaaggaugaggccuaccccugccuucuagcacuguuggggugcaggagaaccuggagacaggcuuggguucuagaggcaggaaggccuccagagaagggccuccuagagacacuguugaccucuucucgguuugggaccuucuggaggcacacaucacacugggagccucaauggcgcuuucaagcagucccaucugucucuuucucgacccacucacuggguugggagaagacucaggugccucugaggccugaggaccaggugggaacaucacagcuacagucucucccuggccacuguuuuccuuugugcccuugggccagggucagcugagucccggcagccacagaagcucaggcuggacugugauucuguaccugaggugcuguggggaagugccucuucucccaugcuugggaguugacccagccucugucugauguuggccacucuaccaggugaaugccacccugaccagccuggaaacagccgagggaguguuggcuguggccccccugagcugggcuagaccagaccggccgugcccuggaucugauaccccccagggcucacagaggcuggaaagggugagagggacucgcaggaaagcuuugucccaagccugcagccaguccagcucccagcucugaguaaacauuagagauaggaucggguguagccaggaaggguggcaggguguggucugugagaagaauggcaggauguggcaccggggcacuguucugggcacccacgccuuggccuauuguuuagggcagccugagguucucagcucucugggggcuuucagaggaaguggcauuccccugggacucaagcccugccccaccccugcugcauggaucucuuucccuggugaugccccuuggcaccacccacucagagcaagcuugggagugggagccagcaguggagggggauuagugugugcccagcggggaaguguagccauuggcccucucagagggucugccugucuguucaggcuuccuguaccccagggucugagucacccgucaugcuacgaugacuggaauuuaucucuaucuuuaucuucaucuagauauuuuuuguagggugggggaaggcugucguuguggagggaggaaggacugacaguaaaaacuccuuugauuccaauccaacagggucaguuguugacugguuagaagaggaaguggcuggugauuuguuuugggcagaaaggggcuagguuugugugcgccuguggguuggugggguucagaggggccgugacagggcugguuguggggaggagagaggaagaggaucggcaccugcagcgggcuuugucauauaagcgccaugcuuugagccacugucccuccauggaggcgggugccucucuauaccuugucucaggugcuggauuugggggccucggggccugguaggcacaagcugagacucaaggcucugcaugucaagggcgaagauggcuggagcccucuccuuagaggucuucacuucuuaaggaugcucacuugggugagauaagaccacagaggaagaagaauggaagagggauugugagguggguuccugagaaggaagggagggcagagcagagaugccgcuuagcgccccagcuggcugaaggccucugacucuguauaaucucuuuuuuuuuugagacagagucucccucagucacccaggcuggagugcagcagugcaaucuuggcucacugcaaccuccgccuccuggguuugagcgauucuccugccucagccuccugaguagcugggauuacagguaugcaccaccaugccuggcuaauuuuuguauuuuuaguggagaugggguuuuaccauguuggccaggcuggucuugaaccccugaccucaggugaucaacccgccucagccucccaaagugcugggauuacagauaugaguccggccauucuauacagucuugaagcagugcugccccaaaagcugcgugaacucaacaucuccugaccucaguuucucuguuuauaaaauguguugagguugggcaagagaggaaacugggcacgcaggagcacuuccauccaagcgaggggcugacgggcuacccuguggacuuguggccucugaccaguaccaaggcaucagacuaggguggaaacugagggagcccaguaacuccuguauccuguggacccagcguucuuuggcuucugggcauuuugggacaguggaguuugagguuacugaccuuaaaaccuccugcggagccacauggaaaaugacugaagcaaggagcaugcuguguaacaaaggaguaaaggaacuugagggauuauuuuaguuucuggaaagucuaaagggagacuuaagggaggacuccaacggggucuuuaaauccaaaaaguauggaaaguguuucuuauccgacccaagguaaaaagaaaaggaaauggaaucgcuuugcugcuggggguauuuagguaacucauaggaagagcuuagacccaaggaagaggcagcagaggauaauugggugugggagaaaaaccugagagagcaggagcugucuaauaguccuaacaguauccaucaccuguuaagcauccagaccugcuuugugcugugcugcugaacucugucacucucuugucauucuaagaauauuuaucgagcacuuacuguguuucaggcacugugcuaggcucuggagcuacagugaugagcagaaacagguauauuuuuggcuacugggugacuccaaaauaaauuuuuuuuuuuuuuuuuugagaaggaguuuucgcuguuguugcccaggcuggagugcagaggcgugaucucaacugacugcaacuuccacuucccagguucaagcaauucuccugccucagccucccaaguagcugggauuacacaccugacuaauuuuguguuuuuacuggagucaggguuucaccauguuggucaagcuggucucaaacuccugaccucaggcgaucugcccaccuuggcuucccaaagugcugggauuacagccgugagccaucgcgcccagcgacuccaaaauaaauuaagcguguaaagguaucauuaccaauugugauaaauacuuuuaaggucaaguucaaagugccaugagaauguaaaauaggcacucugauagggucugguguuguuaacaggagauucaccucuugauguugaguuucuuauuccuauuuuacugaggaggaaaugggcucagagaaguuaaguuacuugcccaagguugcacagcaaugauuggucagaguugggauucaaauguacccaagucugucugacccuagaggcuuuucucucaaccacuugacucucagagcauccuggacugcgcacaacuuacagaauagauauucacccuguauuaucugaucuucauggacaccagugagacauggguuauuguacccauuguauggaugaggagacaggcuaagggagguuaauuaauuugacuagguucauacaagucagccuguggcagggcaggaauuuaaacccagguuguuggauucaaacccugcgggucuuccaaguuguccccugacucccuccaggacccuuguuuuauagacacagcuugcaggggugaagcaaacugugcagacccccagcugcagagugacagagcagugaccacauaaugaccccucucuuuccaucucacugccuuuccucccuuaucuaguugaucaugggaccgucgcuccccucccugggaugguuagggucuggagccugguacugaugcucuucacagagacaccugcgucucucugggccauggcaggcuggggcuugguucccucaagaccagacagggcagggaaagcagcugcucuucucaagcaggccugugcuuggggagggggagagggagguaaaagagguacccagggacccucucccccaaaggugagacccagaguugcucuccauugggggcgggguggcauugugccugggcuguugccuuuucauggacaagugggcccagaggauaccaacuaagggccagugcccagcaccugccguugagccagacaccugugaggauggaagggcccuugucugggcaggguuaucuggugggcacccagcccuagugaacagacugacaccucuaagcuggcuuggcuggucaccaggagccauugucuuugugcuggaggccaggguaggccacugagaggcccaggagacaggcucccuaauauaagggugauccauggugccuggcuggagggaccguggaggcuaaguguguguagaagcucaaagggaggagguguccuagugcagcgcuguccaacauaaauauaaugggaacuacauguguaauauuugcuaguagcuguauuaaaaaguauaaaaagaaauaggugaaaugaauuuuaaugauguauuuuaucuaaccaacuuauccaaaaagaauuucaacuuguaaucaguaaccauuacuaaugagcuauuuuacauucuauuccauguacuaagccuucaaaaccugggguggguuugaugcccacagcacauuucuguugggacuggcugcauuauaagugcuuaguagccgcauggggcaaguggcugcaaucuugggccgugcaguccuaggguuaauuaggacagaugauggccuccucugccuccaccaucagcuccagggauggauggucguucaccauccccaacuggggagaccuuggacuuuuguguccuguucaucugaccaugcuccuggaggcuguggcugcugcugggauuucugggcugcagcaggaaggcuuugaggugggagcuggaggccccugaaguugggacagaaugaaggagagacccuuaggacccaaguccggagugaggagggacccgguggccggccugcgcccgcagugggugugagugagguggcgcugagccgacggaucagaggcccacaggcccgcauugugcgccugucacacuuccuuuggcuuuauugcuuuuguccaacacccuauugucuggcuuccuuuugucccccauucagugcugcugccuuuuauuuuccagccagccugguuguuuucauuucuuuugucugaaguuccugagaggaagguuuuauuuucagcgguuugauuaauucacagcuugagcccaggguuuguuuguuauguaauugcugccuucggcuucaggauaaaacccccuccccaacugcacccacucccacuucucgccccccugcucucggccuggcucugagccccucccggugcccggaugggcugagccgccugcuuucuggacgcucuccaagccccugggcuguaggaggggaccccagggugagcuggccuggggucucuucucuucucugcaucuaggugggauggggccuuuguacuuauggucauggaggccccucucugcagugcccugucuugggacccagccucuggggaacccuacacuuugaaagugggugagcaggagagucuggucugaucagcaagguggaaucaaaucaaauacacaugcacucaugcacugcuugccuaccaaugucucugucaacgaccgaacacauauaggacagugguccugcaagauucuacuacuguauuuuugcuguagcuuuucuauauuuggauguuuggauacacaaauacuuaaccauugcauuacaauuaccuacgguauucaguacaauaacaugcuguacagguuuguagccuaggagaaauaggcuauaccauacagccugguguguaguaggcuguaccaucuagguuuguguaaauauacuuuaugagguuugaauaacaaagaaauugccuggugaugcauuucucagaacauguuuaugcuauuaauugauguaggacuguauauagucaucccgcuguaucugagacgguugguuccaggaccuccaaagauacuaaaaugugcugauguucaagucccugauauagaauggcauaguauuugcauauaaccuaugcacauccucccguauaccuuguuuuuuauuuauuguuauuauuauuaucauuauuauuauuuuuuuuugagacggaguuucgcucuuguugcccaggcuggagugcaauggcaccaucucggcucaccacaaccuccaccgcccggguucaagagauucuccugccucagccuccugaguagcugggacuacaggcaugcaccaccacacccggcuaauuuuguauuuuuaguagagaugggguuucuccauguuggucaggcuggucucgaacucccggcuucaggugcuccacccgccucggccucccaaagugcuggaauuacaggcaugagccgccgcgucuggccaguuguuaucauuucugagauagggccuugcucugucaccuugacagaguggagugcaguggcuuaaucuuggcagcuucaaacugcuggccucaagugaauccuccagccucagccuccugaguagcgaggacuauaggcgcaugccaccaugcccagcuaauuuuuguauucuuuuguagagacagggucuugcuauguugcucaugcuaaugggcaacauagcaagacccugucucuacaaaaaaaauacaauacuccuggccucaagcaauccuccugccuuagccucucaaaguguugagauuacaggcaugagccccugugccucuagauuacuuauaauaccuaauauaauguuaaucauauauaaauaguuuuugcacuauauugucuagggaauaaugacaagucuacuuguucaguacagaugaaauuucuuuuuuaaauauuuuugaucugagguugguugaauccauggauguggaaccuacaaauacagagggcugauuguauauauuuuauucaauuauaaugcuuauuuaaaauacucuacauguacucuauuauauacaaugcguguuucauaauacauaacaaacauuuuacagaguugaugcaaucuauccaaaugcauccauacagagcugaugcaguauuuaaauaccauacugcaccugggagguuuaaggaauuuuuuuacuguagggauauuuuuacuauaucugauuuuagccuuacauacuuccccuaaacaucuaauccccaugcaaaaaaaaaaaaaucaaaaaauguauuuaacagugcuuuucuaacuagugcauaucaaaaucaccuggaggucuuguuaaaccugaucccuggccuaacucccagagauucugauuugugggagggacuuaugacuuugccucucaaacaagcccccaaggcaugcugaagcugcugguccuuauacugcauuccaacuaguagugguuuaacaaacaccagaucaugugauguuauuuggaaaugugauaaacaaggaaacaacaaaacaccagaucggugcuuacuggugccacaaacuauucuaaguaccauauaaauaucaacuccuaguccucacggccauccuauaguguagagacucuuaccaugcucauuuuacagaugaggaaacuugaaguacagagcagcuaagcaacuugcccuaggucacuuggcuagucaguagcugaggcaggacccaugcauagcuggaaccugcuguguucccacuagaacccagagcgcaucucugugacuuuggaggauaggcaucugcugcuccgcccaagccuggcaugaccccuggaaaccacucccugagaugcugcgauugcucagcuccucagaugucccaggcagugaugugacaggaaaggaacagcaggugcagagucucaagagggucugccagguauaccagcugcuuaaacuaggaacugcaaacucagaugccuaugguggccagacucugagagauucuagcuagauaccggaaaauauuuuucguaaagccaaucaucucagucuguuauuccccccacccccgcccuuuauuuuuuuaaagagaugggagucucauuagguuguccagacuggccucaaacaccugaccucaagugaugugccuuccucagccucuugaguaacugggauuacaggcaugaaccaccauacccggcuauuuccccccgugugauagaugcaugaagcaagaaaucauuuacuuuuaccuuaucuccacuguaagaagaagacuauaugucuuauauauagaagaauauaugucuuauauaguuaauacuugguuuccuuuuugaggaguaguaggaguguagaggcuaaaguagacuggccuguccauaagaaauacccauuacucaauuccagccaauuuuuaccacaaaaacaauugagcuagaaguucaaaucuagauuuuuauguguuaucucuugauuuuuaaguauugguaacuaauuauaaaaaugcauuuguaggcugggcgugguggcuuacgccuguaauuccagcacuuugggaggcugaggcgggcagaucaccugaggucagaaguuggagaccagcuuggccaacauggcaaaaccccauaucuacuaaaaauacaaauauuaguugggggugguggcgugugccuguaauuccagcuacucgggaggcugaggcaggagaaucacuugaaccugggaggcggagguugcagugagccgagaucgugcccuugcacuccagccuaggugacagagugagacucugucucaaaaaaaaaaaaaugcauuuguauacauacaaacaugcacagacacaugcacacaugcgugcacacacacacacacacacacacacacuuucucucucucgcugucgcucuccaacucuguugggcucagaaacagccagucaguaucuggccucguuaguugggccgucaguccacuagucccguagucccaagcauuacacaggcagcugcugcgcaaggguaggcccacucuucucuagaacuuuuuguuuaaaaagcaaaaaacaaaacaaaaaagcaugagggauacaagaggcuuugcugauuuuucuguggguucacaaguaagcuugcccuuucugugagugugcccaugugacaggcaccaggaggcacuuggguggggucaggggagcaaacaguagggucacugccucugggcagaaguuuacgacuggggacucaccucagcucacucugucccucccccaggauguccaugaggagccccaucucugcccagcuggcccuggauggcguuggcaccauggugaacugcaccaucaagucagaggagaagaaagagccuugccacgaggccccccagggcucagccacugccgcugaaccucagccuggagacccagcccgggccucccaggauagugcugacccccaagcuccagcccaggggaauuucaggggcuccugggucaguguccccgcccugccuccauccucacacccaugcgcuguaccugggcucucugcucggcugggcaggcccacuccccuagauggcagcagauacaggcagaaguggugauccuagggguaagacgccauguagggaagcagggaggcacugccaaguucagucugaggcuggaagcggggucaccuaucagagcaggaccuagacucaugccuguacuuacucgcuugauagugacaguucaccuaugugugacccaguccuugcuucugaggacuagauggggagaugggacacacaugcuaaaguuuggcuuuaaaguaaucuaccagauuuuucagaugauuugggaaaaucaaccugauuacacaagcaagaauuaggucacuguuaaagaugauacgguucuugacccuuaaaaaaacaagagaauugagcugcaugauucauaaggauucuugcagcuccuaaaaauucugauuucacauaugagauguaaaaaggugauauauaauuaaaauccaaauaagugaaaaugaggagaguuaugggcucuaagaaagaauccagccuggaggaaggagguggggggugggggcacuggugaucaaggaaggcuuccuggagaaguagagccucaagcuaggccuuaaaggauggggaggacuuugacgagaagaggagugaggcaggcaguggggagugugaguaacuuuugccagccccuaccugcuccccuaugcagcccagcugguguaguggguauguucaagggagugauaacuaauagcugacuuuuggccccugauuguaauggcaaaucucauucacaugcauuaacucccuugaucccagcaacaauccugugacagaggagguauuaauauuuccauuuucaaaagagggaagucagguucagagcauuucagggacuugugugggaucaagcaucgugugagucacugagccuggacugaaacccaggucuuuuguuuugaaaucuucuguucuuuuccuaaacaaagcuugggcagguggaggccaaagggaccuagugaguggagaaguaggacuuggauagggcugggaucccucaggguacacaucuuuggggugcccagcccucccugcagccuguccccuucucuuggggguuauggugacaauucaguaugucuugcaggacuguagcucuccagaggguaauggguccccagaacccaagagaccaggagugucggaggcugccucuggaagccaggagaagcuggacuucaaccgaaauuugaaagaagguaggaugucugcccuaguuagaagcagaggccugaggcagggagguguuaagacgguuauuccucaccccuuugcugucuuccaguggugccagccauagagaagcuguuguccagugacuggaaggagagguuucuaggaaggaacucuauggaagccaaagaugucaaaggugaaggccuguugggggugggggagauguuugaaccccaucucucuucuccuggucuggccacgcagccuggcucuguagggcaguucuugguacauaccuauccugugccaucuggcuccugccuggccuuaggggucaucaccaucccucgccuggaggccccaagcauuaggucucacucaucccaugcaggagaggccugguaggaaucaaaucccaugacucugaaucugggcucucaccaggcacccuugugacuucaggcaugucauugccacuucccgagucuaaccgcaaaaugagcagaaaguucccuuucacucuaauuaauucuaggucaguuggaccucacuaagugagugaaaaguaguuacuaaugggcugcugcuuggguuccuuagagugauuuuuuuuuuuuuuuaagauacagucucccugugucgcccaggcuggagugcaguggcacaaucuuggcucacugcagccucaaccuccugcaugauccuccuaucucagccuccugaguagcugggaacacaggcaccugccaccaagccaggcuaauuuuuauauuuuuuuuguagagaugacgucuuacuauguugcccaggcuggucucgaaccccugggccuaaacaguccucccaccuuggcaucucaaauugcuaggauugcaggcaugagccacccacugcacccagccagaaugaucauuuuugcauugucauugaucacacccacagagggaacuuuaaaaccguacagaugcccaggcuccacccccaccuauugaaugggaaccccaggguaugguaggggccugggccucuauacuucucaaaggauccaugagugauuccgauguuguuuuuuuuuuuuuuuuuaaaaaaaaaaaaaaaaaaaaaggucuauggccaggcacucaggaauaaacugcugcaucagacaggagcuaaacuggaggucagggggacacuaacauuuauugguugaggaccaugugccagauccuggacuaagagcuuugcauauauuagcgcuucuucuucuuuuuuuuuuuuuuuuuuuuuuuuuggagagagacagcucgcucuguugcccaggcuggagcguaguggugugauuucggcucacugcaaaguucaccuccuggguucaagcgauucuccugucucagucucccaaguaguugggauuacagguaugcgccaccauacccggcuaauuuuugcauuuuuguagagaugggguuuuaccauguuguucaggcuggucucgaacuccugaccucaagugauccaccugucucggccucccaaagugcugggauuacaggcgugagccaccacaccuggccucuauuagcucauuuaucccucauaguaacccucugaggugauuauuauuaugcccacuuaccaagauuuugaaaacccuaaagugcagagaaauugguaacuugccuaacagcucacagacaggauggguugaaaugggaauuugaccccagaccugucuugcuucaaagccugagugugucccacuggaucccuccgaugggaugguuguccacccugacccuguguggcgcugagcacucgaggacauugaagaggccuggggcucuggggcugacaugucccacugucagcauuuucagggggccuggaauucauggcuaauaggggagaacuucuaggcuaguaguugccagguagcaacaugaagagcccccuucaaggcaagcaucuugugucaucaucucuguggcucagccccuaaugguccugggacauagcaauugcucaauaaguuucugauggauggguggauagauggauggauguauagaugaacaaguaaaaagucucaauggggucuguuucacuguggagcagggacccaagagagccuagcagagaaggagcuccagcuucuggucaugauucaccagcuguccacccugcgggaccagcuccugacagcccacucggagcagaagaacauggcugccaugcuguuugagaagcagcagcagcagauggagcuugcccggcagcagcaggagcagguagguccuguucgguggguguagcuuucuuuccaggaaaaggagugugucaggaccuagagaaggcugccuuagggacaggccucaccagugcaagcuggggccugggggcaggcugggcagggucuguggccaggggcuguaggauucccaccuggacugauucaugagcccuuguacaggguuaggggugggaggguaugaaagggacucugcaggaagagcagcuugcagcuuccugcccagccuccugguccuggagggagggaugagcuuccugcaaaaggagaaccaauucugagggcugacugcuuugcucccuacugccaccccacuccauggcuugccccacuguagaaagcagggugugguuagggcugggcagacugggcaccagggcuaauguccgugacccccucugccuacucuuucccucucccagauugcaaagcagcagcagcagcugauucagcagcagcauaagaucaaccuccuucagcagcagauccagguaaccggaggggagacccggagaggcacaggaggcaguugagggaguugacaccggccuggagggugcuggggacaggggaugugcaccaaguuaaagagccagagcagaaucacucaggccugaccugaggaggguuauuucuauucuagcccccaaccugucuuccuucccugauuaaagggaggagcccggcaugucuuccuccccagcugagaccugagggcagguagacaggggcccacagaguuggccuagggucaaagggauccuuuggaaaacugucccugcuuuauccccugugccucuuguccauggguccauucucugugccaugggcugaccauagcuggguagcucuuugggucccuggggacucacacaggguuucuuugccuucagcagguuaacaugccuuaugucaugaucccagccuuccccccaagccaccaaccucugccugucaccccugacucccagcuggccuuacccauucagcccauucccugcaaaccaggugagugugagaagggagguuccaccacugcggccagccuguccugaggucagggaaagcgcccuggagccacucucauccauuaauuugcuauguggacuuucugggccucaguuuuggaucugucugguagaagaaucauccucuuuuucugaaucuugcugaauuucucugaacuucacugggagaaugaaaaaccauaaagcccuuuccagauguaaaaugauguagcaauccaggucuagucucuccaacucuaguacauuuacugugucagaguauuaauaucuggaauauugccaggugugguggcucacgcauguaaucccagcacuuugggaggccgaaguggguggaucacuugaggucaggaauucgaggccagccuggccaacauggugaaaccccaucuuuacuaaaaauacaaaaauuagcugggugugguggugcaugccuguagucccagcuacucagaagacugaggcaggagaaucgcuugaaccugggagguggagguugcagugagcugagaucaugccacugcacuccagccuaggugacagagcgagacuccauuucaaaaaaaaaaaaaaaaucuggaauauuaacuggguuuuacaaaucucccaaauucuuuuuuguuuguuuguguuuuguguuuugagacagagucuuacuuguucugucaccugggcucuggagugcagugguguaaucucagcucacugcugcagccuccaccucccauguucaagcgauucuccugccucagccuccugaguagcuggaauugcaggugcacaccaccauaccuggcuaauuuuuguauuuuuaguagagacgaaauuucgccgcguugcccaggcuggucuccugaccgcaagugauccucccgccucagccucccaaaaugcugggauuacaggcgugagccaacaucucccaaauucuaacagccacgauuccuaccuucacacucuugucccugccuacaccaugucacucuggccuucuaccccaucacugaaauucagcagaauggccaugugucagacaagggugugggaccugacgguacagggcaguuggggagggagcauggagucugggauuuauuuuguaggcuguggggugcaugugaacauuugagaagugagugugucguucuggcuuugagggguggggaguggaggggagacuggccagaagcaggaccugcuaggugauucuagcagcaggggaugauaccugaacuagggcagugacagagaguuauggggacagggcagagaugcugcccauaauuaccccaggaguguggacagcuuuaaaggcaacacgugcuagaucauccucccuguuccacaggcgagaaagagagagagaagaggaaauucccugaggccuauaggccaugggcuuggguagacugcucagccccacuggcucucugcuccugccugguuugugccgggcacuguaggguggugugaaggggaaacacaaaggacugagaaagccaggccccaucuucauccauucaggggcuguagaaagacaccauggaccguguggcucauaaacaacagauguuauuccucacauacaguucugggggcugugaauuccaagaucauaaagccagcauauuuggugucuggugagggcugacuuucugguucacagauggcgucucucacuguguccucagguggugaaagggguaaacgggcucccucaggccucuaaucucauuccugagggcuccacccucaugacccaggcaccucccaaaggucccaccuccuaagucuaucacauugggaauuagauuucaacauaggaauuggggugggggaggcacauucagaccauagcauucugccccagacucuccccaguucauuuucuugucauaugcaaaauauauucauuccaucccaauaggcucccaaaucuuaacuuguuccagcaucaguucaaaaguuucaaguccagagccucaucuaaucucaccuaggccaggcacaguggucaugucugugaucccagcacuuugggaggcuaaggcaggaggauugcuugaggccaggaguucaagaccagccugggcaacaaagugagacccugucucuacaaaaaaaaaaaaaaagccuggcaugguggccugugccuguggucccagcuacuugggaggcugaggcaggaggauugcgugagcccaggaggacaaggcuguagugagcugugucuguaccacugcacacccuccugggagacaaagcgagacauacagagugaggcccugucgcaaaacagacaaaaauaauaauaaaucucaccuaaaucaguuauagguaagacucaagguauaauucauucugaagcaaauuccccuucagaacugaggcaugaauuucugaggucuguaagcuguccaguuuauggcacuuuguuucaacagccugaguagacuaagacaggcccaauguggaaguuuccaguuagcugggggaauggggaguggagaagguugaagguggaggacagggcaauuccaaaccauugcaacuccccaugaguguggaggagagcuguggaggcaaggggacagugaucuggucggggauaggacccccaacugcuuucugggcagguaaggcaguaaauaagcugugggagcccgggacuggcauggcugccucccacuuuguuugcuccagaaauuaagcaagcaaggucccuugcaaaagcugacuguaaacaguggcccuccccagcucacaagccuuacauggugcucuguacccacagcaugggcuccguacuccugaccucggccuucaugggccucggggccaaccuggcccccauggccugccucauuccccacagcucacccucacacaccccaccacuccaucucuacuugcccaaauccugcccauccugcaggcacuagcgcacaccucggcucccacagggagccugcucuaguuaccccagcuggagcagaguuugcuggugcucugucuguguggcccucaucaccaccugccaugcacuucaugauuucuacauguggccuaucucuccaccuggaugcugggccugggagugagguaggguaggcaggagugccaugucgagaagaaggaaaggcuguggagucuagaggcccuggguucaaauccugaugcugccauuucauagcucuguggacaacccauuuuucuucuuauuuuuauuuuuuuaguuuugaaaauuuuaaauucuuuuuuuuuuuuuuugaaacagagucucgcucugucccccagguuggagugcaguggugcaaucucgacucacugcaaccuccgccuccuggguucaagcgauucuccugccucagccuccugaauaucugggauuacaggcgcgugccaccgcacccggcuaauuuuuguauuuuuaguggagaugggguuucaccauguuggucaugcuggucaggguggucucgaacuccugaccuugugauccacccaccuuguccucccaaagugcugggauuacaggcguaagccaccacgccuggcuucaauucuuaauaauagagaugggggucuugcuauguugaccagauuggucuugaacucuuggccucaagcagucuuucugccucagccucccaaagugcuaggcaugagccaccacacccagccccauuugacuucuaagguuuucauuucuuuuucuguaaaaugggaugaugauguauucagccccuguuauauaucacauaccauguauuauugucagaugauacauaugagacguucuacacaacaggcagccgcuuuugugcccugugcccaguagguacaaaauaaaaguagcuguuggaugaauagguguuuuacccucucucauugugccauuggaugggacucuagaaucugggaaacucuauuuagaguggguugggaagggcgggaacccagugaagaugccagucagugugcaggggcaguguggagugaggggauaggagccuccaagcagugcuuuggggcuggggagggcagugguuggaaccaagcugguccagugccgagccauugcccaucuuguggugcugggaccucgucaagcagggugucugcuguucugugcucauccaggacuuuucuccuugcugccuuuuccauaguggaguauccgcugcagcugcugcacagccccccugccccaguggugaagaggccuggggccauggccacccaccacccccugcagguaccgcccucuacccacuggccuggggcucccucucgagcuuaugacggccggcugccguguuagggaacugcgggguguggacuggugagcccuggcauccuguguucuuguucacccgcuccuucugcguccacuuuucugucugucuccuuguguguucuggguaugcucaccucacuuccucucuguccugcugugggaguguccuuuggugucugucauccucugaccugcugggucucccucaggagcccucccagccccugaaccucacagccaagcccaaggcccccgagcugcccaacaccuccagcuccccaagccugaagaugagcagcugugugccccgcccccccagccauggaggccccacgcgggaccugcaguccagccccccgagccugccucuggguaagccuccugcugccugcacuugucccucagcccucuuaggggagagccggcggcaugaugcgaccuugagcaggucccuucuccucccuggguuccagauuuuaucaaaugagggguuagacuugcucuuagcagaagauccccuucuuccucucccucaucauaucugucugggcauuccaagcaucagggauucaggccagagucacauaguuccaggggguacuguugucauuucuagucuauugacaugcacaauaacuagccaguguaaguggcauaucccugaggacaugcaaugcagccgcccuguggaagaacaggagggaacacuaacucaggugccucaugggaguggcauggcgggaagcugauggaguuugggcucaugcugggcugaugcccucagcuucucucgcuucucuucccucucuucugcccucucccacaggcuuccuuggugaaggggacgcugucaccaaagccauccaggaugcucggcagcugcugcacagccacaguggggccuuggauggcucccccaacacccccuuccguaagguauggucccccacucccuugagccuaggggcagcaacagaugguggccaggaguggaagacacagucugaggccaccaagagaggagcauggggaggaguggggugaugcagaggaggcugaugucagguugccccugucaaccuaggaccucaucagccuggacucauccccagccaaggagcggcuggaggacggcugugugcacccacuggaggaagccaugcugagcugcgacauggauggugagggcucaggcgcagggcugaugcgcaggagggcccaacucuguauuccaccagggccagggcugugucugccucugaucucuucccucccuuggucuguuggguccuuuccaggugugugugccucugcugucccauuaugugucugucggcucugucucugagucugcuuuccuaaguuuugugacugcugaguuucugcucucucuugaggccauaccgcugugauuuucuugugugucugucucugguucccuggcugggccucugcggauaauuugcuguuucuucugccccaucugcuccugccuugcuccuccucggcuggcugcugugggagccuccucagugccuccugcuggucaaguaggggacgucucucugcuggcccuggggcacucuccugaccccagacaggcugcuuggcugacuucacuccugucucccaggcucccgccacuuccccgagucccgaaacagcagccacaucaagaggcccaugaacgccuucauggugugggccaaggaugagcggaggaagauccugcaagccuucccagacaugcacaacuccagcaucagcaagauccuugguaagggccaguggcuggggccaugguucagugugaccugguugcaggagccagcugggucuauucagggcuugcuuggugauauuccauacuguguuggacuccaguggaaucugacgacaggggugcaggaguugcuggggaugugagggcagcuggguccuggggucuuauaucacugaaguguucgguagcaccuguccucaagaacucaaggagugugcguguguguguguuuacauucuuuaguacuccugaucuaaaccuaaccuguuccacuguuuguccagacccuugcucuggcagaaaacaggagagacuaguguuccugggcugucacuagaaagauuuuuuuaaauuauauguccugauugguggccacggagggauguugggcagggcagauggagcucgaggggccaguuguuuucaagacugaggcuccuccagugucagcgcaggacucugucaacugagacaucagguauuuuguccugagcagggagccugucuggguuguugaaggucugagguggcugcucuuuuguuuaugcaaaucaggcaggccagaggcucaaggaaguugcuggauuguuaggaacauggguggguacugagucuuaagcuggcaguuggauaucccuauacaggccaacuucauucauuugcccaauauccaaggagcacccguaucgggccaggcccuugcuaagugcuugcacauauauuaucuuauggacccaccuggggaucaaggucuucucagguccugcauggggcuggggguggucagcagagcccagcacugacugccugccccugggggguugggucaggaucucgcuggaaguccaugaccaaccaggagaagcagcccuacuaugaggaacaggcgcggcugagccggcagcaccuggagaaguauccugacuacaaguacaagccgcggcccaagcgcaccugcaucguggagggcaagcggcugcgcgugggagaguacaaggcccugaugaggacccggcgucaggaugcccgccagagcuacgugaucccgugagcaggcccccccgcaggcagccaggagacuguguguacauguguagcucucaugaguggcugggugucaguguguggccugccuuugugugugaccccaggggugcuguguguaugcguacguguguguguuaucuguguauagcugagccugcacgugcgacccgacuguguauggcuauguaugugacuguggugagcacucaguggcugaggauguaggaaugugacuggaggacuggccacguggaccuggagaaagugccuguagaucccacggccgauaaacucaauagaaauucagaggugcuagaaaucaaaguauucaucacacagaaagguuccugacuugacuaaagcaagcacccuagucuauuccuuuaaacaggacaucucccagggcauuuaaaauauacaauuucugccugguauagugacacacgccuguaaugccaacacuuugggaggcugaggcaggaggaucccuugagcucaggaguuugagaccagccugggcaacauagugaaaccucaucuuuaaauaaaauuagccagguguggugguucacaccuguagucccagcuacucaggaggcugaggcaggcucaggaggaucacuugagccugggaggcugacgcugcagucagcugugauuguaccacuguucuccagcaugggugacagagcaugacccugucucuaaauauaaguaaacaaaacauaaaauauacaaguucuaaaaacuggauucacacaugauccuccaagaauauuaucuguugaacacaucuauggcccuaggucugcaggucaucugcagggucguaggugccagugaauuuggccaucagaaagcaggcugggggcaggguauauaagucacagccaagaguguguggagugggagugcaugcucugaggaggccuggaggggagauggguuugggguugaaucaagugugcauccaucaccguuccccuucucugccccacagcccgcaggcuggccaggugcagaugagcuccucagauguccuguacccucgggcagcaggcaugccgcuggcacagccacugguggagcacuaugucccucguagccuggaccccaacaugccugugaucgucaacaccugcagccucagagaggagggugagggcacagaugacaggcacucgguggcugauggcgagauguaccgguacagcgaggacgaggacucggagggcgaagagaagagcgauggggaguugguggugcucacagacugaucccggcugggugggccuggccccuucuccucuggggaagaccuugucccaacucgaugggcacagccagccaaccuaagacuauguugguacuuggacuuguucgugccccagagaugggcaaagcugugcacuugcagauacauucaugaggggagaggcgcccucccuuccugaggagcuguuggccugggugggcaggaacugcaguauggccaugggcugagcaggcugagcaccucagccuuuagggcuuauggccaggggacacuguaugacucuccucuccugcaggugucuauccaccugggguauggcaucuaccgaccugucucccuggggucacaugcuuuguuuccauucuuguccuggcuggaccagccacugugggaccaacaccccucccacacucccccagacugcucgucuaucaccaggaucgcuuuguacuuugugcaaaagggucuggcugucccuugcuguuuucaucucugccaagccuauugugccucuggcugcuguaugugugcgcgugcacguguguguguuucaucuguucauucacugcacaagauauuuauugagugcccacuacgugccaggcacuguugcugaguuccugugggugugucucucgaugccacuccugcuucucugggggccucuuucugugcuucucuuuguccccaaauugcuaccucuuugucagucugggugucucagguucuguguguccuugugugcauuucugucucucucuguccucgucucucugcaaggcccucuauuucucucuuucuuggugucuguccuuugcccccugugcccucuggauucucugggucuauguaggccccuggucugcccugggcucaucagccuuccugaccuccuccugcccuccccuucacucccucccuggcucugccagucgguucccacggagccauuuuuagcucugaucagcaugggaaugugccucggccuccaaggggcuuuguccuggugcccccgccccuggucccaaccugaucccacgagggaguugggacaggaggauugauggugcuccccuuccugccagcgucagaggcccuggagaggggcuguccauggcagcuggucuuuauuccucccucaugagcacagggucggggggguccccauucuuggaagagguugagaagacuccugggcuucagccucucccacccagcccugccccucaccugccugcccuccccucccccacucuauacuagggacuggaucucagccucugaucaguuucacaaaguuuguucccuaaggaaaucaaaucccauugucaccuaacucugaagaucuaaauagcccuuggaucaguaugggaaccccaaaucccacagggccagauguggagucugugucugcccccgucuucucuccauccucaaagcccccacuucucuccaggcuguuucuuuuuuuaugacuguaaacauagauagugcuuuauuuuguuaauaauaagauaaugaugaguaacuuaaccagcacauuucuccuguuuacacucgggggauuuuuuuguuuucugaugacauaauaaagacagaucauuucagaaucuggcccuugugcaggggaggagggaggcuggccuaaguccagaauucccaaauaugccaccag

SEQ ID NO: 12854 - RNA, 8724 nt, Homo sapiens
uccgcuuccgguucuuuauuccggaaguugcucucagaggcagcgugcgggugugcucuuugugaaauuccaccauggcguaccguggccagggucagaaagugcagaagguuauggugcagcccaucguauccuacgcaggaugucaggacuaggagguucgggucagaauacggggugcgaaggcgcaggcugagggcaggccugggauaguggaguacggauccacaucccaugagcccccggggcuaccaagacuggaagaaagcgcggguaguugaaccgugaugguggggagguggucuuggggggaccccugccguggggaaugcaggaauggacgcggcaaaaggagggaagagaacuucaggugcggagugaaaacgggaguuaacgguuuugggaaacuccagggggaugaaaguggaauggauguucuuuagucuuuagaagacccguaacgaaugcccagcugggcacuuguuguuugcguaagcaccagaccucgcguuuaguaaacaaaggugagacgggaauagcgucguccgguuguuucaggaagcagagucuaugcugcuuuuguauuuuuuccuuagccacuguggugcagaaccucaucuucagauacuuacaaaauguacguaaguugcuuguuucguaacuacuuuuuaaauaagaggugaacugauuuaguuuuuuguguuaaccugagcgaucgcuguguucuagaauuuaaaaauagauguaacuggagauuggaggguaauugaggggaaggaguacuuagaaagcacuaaugugaugaagugguguguauccaugccacuucccaacaugcaaagaauuguauccauuacuuugcaagaucaaaaauacuuuuuaauuccaaaaaguauuauuagcagacuugaccaugguauuugggcaucaguaguuuuguuaguagugauuauggcuagaacauuggaaccucuccccuuuaggaugaaacauuggaagaaaaacccagccaacuuaaaccaugucaagaggugguguguuuaauaccugugggaaaacuuaaagacgaaaaaaggaagagagaagggguagcuucagaggaguuuaguggcagcugcuuuccuuugagggaaauuuuagcaacuuaaauuuuauagugugauaacacaacugaaaaacauuaauuucaggugauaauaauucuuaaccaccugaauugagggcuccuguccuaguuguuaggugugugacaugagaaggcuuuguuuuggaacuggauuuugcugcaggagauaagcccuuggucauuagaaauuacugcuuugugcuaugcugucaaaaacuuucacucuuaauagauugagaccagaagcaguaagaaauauugagucccaaaaucacaggaaaauuauuagcuuauacaguuccaauauagaacuuauuaaaugaaaauucuuuuugagguuauuauuauuggugaauaauucuuagauaugggcuaauuaguuaaaacuuuugacuuacauucauuacaauuuuuuuaggagccauauuucucuugucguuugaccaaaaugguuagguuuuguauacuucaauuuuuuggggggcggggggcggggagaucuugcuuaauguugcgcaggcuuauauugaacaccuggccacaaagcgaauuauuccgcuuuggcaucccaaaguaugggaacggugugaaucgaggcaccuggccuguuuuucuuuucuuuuuuuugagacggagucucacugugcccaggcuggagugcaguggcgcgaucucagcucacugcaaccucugccucccggguucaagcgauucuccugcuucagcgucccgaguagcugggacuacaggcgugcgccaccacgcccagcuaauuuuuuuuguauuuuuaguagagaugggguuucaccauguuaacgaggauggucucuaucucuugaccuugugauccaccucccucggccuccgaaagugcugggauuacaggcgugagccaccgcgcccggcccuauuuuucuuuuuuuaacguuuccacuuuuaugauuauuucagagaucgcggauucagguguggcucuaugagcaagugaauaugcggauagaaggcuguaucauugugaguauccaggcgauuucaucucauagcaguucggucguagaaaaagacuuaacagaaagugucuagccagaacaguguauaaaaagucaaagauccaaccuaaggaaaguuuuucaggugcugcuguuuagccuuuuuucauuguugauagauaaggauuggguaguuuuuaauagggaaaauaacuuuuaauucauuuucuuuccucugucuauguugagaagaaaauuuguauuugauuuuugagaaagggcuuuguucuguugcuuaggcuggagugcaguggcacaaucauggcucguugcagccucaaccucccgggcucaaguaguccuccugccucagccucccaaguagcuaggaucagaagcgugcaccaucacagccugcuaaauuuuuauuuuuuauagagaugaggucucacuguguugcccaggcuggucucaaacuccuaggcucaagugauucucccaccucagccucucaaagucuugggauuacaggcaugagccacaacgccuggcugaaaauuaacuuuuaaaaauuauucgaaaaaaaaauauugagcgacaauguuaguauggagaggggggacaaaauaaaugaaauuagggagggugggguuauuuguuguggguuaggugauaccugaauagagagcucagugggguuaguuaaauaaggcuucugggauagcaggcuacccuaaauuuuuuuuuuuaaguugggguccggcucugucacccaggugcucucagcucacugcaaucuugaacuccuuggcucaagugauuuuuccaccucagccucuaguagcugggaacuauaggcauacaccaccagguccagcuaauuuuuaaauauuuugcugggcaagguggcucacgccuguaauccuagcacuuagggaggccgagcaugaugaaucacuuuagcuccagaguucgagaccagccugggcaacaugaugaaacccuguuucuaccaaaaauacaaaaaguagccaggcaugguggugcgcccuguaguuccagcuacuuggggggagcugaggcagaagaauugcuugaacccaggagguccagcugcaguaagccgagguugcaccacugcacucuagccuggaagacaaagugagauccuuucucaaaaaaaaaaaaaaaaaaaaaaaaacuuuggguggaaggugggguggggcuugagaagagugaaucuuugaaguuaguuggaguuuuuaucugcauagguauacucauuuaaaaugguuugaaugugauuuucuuugaagauaacaguuuguuuauuuuucuaggguuuugaugaguauaugaaccuuguauuagaugaugcagaagagauucauucuaaaacaaagucaagaaaacaacuggguaaggauagaaguggucuuacagaauucuagaaauauuuuauucacuugcagaauucagugaccugcaacucaguucauguuugaauuuauuuugcauuugagaaguuauuauucagaguaguaguacacuuuugaaaucauccucuacuacucacuccucaccacacuccauuuuggcuucuccacccagagagcucucaccaagggaaccaaagacuagugguauuaaaucuaaugaucaguacuaauccucauuuuauuaaacucucaacagcauuuggcacuguuggcugcucccuccuuaaagcgcuuuguucccgugucugaguggcaggaaaaacccaaguagauuuuucuguuuccucaguugacaauaauuaacacagaagacuucugugaccagauguaugggcauauuuccccacacaccaagcaagcaaucaguucggcaguggacaucagcucagagucgucaaguucaguucaguucuaacacuaucuaccugagauagcgucaguucccagagguugagggcucaauccccaagauugccuuccaugccccucaguccuccaccagaugcuaauugucagcuccagauuguuuuaccugugcuucuuacugacuggcuauaaacugggucccaugaccccuccguugguuugauuaauuugcuagagcagcucacagaacucggggaaacacuuguauuuacuggucuguuauaaaggauauuacaaaaaguacagaugaagagaugcguagggcaaggcauauaggaagggaugcgaagcuuuugugcccucugcaagcucaccacucugggaaccuccacauguugagcuaucagaaccccauuguuuucaguuuuuauguaagcuucauuauguaggcaugacugauuaaauuggccguuggugaucagcuuaaccuucagcuccuuuccuccuccccgggugggaggguggggcugaaaguccgacaucacuaaugccuugguccuuucagugagcagcucccaugcugaaacguuguaggggcugcuggccaucagucaaucauuagcauacaaaaaggcaacaucuuagagauucuaaggauuuuaggaguuguaugggauugaagaccaaguaaauauuuugcaguaucacaccuuggcucuacgauauuauacuuggguuuuuauuuuucacuucuggcuauuuuucagacuuauauauucauucuugggacccaaucacuaaaugaguugcuccaggcuugguucuaggcccuccugucauucaguauugucugccuaggcacuggaguacagcuucaguuaccaucuauaaauacugacucccaaauuuguuugucugggccuauucaccauuucuacuugaauguuucaaaggcuucuuaaagucagcauaucagaaagcaaacucaauuccaacucacacuguuuagagcuauuguauuauuauuuccugccuuauugaauggcaccaguuuccaguucagcuuacuaauugauuucucugcagcuaccuccaguuugcuuuccaggccucacucaucuuuuaaaaacaccagucugaacauaugucaucccuuugcuugaaauacugcaaugacuuccuguugcuguuaggauaaaaaaaaaucuaaugauucugcaaaucuaaugaucuucaugaucuagucuuaucucccucugcucaucucguaucacugccucacuuucugagcuuuagcaacacuugucuuauuucaguucuuugaaucugcagauuugcccaaccauuaaucuuuguauaugauauuccuugugucuguagagcucagaucaaauaucacuucuuuuaagacagcgguccccuaggccaggugcaguggcucacaccuguaaucccagcacuuugggaggccgaggcggguggauuacgaggucaggaauucaagaccauccuggcuaacauggugaaacccugucuuuccugaaaaaaaaaaaaaaaaaaaaaaauuagcugggcaugguggcgggugccuguaguuccagcuacucgggaggcugaggcaggagaauggcgcgaaccugggaggcggagcuugcagugagcugagaucacgccacugcgcuccagccugggcgacacagcgagacucugucucaaaaaaaaaaaaaaaaacagugguccccaaccauuuuggcaccagggaccgguuuuguggaagacaauuuuucuguggacuggggugugggggauggcuuucggaugauucaggcacauuacauuuauagugcacuuuauuauuauuacauuguaauauauaaugaaauaauuauacaacucaccaucauguagaaucagugggagcccugagccuguuuucccacaacuagacagucccaucugggggugaugggagacagugacagaucaucaggcauuagguucucauaaggagugcgcaaccuagaucccucuuugcccgguucacaauagguuuugcgcuccuaugagaaucuaaggcuuccacugauaugacaggaggcagagcccaggcgggaauacuagugauggggaguggcuguaaauacagaugaagcuccgccaccucgcccacugcucaccucuugcugugugacccaguuucuaacagggaccaggacugguacuggucuguggcccagggguuaggaagcccugcucuaaaaaguucaaaguuuaauuugguuuugcuggggaugggggaaggcgggauuaugugcucccugaguuuguaguaaaaccuuuauuauugaaauuauuuuauuagugucucuccuguuaucagaugcuucaccguaaguguaugagucaugccuuuuuugaucccagugugcucaguaccuaacucaaugccuggcacauaauagaaacuaaaaaauauuugaacaaugaaugguauuucuuucuuuuguuuuuggagacagagucucugucgcucaggcuggaguguaaugacgugauuuuggcucacugcaaccucugccucccagguucaagcaauucuccugccuuagacucccaaguagcugggacuacaggcguguaccaccacgccuggcugauuuuuuguguuuuaguagagacgggguuucacuguguugcccaggcuggucucuaacuucugagcucaggcaauccaccugccucggccucccaaaugcugggauuacaugugugagccacuaagccuggcaaugaaugguauuucuuaacccaguuaaugaauggucuuaggauucacgguuucaucaagacacacugaaucauuucuguuaacaucccauucacuugagguuuauuuaggcauuuugucuuuauuuguuaaaugcucacuaauacuuuuaucagugguggguuucaggugucucucuuucagacccucaggauucucuucaaccugaacuagauauauggaaaguagauucugagaagcaguaugguguuucgcuggcugcuuccugcuuagacuauuuuuaugaaagccuggguuuuuuagauuuauuguuauuuauuuauuuauuuuuuuggagacggagucucacucugucucccaggcuugagugccauggcacaaucucagcucacugcaaccuccaccuccuggguucaagcgauucuccugccucagccucccaaguaacugggauuacagggcaugccaccacaccuggcuaauuuuuuguauuuuaguagaagacggggugucaccguguuguccaggcuggucucgaauccuaagcucaggcauuccacccaccuuggccucccaaagugcugggauuauaggugugagccaccauacccagccggguuuuuuagauuuaaagaugucuugccaggacgggcaagcuuagccuuacugaggucauauuauucauaaauuauuuaccaacuguugaauucccaugguaguauuuauccuguagaauagaauguuauuaauaccugcagaagccugggaaaguagaacaguuuaauuacuguuggaguugaucaacgugucucaaaccguucuaccagugaacaccaguguuccugaagauguuuauaaauuucucagaaaaguauugucuuaaauaaccuuaggaaauuuuggguaaaacagguuuguuuauuguaggauggagucuuuuuuuuuuuuuuuuuuuuuuuuuuuuuuuuuuggagaugaauuuugcucuuguugcccaggcuggagugcaauggugccaucuuggcucacugcaaccuccgccucccggauucaagcaauucuccugccucagccucccaaguagcugggauuacaggcacgcgccaccaggcucugcuaauuuuguauuuuuaguagagauaggguggagucuuuaauauacuaacagcuuuaagaauggaguuauaauaugcuguauuucccaaacuugacauacgacucauuuccaaacuuuuauuacaaauucagcauugggaaauguuguaugaggccuauugaguugacuuaguccauagaaaugauauuugucaugaaaugucaucuaccuauguuagucucuugaaaagauaaauguauucuaauggagccagaaagccuuucacuauauggacacuugaaaauguucacauauuuuuauaagaaagcauuuucaaaauauuguucaaaaacuggauacaaaauucugagaguaaaacaucugaguguguggcuauuaauagcuuuuuguuguuuuuguguugcaggucggaucaugcuaaaaggagauaauauuacucugcuacaaagugucuccaacuagaaaugaucaaugaagugagaaauuguugagaaggauacaguuuguuuuuagauguccuuuguccaaugugaacauuuauucauauuguuuugauuacccucguguuacuacaagauggcaauaaauacuaugggauuguuuguauuaaaaaauuuacauugcuucuuacuauucagcaguagaaacuuuuuacacaguaacaccauucguugcugguauuuaguuuucugaagggucgcaguugccuugagcacuugguauucgcagagcuuggaccuguagauuuugaggcagauuaggaauucugccugauggguaagcuuccaguauugggagguggagaaggggaggguucagaaaaauaaauaagaguuauu

SEQ ID NO: 12855 - RNA, 2798 nt, Homo sapiens
agcacaguuacaagugggcaugaguuuuuauucucagugcacagcaguauugguuucuguucaucagcaaaaagcuuuauuggcuccaacaaauuaucccuuuuaaaacuccucuucuucuucuggucucaguggaacaacacauuugaauuucagauuugcaguuuauagcauuuuuuuucccuaagaaccauauaaauacaugcaaaaccuuguacauagagcuuaaauaauaucaaaaugcaaauauagauugggugcacuguuaagcugaauugcaaauuauggcaacacacacuggacugggguauacguugcuuugauaucaccauuuguuuguuuaugucaugcagaccacaauagucaaucuuuuguuuuucuuuuuuguacaaaaauaccagugcuuguuauacuaguuacuaaaagaagaagaaacucaaaauuccuaucugcgugcuaauuugaaaagaacaacguagauagauuuguuggcacauauauauggcauauucacauauggcauauauacauauggggagaaaacaugaaccaaaggccaauucaguuaugggagcucaucuccuuccaucucuccuaaucaagagcaaagggaacagcaggccuaacagcaggguugggaaggcaaaaggacuggcacugaacuaagugaaagggcgucuggucuauucagaggaagaggcuggaauggcuuaacaauagcaggcauuuauaagugcccacccucaccaaugcaucggggguggucccuagauaugaaaggugaggaagucucugcauacugugaugguaccacgggcugcuucaauuguaaggcaaaggaagcaggaaagaaaggaagggaugcauuuagaggcuuuuccacacaagcgagugugccacgccccucuggguuuucagcagugagguaaccauucagauuuaaccaugccaacucuccucucugaagcucaaggggaagaagaaacucaaacccuaaagaacccacaaguguccagagggauuucuaggugaucucucucuuaaccccuuuagggacaggagagucauuccagaggacagaugauacuaugggaaggaucuagccuuaagacugucacucagggcuagaaccagccauuguuuuauccauuuagaauucuguccccauuuaauauauugcacaaaaucuuucuaggggagggaaggcaucacaaauaagauccuugcacaaaaacucacuaauggaaaacuccagggggaacaggaaauaaaaaccaugaaaaaugcaaaccccaaaucagaguauccuuauagaccaggagauauucgugucuuuuauaccacucugccagcuauucuucaagaaacacaaauccaacagaggccccugauccuaaugacuagucaggaaagauucugucuauccaucugcaugguggggguuggggggaagauucauuuccugacagcugugucccuugcuggguguuuuccugacuauccacaguuuacuacccguuuuucuagguuuauuaagagaggaagcuaggaugauacguucuccuucuccccaucagacccuuuucaaauccaaagcaccauuuuggggaaaaguguuauuaacuuaugccauauuuacccacugccaguuggaucagugaaacugaauagaaaaaacuuauauaaaaaacauaugcacauagacacuuaaacuuaccuaauuccauaucaacaaaauuuauauuaaaaaagucuagaacccaacaauuuuucuucccuaaguauaaagauggcuguuugcagaaagaaaguaugguguauugguuuuaaaaccaauuacaaauauacuaagucaccugucaugccaaacagcugguuaugugcucccuuccacagggcuacaugacggcacuuuauuuuaaauccuuuaaacaaaauacauauggcugacccaaaaauaucaguuucugaucuaaagaaaacuauaauuuuugcauauauuucuauauuuucucuccuauuauggaaacuagaacacaagaaaaaaaaccauugacuuuuaaaaaguagacacaagcccucaaggguaaccugucaggcaccaugagaaccuuuugugaacaggaaugguaaaauagccuucaaagcucguuauuggcuugcuauuuaaaaugaucugagguaauacaagauuugauagaauuaaaucuucuaaaauaguugaugaauauauaugugaaaccuaacaccuugggugagcuguuuuuuuccccuaugaguauuuaagacacaaaaaagaauuauugaagcauguacguuuuacaaaaccaaaaucaaauuugcuuuccuauuuccuacgaugauggauuauguagucauggggauauguaggggacauuguuucuuuauguuuccuacuguggacagcucaggugaaaggggugagggaggacagauccagaagaaaaggcuagguggaucaggucaucuuccucucacaugggaauuuggccguucauacauccccucuucuugacucucaucacucuagaaaggggggugggcuucauuuaucuaaugggaggugagagucagggacaugaacuggccccuacacagaagucaacaccagcagggauacaaauggagcuccugcaaacguggcuccacguugucccaguaaggaacacuuaaaaaaucuccuagcaaaguccccaacuccugagaggcagaugggaaggggaugcuuugggcaguauucaggggaaaaaaaggcacagggcuuuacugggcagcag

SEQ ID NO: 12856 - RNA, 2798 nt, Homo sapiens
cugcugcccaguaaagcccugugccuuuuuuuccccugaauacugcccaaagcauccccuucccaucugccucucaggaguuggggacuuugcuaggagauuuuuuaaguguuccuuacugggacaacguggagccacguuugcaggagcuccauuuguaucccugcugguguugacuucuguguaggggccaguucaugucccugacucucaccucccauuagauaaaugaagcccaccccccuuucuagagugaugagagucaagaagaggggauguaugaacggccaaauucccaugugagaggaagaugaccugauccaccuagccuuuucuucuggaucuguccucccucaccccuuucaccugagcuguccacaguaggaaacauaaagaaacaauguccccuacauauccccaugacuacauaauccaucaucguaggaaauaggaaagcaaauuugauuuugguuuuguaaaacguacaugcuucaauaauucuuuuuugugucuuaaauacucauaggggaaaaaaacagcucacccaagguguuagguuucacauauauauucaucaacuauuuuagaagauuuaauucuaucaaaucuuguauuaccucagaucauuuuaaauagcaagccaauaacgagcuuugaaggcuauuuuaccauuccuguucacaaaagguucucauggugccugacagguuacccuugagggcuugugucuacuuuuuaaaagucaaugguuuuuuuucuuguguucuaguuuccauaauaggagagaaaauauagaaauauaugcaaaaauuauaguuuucuuuagaucagaaacugauauuuuugggucagccauauguauuuuguuuaaaggauuuaaaauaaagugccgucauguagcccuguggaagggagcacauaaccagcuguuuggcaugacaggugacuuaguauauuuguaauugguuuuaaaaccaauacaccauacuuucuuucugcaaacagccaucuuuauacuuagggaagaaaaauuguuggguucuagacuuuuuuaauauaaauuuuguugauauggaauuagguaaguuuaagugucuaugugcauauguuuuuuauauaaguuuuuucuauucaguuucacugauccaacuggcaguggguaaauauggcauaaguuaauaacacuuuuccccaaaauggugcuuuggauuugaaaagggucugauggggagaaggagaacguaucauccuagcuuccucucuuaauaaaccuagaaaaacggguaguaaacuguggauagucaggaaaacacccagcaagggacacagcugucaggaaaugaaucuuccccccaacccccaccaugcagauggauagacagaaucuuuccugacuagucauuaggaucaggggccucuguuggauuuguguuucuugaagaauagcuggcagagugguauaaaagacacgaauaucuccuggucuauaaggauacucugauuugggguuugcauuuuucaugguuuuuauuuccuguucccccuggaguuuuccauuagugaguuuuugugcaaggaucuuauuugugaugccuucccuccccuagaaagauuuugugcaauauauuaaauggggacagaauucuaaauggauaaaacaauggcugguucuagcccugagugacagucuuaaggcuagauccuucccauaguaucaucuguccucuggaaugacucuccugucccuaaagggguuaagagagagaucaccuagaaaucccucuggacacuuguggguucuuuaggguuugaguuucuucuuccccuugagcuucagagaggagaguuggcaugguuaaaucugaaugguuaccucacugcugaaaacccagaggggcguggcacacucgcuuguguggaaaagccucuaaaugcaucccuuccuuucuuuccugcuuccuuugccuuacaauugaagcagcccgugguaccaucacaguaugcagagacuuccucaccuuucauaucuagggaccacccccgaugcauuggugagggugggcacuuauaaaugccugcuauuguuaagccauuccagccucuuccucugaauagaccagacgcccuuucacuuaguucagugccaguccuuuugccuucccaacccugcuguuaggccugcuguucccuuugcucuugauuaggagagauggaaggagaugagcucccauaacugaauuggccuuugguucauguuuucuccccauauguauauaugccauaugugaauaugccauauauaugugccaacaaaucuaucuacguuguucuuuucaaauuagcacgcagauaggaauuuugaguuucuucuucuuuuaguaacuaguauaacaagcacugguauuuuuguacaaaaaagaaaaacaaaagauugacuauuguggucugcaugacauaaacaaacaaauggugauaucaaagcaacguauaccccaguccaguguguguugccauaauuugcaauucagcuuaacagugcacccaaucuauauuugcauuuugauauuauuuaagcucuauguacaagguuuugcauguauuuauaugguucuuagggaaaaaaaaugcuauaaacugcaaaucugaaauucaaauguguuguuccacugagaccagaagaagaagaggaguuuuaaaagggauaauuuguuggagccaauaaagcuuuuugcugaugaacagaaaccaauacugcugugcacugagaauaaaaacucaugcccacuuguaacugugcu

SEQ ID NO: 12857 - RNA, 11073 nt, Homo sapiens
cuggaucuccagcacaacaggcugagcgacggcgucuucaagcccgacaccuuccauggccucaagaaccucaugcagcucaaccuggcccacaacauccugagaaagaugccgcccaggguccccaccgccauucaccagcucuaccuggacaguaacaagauugagaccaucccuaacggauacuucaagagcuuucccaaucuugccuucauucggcuuaacuacaacaagcugacagacaggggacuccccaagaacuccuuuaauaucuccaaccugcuugugcuccaccugucccacaacaggaucagcagugugcccgccaucaacaacaggcuggaacaccuguaccucaacaacaauagcaucgagagugaguggggugggccggggcggggccgaaggcaaggagguuggcuuguguagcacuuccacccucucuagggagacucaggguggggugguauaaaaagcauccacuuuggcacuggacuucaauucauggccuugccacuugcuaucugggugaccuugaaaagauauuugaccagucugggaaguuuccucaucuguaaagugagaaugguaacaauaucuucuaucacaaaggugauaugaggauguaauaguuuaauauggagaaagugcccagaauaccauacuuggagggucauagguuuucuuccuccauucuuccucagccccaguuccuuggcaacuggaucuauagguaggguagacauggaauauacuccuggacauucugcuaaaaacagaacagagacauuuaaauaccuauccugaaauguccugggucugcccucugcagaaaccugccccugugggaagaugcuucuucccaagccugagccuggguuuugauucaggguaugcaacugguaaaaauguggcagucaggaaaagaaggucugcaugcuggugcuuucugaaucuaucuggaagggugcgauguuuaggugcacuuaaggaagaguuugccuaagugacauuuacaggguucuggacuuggaguaucaauugcagcccaggagaggaggcuggaaguugcaguuuugcuucaaucaaaaauuucagcucggagcagagcauuagcagaaagguuuagaagugaaauaauauuuucugguccuugaacaaaaucagccuacauucacagaagggaugcagcagcagaagggaagagagggauugagggaaaagagaaggaccccuagaaugauauuuggggauccuuagguuccaaaccaaagaaugagauggagauuguuggugucucuaccgacaccaacaaugggcgaauagaucguucacucauuugggauaauuucaagaaguaggggaggauuuuuuuuuuaaucuuacaaaaaaaaaaugggaaaaggggaagacuguauaauuuuacccuggagacagcacacuaaaauaaaacacauuacccccaggaagcuaugaggccaaaauacagacagaagggauaccuugauuaauaaauggcugauaggucucuaccagauuguggaagaacagguugcuggaggauaucccaaccuucuaagguugaagucagagaacucacaccucacccacaugagcccaccccauccagccugucuccugugccuuuuacccgacagaaugggcugaguggggccuaggucaguggggugauuacguucuucacaaugaccauaaugcugccacugguacugucuuuaaacagcuuacaaaaugccuuugccaacauucucuccccugauuacagggcaggcaccacucuuaccauuucacagauugaagaacucagcaugaggguggcuaggccacagccccaagcucauaagagaaaacccccgugucagggcccuucugcuacuccaauggcaaagaagaaagacgaggaaaaggaagaggaagacaauuacaaugaagaugaugccuacucuuccuccuccugcuccuccauaaaugauaagugaggcaaggcuuagggagaauaaaacaguucauuuaaaugcuggcaugccuggugccacaggcauccaacaagaugugauggaggaaauggaaucucaggccauggacccuucagaaucaguaggcucaucaugucccggggguuccggagcucuccccagauccucuuuccucuuccugucauccuuauuucaguuaccaucuuuugcccauccucaugucucacauccaauucaaaggaaaaccugcagaguaauuuucacauccaccuacuggcuucagaucucaccuuacuccauugcuucuccacaguguagccggauuaucuuuguacagcauaaaccugaacauagggaucucuaaggacccuuccagauuuaacgcuccaggauaccaugguucaaguauccuguuaauaacaucgcucucacaaagacaguccuguucacugccauuccucagaccagagaucaaaagccucuuagugaaagccuaacuaccuucccagcuuacucuccuuaguacaucacauugggcacuauuacuauucccagauucgcccacaagcagaauuuuggccuccacaacuucauucaaacagauuccucuaucagaacaccaucccccaggucuccaccuguuguaauucuaccuauucuugaaggcccaguucaaaauuuacuuccaauucucuagaguuaacuugcaauaacaguuguugaucaauuccaacuuaauucauuuuacaaaugaguaaacugagccuggaggucaaggcagcucaucuaugaucacacauucccaaagcuagccaguuucagagagaagucuacaguccuugcucucgggugucuucccccuuccccuuccucaucuuggccgccagccuccacucccuucugauuucucgucuucuuuuuccguagaaaucaacggaacccagauuugccccaacgaccuaguggcguuccaugacuucuccucggaccuggagaacgugccacaccugcgcuaccugcggcuggauggaaacuacuugaagccgcccaucccgcuggaccucaugaugugcuuccgccuccugcaguccguggucaucuaggcccuacuccgccaccggaucugcucugaccgcacuugaaggcuggggcccaggcaccugugccggccauucguuuucucucucucccuuucuuucucccagcuuugccucccuuaucccacccucgaggcagggaaaagccaucuauucuucugcagccucaggagcgagacuucaaggacucaguuugguuccacccaguugaaagacacccagugcacacccaaacuccuggccuucugugguuucccuuugcuccagaaacacagaugugucuaaagacuugguguccccuucucucuccucccccacccgccacuccuggguacaucugggccguggacuaucugaucuugguccuggccgagcaaacagcccggagguaagguucagaaagucccccuggggacuccuccaucuucggcagcucuggcucaaagaggccgagaaacccaguucuccugggccaaggaucccuucuggcaaagcugcugcuccgccgcuugguuccccggcaccagacaucgcccuggcccugcuggcccggguaucgggaaggaggagcgagggaaugacggagguagggugcagggucagggcucccgcaggggccugcaucuggccagcaggacacagggaugcgcagggcgcccccuucuguuccagggugaacauagcacacgcccuccuggcugggccucaggaggaacagccaaggagaagaauggcccaaggaacuaggaagcagccaugggagaggggaaggguucaagcccgggaugggcccgcgugacgucgauggguccugcggcccccuugcccaaccucggguuuagggaggaggguucacaguguuuuugugggggcgggggaaggaagaggcagccccgcccccgccaucuguucuccaucagugugcgcggcccagccauuuccacccucgggaggcggcuccugagaaacagggaggaaggggcggagcaccuggacgucucccagaagccccuccacguuugaaaaugcgccuccuccucggagacagacgcaucggugccaccuaguggcuggugggaguaacagcuggucccagucuugcgccuggcccucuuccuggggugauuuuccucgguggaggaggcccguggggucccaacacggaagagccaugggccgugugcauggugucgcucuccucuagggucuagcgggcacaaacguccccaggcugggcucauucccaucgugagugagcccaggugaggacauagucggcucccguuuguuguaggcccuucccaggugccuucucagcucccucaucuguaaaccgaggagguggauaagaugcucccggccgggcgcgguggcucacgccuguaaucccagcacuuugggaggccgaggcgggcagauuauugccugagcucaggaguucgaaaccacccugggcaacauggugaaacccccgucucuacuaaaauacaaaaaaauuagccaggcauaguggcgcgcgccuauaaucccagcuacugggaggcugaggcgggagaaucgcuugagccggggaggcggagguugcagugaggcgagauugugccacugcacuccagcuugggcgacagagugagacuccgucucaaaaaagaaaaaaaaaagaugcuccucugaggucccuccggcgcucauguuccgagucugcagcuccacacuuuaaaucauacucgaaugcaggacaaguccuaaauauuugccccuucccuugcaguaauuuauuuucuguauggacugucccucccccagaggcuuccccacccuccauugccuggcccaggugagcagcuuggcaggucuccaaguggaacccgguccagacagggcugccucgacuucaccuuucccccuaacuuccuccaagggaugcugccccuucucagcccccugcguguguauauuggugggaggcauagaggauggauguucuagaaaugaguaagacacagugcccacccccaaguuaggaugaaaaaaguuccagagguuuuuaagaaauuggauuaagcugggucccuaacuucaagaaauucccauuaugcuccuucucaccuuucuuuuuugcuaauuauggaaaauagggcccauuucaucauagccuccuucccccgugcuccacuacaaucgccgcauucuuucuagcugcagcugguuucuucaaggcuccugcuuaaaguccacacguuauuauggccgaaagcaaccuggugcuucggccuggauaagagccccuucugcaucuuauucacagcuugcagccucagccccuuugaugaggcccucaggggagaggucauuaccuugauccugcaaacccagacucguugagcagcaacgcaaucaccaucaucccacugcccaaucuagaauaugucugcucuccuuugcucucugcagcuguaagccagaggggauucaagguaaauaggcuuuacaggcuccccuccuccaaacacacacagaaugggcugguuucuuucaaguuuaaaaaaagcccccuucuccaugcacaaguucauucccuccaugcugucgucaucgacauauacagguguguacguagguguauguguguacucugcacguauaucucuucugucuugaagacccuguuaacuuugugaaauaacuuccacauuucaacacacuucacaguacaggaaauaaaguaauaugaaaaacacccugcgugaacucaacggugugaacaggucaagaauaacacuucaaagucaucuugccagccaggcgugguggaucacgccuguaaucccagcacucugggaggccaaagcgggcagaucaccugaggucaggaguucaagaccagccuggccaacauagugaaaccccuuguuuacucaaaauacaaaaauuggcugggugcggugguacaugccuguagucccagcuacuugggaggcugaggcaggagaauugcuugaacccuggaggcagaaguugcagugagccgagaucgcaccacugcacuccagccuaggagacaaaacgagacuucauuuaaaaaaaauaaaaauaaaaauaaaaauaaagucaucuugccacccacccccuaccauugagccaccaugcccagccccaaagccucuuaauugcucuaacaagaugaguggggaaaagauuauacucuuaagaaauuccuacgaaagcuauccaaaagccuuuucuuuccucuuuucuuauuauuuuuaaauagaggcagggucucauuauguugcccaggcuggucuggaacuccuggccucaagugauccucccaccuuggccuccccagagugcugggauuacacacgugagucaccaugcccagccccaaagccauuucuugaagaauuucucgcaaacucacaacccucaugaaaaauuaauccucaguuccacgagacugcccacccacagacaaaaaaauauauauauuccuaaagucggaccagaaaucugacagcugccuuugaaacccaaagccucggguucuuucaagcuacauguacuaaauugucgaaggucucccaggagcucuguacugaggcagacacagaaagacacaaaacggucgucuuuccugcccaaguaaagcuuacagacuaacuggggagauguagugugcauacaaaacaguaaaagagccaucucaaggacagagagcauagaccaagucaucuggaauggucuacaugccaugcggaaguccaccgaaggguuagaacagggugucccagacucucucuucugagggaagguugguugcaaaagugggauucaugacccucccaggcuacaccaucuucuuuagaaugagaacugccaggugacgcccucgcugcuccuaccuggcuacuaaacaucgacuucgguucacuucacggauguucaguggauaucggucacaugccagguccccagcuacgcauucaaggauggauaauauacauagcagcacauccuugaggaacucauaccuugguaaagggaaagaaauccaugaauggauaccucuguguccuaaguguuuguaauaaugcugugugucaggccucugagcccaagcuaagccaucauauccccugugaccugcaugugcacauccagacggcugguuccuaccuuaacugaugauauuccaccacaaaagaagugaaaauggcuggucccugccuuaacugaugacauuaccuugugaaauuccuucuccuggcucauccuggcucaaaagcucccccacugaacaccuugcaacccccaccccuggccaccagagaacaacccccuuugacuguaauuuuccauuaccuacccacaucuuauaaaauggccccaucccuaucucccuucgcugacucuuuucggacucagcccgccugcacccaggugaaauaaacagccuuguugcucacacaaagccuguuugguggucgcuucacacagacacgagugaaacuacuguguaugaacaguauaaaggaaagggcuuuuaccucuaccugaggaaaaccagaaagacuccuaccaugugagcuggcucuuaagggauaaaucagauuuugccagguggaugaaagaaaaaaagacgccaccuggacaggaaacagcaugaguacaaagguaggaagguguggagucuacccuguggggcuugugugucugaaaaagaggagagggucauguuccggucauggaguggaguuauguggcuacaagcccucagcaggggauauaccccugucauccaaaacacaggaggguuccugaacuuccccgccucucucucccuauccaugaaaagggcaacaacaggguuggcuggucaaacuucuguccauaccaccugccgccuccgauucaucaacacgccuuuugccucuccuaaugagagauuaggauuaggacgccucccccgccuccugcuuccuuugccaggcucuuggggagcugggcugccuggaacagcagucugcgggguuagccguuucccccaccaggucacauguacacauccauggacagccccuaauauucaugagaacaagagugugugaccugugagcuugggaaagcaagaggagaaguugggagagggucuaggaugcgagccugagucuggauguggcuccugcagggaguggggggagcagguguguaugcauuggggaggaacgaugguggggguguggcaaccaagcagggauggcaggagcguaugucucugggaaagcagggagggagagugggagcaggcggcagggagagugaaugaacacucgcauuugcauuucucccaggaauaaauguguggggugggagcggggagauugccuaggcuggcuguggggguggagggccucuggcugcaaagcccaggcuguggagagaagauggaggcauacagcccgccaaaugugccaucugccuacuggaugcccuccaggauccagggcuaucuuucccuccacccagcagagccucugauggugucuuuucccagguggggggcugccagggguacaagaacaugcucuucucuggugaccaggcucuugggcugagggaagcccccucuugcaccagcuggagcccaggaacacagcaagccaaaugcugcccucgagggccaggcuauuagaucugccucuucaccuggugugccagggcagagaugaguucugccaagccaucugcucugagggccuggaaacacacggauucaggacuccuggggaagaagguggaaauggggagggucauaugaacuaaagaaaacucucugaccagggagucaaaaaaucuaggcauuggcccuggcucugugugaccuagggcaagucacgucaccucuuugggccucacucuccucaucuauaccacaaggacuuggacuagaucuuuagggggccucacagcuggaauucaguaucugguugguggaaaggaguagggaacaaggagagucacugagaaaccugggugggcgccagggcacaggcuggcagaagcuggggaagacuccuuagccaccccaccucugccuucagcaaggacuugcucggcagccugcucgaggcaccaaggaaaggggaguguuuccagaugaaugccguuggcccucuguaucuguggguuccacauccguggauucaaccaaccacagauugaaaauauucagaaaaaaaaaaaauucacaacguuccaaaaaggaaaacuugaauuugcugugugccaguacuauguggaauccaugugaauggagugagguguaagcauuguguuugguguuauagguaaucuagagaugauuugaaguacacaggaggaugugcguagguuaugugcaaauucaccauuuuauauaaaagaccucagcauauguggauuugguauccacuggacgugcagaaccaaucccccaugguuacugagggacgacuguacaucucugagggugcgggagaggauacuucccaggcccccgagacccuacacaaugucuacugguguuuaugauccuuucuagggcccaccucccaauuuccauuugguuuccuccuagcagauuuagagaauuucccguauccucaugaucaucaucugugaacuugaaguuggcuuucaaauccgaucucaucccccauacaccuucucuuugaacuaccuaggccugcagcuccugucucuggugauuuuauucaauuauggucucugugcuggcgcucuaggugagggugaagugccucauuuccaccuauuuuuaucuuuggauucuggcuaugaagcugaagccuugucacucucuggcuggagaaagaagcugcaaagacaagcucuaucucuccauaucccccgacuccagccuucucugaggacucagaaucugagggauggggccccuuccuugcaggggauggcacucccuguuccucaaagauguggccuuaucaggagaguggacaaggaaaagaaagaaggagcugacagaguaagaggagagagagcaggagcuggagguggggggugaagcggaagguggggggagaauucucuuuugucaaauacaggaauggggcaggggacccccugaggaaagaggaggggaaacagcuggacaucagaaggaaugagaagucugauuggucgcaggccuggccaacuccuugcccucccccgggcaccacugucuaacccaagccccaguucagacagccuccaccagaguccccaccuuucuggaagcugcagggcucuccauccaggauccagaagcauugaagggguaaggcucaagguugaggccucuggccaucggugcgcaaaugagggcaaaguguuuggcuggggcaggggauugggaagggaaaaugaagagaguuuaggccucuggccaaagaaguuggacaagacuuuugggugggcacuaaacucucuuagaaaaauuuuuuuugagauuauguaauucguuuggggugagguaugggagguaaggugaagaaacaccucuugcuacugcuagaggcuugcccccuugcccagcuaaaauuaagaaaggguggggagguuaacugggcaugguaacacacgccuguagucccagcuacuugggaggcugaggcaggaggacugccugagcccaggagguuaaggcuucagugagcugagaucaugccauaacacuccaggcugggcaacagagugacaccgucuuaaaaauagaaaauaaaauaaaaauuaaaagauaaaaaaaauuuuaaaagaaagaaagagggagagucuacuagaaacuugugcagcuagcuuuggggagggcuguguuaagccuacacuggguaugacuguuguauacacuuaugccuggauacaaaaccacaccacaugcauuuccugacccgucuauacauauacgaacuacauga

SEQ ID NO: 12858 - RNA, 19263 nt, Homo sapiens
ccagagaggaaaguuccugcagaaaguucuuguccccuacauguagccuaggaaaugucagagggcugcucggccagaaggggccuggugggauggagggugugccccacagcagcaucagccaggagccauguacguccccuccccacagacacccuccauccccguuggagcugccacugcauaaaccugccucaagcugcuggguggccccccacggguaccaaggacugagauggaguauuucacgauccuggugaaaugagcacuuggauccagaaauuagagaagugaaaugauaggauaaaguuguguuucugucacuacugagcugauggacugccuugaauaccugagacauaaaaggagaaaacugaggcucaggaagggcugcguagcccaaggccgccccguuagcauggagaggaggcagagccaggccugcaaccaaguuugugagacuccaacuccagcacugccuaccuuaaaaaugaggaggucuccauccuggcuaacauggugaaaccccgucucuacuaaaaaauacaaaaaauuagccaggcgugguggcgggcgccuguagucccagcuacuugggaggcuaagccggagaauggcgugaauccaggaggcggagcucgaagugagccaagauugugccacugcacucuagccugggcgacagagugagacuccaucucaaaaaaaaaaaaaaaaaaaaaaaaaugaggagcccaggccggugagguggcucacuccuguaaucccagcacuuugggaggccaagggaggaagauuaccugaggucaggaguucgaggccaagaccagccuggucaacauggugaagccccuucucuacuaaaaauacaaaaauuagccggguuugguggcgggcaccuguaaucccagcuacucgggaggcugagacaggagaaucacuugaacccuggagacagagauugcagugagccgagauugcaccauugcacaccagccuggcgacaagagggagacucugucacaaaaaaaaaaaaaaaaaaaaaaaagaggagcccaaauguucaccaagagagacugucaacuaaauaaauauuggggggugggggcagagaaagaaucaccaaaaggaccaauaugaucaucuucaaaagauaccuguaccacuaagugaaaauaaaagugcauagcugcuuauuuguuacuaguguguaccuuaaauaaaucugugaggacacaagaaacuggcgcacgguccucugggggaaagugagugaugaggggauaggcaagggaaaagacuuuuucccuaugcaagcucuuauaccucuuagauuuucaaucaagagaauguauuaccuauucaaaaaauaauaaccuuuuuuuaaaaaaagagggugacagagaaucuccuuguucaacccucuuaaauucaaugaaacagaccccuacugagcacccagggugugccaagccguuggugggugcuguggguuauaccaugaugaacaggaugcugucucugcccagcaggggcccacucaccccaggcaacccaggccccccaggcuggagggugggacaggcugccacaggacucacacagcuucucccccguuaugcauuugcccagaccccacccacccuggacugggagccucaacuaguacagggugaggguccguccagggccagccucuguggguccugaugaccacugagcaguuugagccaaacucuucgggcccacacugcuccuucccggcaaagucucaggaccaccacgggggaggugggaagcuugaguaccucccuccuguacuucuauggaaagaguauuacacaauuguguccuuucuucucuugcuuuaagcacucacugcuuguaaccaaggcagcaauuacugugagggucaaagaaaugguaagccccccagauggauuucggucuggaugggaagugugggcaggucccaacucugcaaaugcagcugaaacccaccaacuuggagagcccccucccucugcugccuggcccucccugcauucugucuccuaaccaugcugccccuagcccucuccuaggaccaggcagcaguagcagcaacaaugugcauaucuggacuucucaccauaugccccagcauucacaucaugugccugugacuguucucuggcuacaccagcaagagauaaauaccuccccuggguugaagacacaccacuggugucccugagacucuaggagaguagaggaggcucuuccuggaggauccacauagucccagggugcaugaagccagugaaucacaaaauacuccccugccauugcugccaaugauccuuguguuaucuuggguauacccugggagggagauggggcagaugagaaaaccaaggcucgugugcugagaccuacucaccagguagcuagagaacagcagaguugacaucuuaauccagguuuccuaaccccaaaccuuauacucucucuucacaguauuguuggaagagcacugagaggucauuugguacaaccucguguuuuauaaauggcaaacugaggucagagagggagagagacaucuucaaggucacacagcaugcaauggggcaaagccaggucccaagaaccuggaccccugucuaccaggauggcgacuguguugaacugggaagugcuuguccugacuaaagguguucaaauccuuuuuuuuuuuuuuaaccaaugcuucaaaauauaccaguaggguuugugggaguggggaacacagaagaaacaagauuggccaugagucgguaauuguugaagcuagguauuagauaauggggauauuaauacuauacuguguaaauauguauacguuuuaaaauuuccacaaaacuuuuaaaaaauuaacgugcugucaaaaaaaauuagguacucaagccauauuagguccacaagccacugauuagcaaacucuauucuggacacuccugaauauccugcuggccaugucuauacuucuuuccaauucucucugcauagcgugggaugcgggagauaggagagggaggaagggagauaacuggcuuaggcagggcuuggaaguuggccauccauucccgagagcauagacucuugggauuuggauggcugucauacaaauggauacaggugacaccccugccccugcccauacuccacacuccuuccagucugucuauccccacagacacucuacccaucaucccuguaccucacuguacuuugcucaccuuauuauuuuuugagacagggucuugcucugugacccaggcuggagggcacuggcguaaucauagcucauuacagccuuggucuccuggccucaaauaauccucucaccucagucuccuaaguagcugggacuucagguacacaccaccacacccagcuaauuuuuaaauuauuuguacaaacaggguccccccauauggcccaggcuggucucgaacuccugggcuccauuaaucuucugccuucgucucccauagugcugggauuacagacaugagucuccgugcccagccagucuuuuuugcccucuaucaucuaccacccaccauaccaagggaaacaagcaaaucuggcgucugauguucccggccugcagaagacgccauaucccaucuggaugagaaaugaagcacaugagcagccuggcagagccacaguuaaugugaaccuggagaggaaccgugcugucuuccagcaagaccucaccagcagggcgugaagccaugagaucugggguggaaggggguuggagaaaggucuggguuuuauuuuuccuucuccuuuucuuaggcuaauuaccauucaucgcaaucccuuuccuaaacccuaauaucuucccaguuuauaaagugcucucacauuuacaauauuuaaucuucccaacccugugaggucaauauuauccauauuuuguaaaugaggaaacugaagguccucaugaucaagugauucaccuaagaccauagcuuguggguggcugagcccagggcugcagacccuaauuuuaauguucucuccucuaccccauauugcggagggcaggcaggcaguccccugucauggggcucugcagcucuccauggaaccaauaauggagaagaaaauugcguugcauuuucuaaguagucagcugggauggcaggaauuuauuuauuuuauuuacuuauuuauuuuuugagacagagucacgcucuuguugcccaggcuggagugcaguggcacgaucuuggcucacugcaagcuuugccucccagguucaagcaauucuccugccucagccucccuaguagcugggacuacagaugcccgccaccacacccagcuaauuuuuuuguauuuuuaguacagacaggguuucaccauguuggccagguuggccucaaacuccugaccucaggugauccgccugccucugccucccacaguacugggauuacaggcgugagccacugugccuggccauggcaggaaauuuugaugggcaucuacuuaccugcaaguguguugugcuuucuuaauugaggggcauuguuagaggauuguuagagguagugguguuacuugacugggucuucugggguguugaugugcacaggggaaauuuggauuucccaucacuuugugugaugaccacacagccccuaaaucucaccuaagugugauauggagaagcugaaagaagccacuacauuguccacaugagcuaggaacagugacuuuaggucuuacauuaaaucuuaauucugccuuaacuuugcugugcaacucaggccagacuucucccucucugguucucagaacagcccuggcagccaaaccgaaguuaucuccuaugccagccugagacuccacucccuuugcaaccuccuggagaagauaacuuagggaaagacugucacugcucagaggaagcaucccaaaccccucacugguuuaggaauuuaacacuaccgagcaacggccccagaaggcaaggcgauuguuaggaggaauuaaacaggcuagugcuggacccagccauccaguccuggcuuacacagagguugcuuuucaugccuuuucacucuguuaauuuggcuuguuuuccaaacaugggucaaacaaccccucuccagaagcggcagcagcagaaggaaauguuauuaaaaaugagucuguuagugggaaugguguguggaugaagucuuugggaguuuuggcugccaaauaaagacuuuauugucauuccuccuuucccaagcucccucccucucuccuccccuccccucccucccuccucccuccucuccuccccucccucccuaugaucugccccucccuccccccaagcuaaccuccccaccccaauaggaucugguggaagaaaagucaggcaaacacaagcacgcacacaccacugggagaucagaucuucuagcuggcucucugcugccacagcuccgccgaagggaggggguggaagaggaggacuaaacucagagcugagaggagaggcaggugugugcagguaagcccaguugggagaugggcaggagacugggaagaaucuuucauccaguaaguuuccuccagcucuguccauuuauugaucuagucucuauccucucacuccuuccuuccucccaccucuuucuccucucaaaugaguucaaauuuagucuuccuaacuucuuuccuauagccucuuccuuuucuuuucaucacucuguaccccuauauuugcuuacugcaaaaguuaagcuuuccugcugcagauguuuguuguagcacagagagccacgcugcacaaaguguuucuacagaucagguguuuccauagaaacuggacuccagaacccauuucuuugcaccuuuuguguauugucacacauuguggaagucacacacaucacacggaggcugcacguucacuaccaucaccccacacgaccauacaaaaugaagacauccuguccauucaccucugcccucugcaucugacaugcagagcuagaccacaucaucaccagacaccagcagacacacacacacaugcaugcacacauguucccugcaucuugucucucgcccucucacacacaccucccuagcuguaagagcaaagauaaaguacguuuucccacugagauggcagagccagaagaaaaucuugcaucccaaguccaggccgaauagggaggagauaagcaagagcgggagcuggaaggguuucuucauuauuuagggcuucacuggguaggagggagagaaaaacggcuuuuuccaaccugcacagugucuucucagcagcuuucaauuucugucucacugguccaaaccacuuggcuuuuggaaagaaagaagaaagcgacccaguucccaauccuugaagguccuaauucccagcucuggggacaguucauuuuuuuauuuuuuuuuccugcaggcagccagaaaaauauuuuucuuuaaagccguucugaaauuauuccaaccauuuagguuggcaaaagguccuguggcagaggagaaaaaaaaaaaaaggcagcaguuccuuaagcaguuggggaggggaaaacugaagggcggccccucuccugcuccccugcucauuccucucuauuaauagagagggucugucccaaggcaggcgggguguagggagaucaggggucccacacacagcugaucuucacagucaccuaagggcuggagagggaggaguguggagggcuuacuaaaaauacagaugucggcucucacugcagaucuacugaaucgagacccaggaaucuuguuuuaauacuucaggagauucugaugguccaccagggcucgagaaucaggggccugagagagagcuuugcuguaauuuuuaagcccaagacuccggcaguguuagcugggcagaaggacuguguccuggaaaaggagcaccagagugucccaaauaggccaccucuuuuuuggggagugggaguaaacagggaagagcugucucccucucuccuccuugcaagcacaagcagccauauauaccacagaggaacauuccaguaagaaaguucccccaagauggcuccacagagcuucuguuuccccucaccuguuaaucugccugccccaggaccccaggagcaugugcugggcccuuccccugacccuuauaggucccugcuccuccuucccagcagccaccugucugggcucucacagagggugagcugaacacuuucuucaugcccccuccaccucccuagugggcaaucccauuuauugggcaugugagugaagcauuucaaggcuggaaggggcaaaaagcugggagaagucaagaaucgcaguggaacuccauggcccacugaggaaggcagacuugcaccuucuguggccaguguccccucaccuguugcagaaagcaucggugagaaguuggugaauuagaaagacagaacaagcuuucccuagguggcuggggacuuccagagucuccucaguuaguuguuucugagacccaagugugaucucacaagccacaaaggggaggaaguugcucuguguggaagagcugguaccccacucacaaggaucccugccuucgagcagugcaugggggcugcccucuagccaggcuggagggaaggagaccccauuacuuugaaauaauaucaacaagaccuuaacauucagaaaacacucacuuugcauguauuaacucauuuaacccucaaaacagaaaagaagguguuaguauccccauuuuauagagcagaaaagcaauugcuuugccuaagccuaccuagcuaagcaucugaaugaagaacugcaggauugggucucagaucuauaaucacucaaggcaucagacacacucuucuaggcuuucuucaaggcuuggagaugcugggggaauggggcagaggauaugguagguggcgggcugucagagaagagucgucucacccugguuucuuccccaccgcucagaauggaaaacuuucucuucuaaacuaguggccugaggccagaaaaucuucauucuguuuacacuuugccuugugguagacacuggggagacagauggucucuccauaauaguguuauuuuuauuuuuagcacuuuuugaucuguagugcauuuuaaagcugcuaacugcacuugcuucugacaauuggguaaggaauauagguauagggaagauuuuuuuauucccauuuuacagauaagaaaacugaggcccagaacaggguucgcaucacuagguagugguggaggggugagaaucuucucuccuaacuaguaugcaccacaggcucuccucccacugccccaggcaagcucauccuuguaucguuucaccuuccuagaaaggggcaucuugaagucaucaugcccccauaaggcuccuuuguuaucucaggaccacaucagcccuaaugggggccuugaaagggccucaggcucacuccucuacuaacucugcucauaaauuggcaaagacugcuugauucucccugcuuccaacacccuucuggacuacaggaagagauacagagagcaggauggcuuucagacaccuagguugagaacagaaagaagggaaaaaagagagagggguguuccgacauucaccggcacagcgcuaggucagaagcagccccauucuccacugcaggguagcucugggucaaggcauggaggcuuaggggugaccaauuagacaggagaucugacaaguaagaagaaugccaguucagagugcggcguaacccugcugcuagcccugccuagcccugggagacaaacccaaccucauucccagcccaaccucaaccucuccauacaaagccaauuagccuuaaauagcugcuccuaaugacuugaccaacccaucaggacuuccacccaacccugcccugagcagaaacauuccaccacuccuggguuuuaacauuaaauuaaugagagagauagggaagggggcuaucucacuuuaaaaaucaaggaguccuuggggcgcuguggcucaugccuguaaucccagcacuuugggagacugaggaggacagaucacuugagcucagggguuggagaccagccugggcaacaugguaaaaccccaucucuacaaaaaagacaaaaauuagccagcugugguagcacaugccuauaguacuagcugcucaggacgcugagauggaaggaucaccugagcccagggagguuaaggcugcagugagcugugauugcacuacugcacucuagccuggucaacaaagggagacccuguaucaccaaaaaaaaaaaaaaaaaaaaaaaaaaaaaaucaaggagucucucuagagaaucugcuguuuauaaacaaauaaaugaguaaguaagccucugccacuugcagagauuuugcacuuuauaacaugccuucaaaugcaugaucucauuugauccucacacagaugaggagcccggguuggagagucagagccaggagucaagcccagauccacaauaguuggaauugaaauuagaauuuaaaacucucuuagaggcugggugcaguggcucacaccuguaaucucagcaauuugaaaggccgaggugggaggauugcuugagcuuaggaguucaagaccagccugagcaauacagugagacccccaucucauuuuuguuuaaagugaaaaaagaaaaaaaaauuaagauucucuuaggaaacguucuuuaauguggagagugaauguuggguugggcaaagcaauugccuuucucuuccgugaagcagcagcuuuuccagaacugaugguggagagcagaacugcaugcaguuggcuguuguagguggucaacaaaccuucacugauugagcaaugagcagagcccaguagaaagcuguggguggagaagugcacuugugaaagcauaagaaaaauuuaaaaacacacacauggacccauccuaaggaaucuuaugauuggacagaaguuucuagaaggcaggagcauagagugugggucugaggcuuuguaggagggacuaugacuacccauggaguccagguacccucagucugucacacagauucugguuucagagaccuaggacaucacggagcacugccagagagaauggcugugcugucagcugucagaacuuuucauccugccucauggcaaagcuccggcaggaaggggcaucaccccaugagaaaagccuuagaaaugaaugcuauuuccuuaagagagaagcaucccugcacuuggaaugguucugauucagcccuggggcugagggaaggggaggagagcaggcucagcuuccccacauaacuugcuccugggagcauuuccuggggaaccuccuguuggcucugggagcagcuuggcuaggcccagagguuuggaauguaaacgggucagaggacuagugaaaagauaaguucccaaagggucuggugcugcacauggggaugaggaaggccuguguuuacuguggaugagaaggcgcgcacagccagccugcuggguggagcugugaguaaccugccuguuccucucaccccugacaaugaagaccagggcugcccuggcacugagccaaggaaaccccgccccgcccagcacaggucacagccacagugccucacugcuuuugcuggaagcccugggcaaauuggugcccagucccuggcauaugcuuucggugacaaaggcaaugaagggauauagaaaaacucccgccagugcugggagccuccuugggacagggcuucucacaguaugaaagauuucuagaucauuucuaggcuucugggugauuagaaaauaaauuuuuuuuuuuaaaucagggucacaaaaauugaggcuuuuagaaauguuuguuuuagaauaccaaugcuuuaacuacccccuuaauuuauaugcaagaugacuguucuguuuuccagaaaauuacagaacuuacacaauguuaauucauaguucaccaauuacaagugaagugggguucagccaacaagacucaagcuuaaaguuuugcaauuaaugccuucucuuuuuaacccuugcaauguaucucugacaauguuauauccuuaacgggagaucaagccaaaaaccuaacugcaagguccuuugugauaggaggccagggaaaauggccuuccagaccuccuuggagaggccugccuuggaagagaccaccuuagagggagguggagaaagacagucucugccuuccuucccuuccgccuuccuucuuuccuuccaauacucaguguacugcguaugggcucauauacgcacacagaggauaagugagugaguuugcuuaugugcaugggaccugaagaggugugugugugagugugcagacuggaucugcuguuaaacagcaucuuggccuuggcgagccacuucuuccuuccaguccucaguuuuugcaaaugguggggucuggaguugauugguggauuucaagccauuuuuagcaaagaaacguguccccugccccucaacaaaugaaugcuucggcuaaaccucaauauauauaauagguuuuuuuaaagagagcugcugagguuggcacagggauggguugaggguaccccagggccaucuccucagucuccuccccacagggguaugucacagaaaugaaagcagaguuggaaaaccacuagguuauaggaucuuuaaggaccuuucuggauuuaaccaggacgcuaagguucauacauccuaacaucccucucaugaagacacugaugauuuucucaugcugugaaugggaggacugagggccagagugguuaagggucuucucugacaagccccaggacuccugacucggaguccagugugcuuucuuucuuucuuuuuuuuuuuuugagaaagaguuuugcucuuguugcccaggcuggagugcauuggugcaaucucggcucacugcaaccuccuccuccuggguucaagcgauucuccugccucagccucccaaguagcugagauuacagguguccaacaccacacccugcuaauuuuuuguauuuaguagagaugggguuucuccauguuggucaggcugaucucgaacuccugaccugaagugauccacccgccuuggccucccaaagugcugggauuacaggcuuguaugccacugucccaccagccccaaugugccuuuuuuuuuuuuuuuuuuuuuuuugagauggagucucacucugucacccaggcuggagugcaguggugcaaucucggcucacugcaaacuccgccucccggguucacgccauucuccugccucagccucccaaguagcugggauuacaggcacccgccaccacgccuggcuaauuuuuuguauuuuuaguagagacaggguuucaccguguuagccaggauggucucgaucuccugaccucaugaucugcccaccuuggccucccaaagugcuggauuacaggugugagccaccgcaccuggccaccaaugugcuuucuaccagcaugucccccgcccucuucagagcaggcucaacacaucgaguggcuaagccaauggccagggaauccagagccucaagcccuuguuauucccuuaccugcuggguacaggcaaacaaggagaugcuuccacagcucccugagcucugcccaucuucccuagagcucuaguucugcccaacucuggcuucaaaaacaugacaacuaguuacugagggcccaaggauaaugaccuuaugugucuucucccugcaggugcaucaccuggaucaugaggucaccccucugcuggcuccucccacuucucaucuuggccucaguggcccaaggccagccaacaagacgaccaagacccgggacugggcccgggcgcagacccaggcccaggcccaggcccacacccagcuuuccucagccugaugaaccagcagagccaacagaccugccuccuccccucccuccaggcccuccaucuaucuucccugacuguccccgcgaaugcuacugccccccugauuucccaucugcccucuacugugauagccgcaaccugcgaaaggucccugucaucccgccccgcauccauuaccucuaucuccagaacaacuucaucacugagcucccgguggaguccuuccagaaugccacaggccugcgauggauuaaccuggacaacaaccgaauccgcaagauagaccagagggugcuggagaaacugcccggccugguguuccucuacauggagaagaaccaguuggaagagguccccucggcccugccccggaaccuggagcagcugaggcugagccagaaccacaucuccagaaucccgccuggugucuucagcaagcuggagaaccugcugcuccuggaucuccagcacaacaggcugagcgacggcgucuucaagcccgacaccuuccauggccucaagaaccucaugcagcucaaccuggcccacaacauccugagaaagaugccgcccaggguccccaccgccauucaccagcucuaccuggacaguaacaagauugagaccaucccuaacggauacuucaagagcuuucccaaucuugccuucauucggcuuaacuacaacaagcugacagacaggggacuccccaagaacuccuuuaauaucuccaaccugcuugugcuccaccugucccacaacaggaucagcagugugcccgccaucaacaacaggcuggaacaccuguaccucaacaacaauagcaucgagagugaguggggugggccggggcggggccgaaggcaaggagguuggcuuguguagcacuuccacccucucuagggagacucaggguggggugguauaaaaagcauccacuuuggcacuggacuucaauucauggccuugccacuugcuaucugggugaccuugaaaagauauuugaccagucugggaaguuuccucaucuguaaagugagaaugguaacaauaucuucuaucacaaaggugauaugaggauguaauaguuuaauauggagaaagugcccagaauaccauacuuggagggucauagguuuucuuccuccauucuuccucagccccaguuccuuggcaacuggaucuauagguaggguagacauggaauauacuccuggacauucugcuaaaaacagaacagagacauuuaaauaccuauccugaaauguccugggucugcccucugcagaaaccugccccugugggaagaugcuucuucccaagccugagccuggguuuugauucaggguaugcaacugguaaaaauguggcagucaggaaaagaaggucugcaugcuggugcuuucugaaucuaucuggaagggugcgauguuuaggugcacuuaaggaagaguuugccuaagugacauuuacaggguucuggacuuggaguaucaauugcagcccaggagaggaggcuggaaguugcaguuuugcuucaaucaaaaauuucagcucggagcagagcauuagcagaaagguuuagaagugaaauaauauuuucugguccuugaacaaaaucagccuacauucacagaagggaugcagcagcagaagggaagagagggauugagggaaaagagaaggaccccuagaaugauauuuggggauccuuagguuccaaaccaaagaaugagauggagauuguuggugucucuaccgacaccaacaaugggcgaauagaucguucacucauuugggauaauuucaagaaguaggggaggauuuuuuuuuuaaucuuacaaaaaaaaaaugggaaaaggggaagacuguauaauuuuacccuggagacagcacacuaaaauaaaacacauuacccccaggaagcuaugaggccaaaauacagacagaagggauaccuugauuaauaaauggcugauaggucucuaccagauuguggaagaacagguugcuggaggauaucccaaccuucuaagguugaagucagagaacucacaccucacccacaugagcccaccccauccagccugucuccugugccuuuuacccgacagaaugggcugaguggggccuaggucaguggggugauuacguucuucacaaugaccauaaugcugccacugguacugucuuuaaacagcuuacaaaaugccuuugccaacauucucuccccugauuacagggcaggcaccacucuuaccauuucacagauugaagaacucagcaugaggguggcuaggccacagccccaagcucauaagagaaaacccccgugucagggcccuucugcuacuccaauggcaaagaagaaagacgaggaaaaggaagaggaagacaauuacaaugaagaugaugccuacucuuccuccuccugcuccuccauaaaugauaagugaggcaaggcuuagggagaauaaaacaguucauuuaaaugcuggcaugccuggugccacaggcauccaacaagaugugauggaggaaauggaaucucaggccauggacccuucagaaucaguaggcucaucaugucccggggguuccggagcucuccccagauccucuuuccucuuccugucauccuuauuucaguuaccaucuuuugcccauccucaugucucacauccaauucaaaggaaaaccugcagaguaauuuucacauccaccuacuggcuucagaucucaccuuacuccauugcuucuccacaguguagccggauuaucuuuguacagcauaaaccugaacauagggaucucuaaggacccuuccagauuuaacgcuccaggauaccaugguucaaguauccuguuaauaacaucgcucucacaaagacaguccuguucacugccauuccucagaccagagaucaaaagccucuuagugaaagccuaacuaccuucccagcuuacucuccuuaguacaucacauugggcacuauuacuauucccagauucgcccacaagcagaauuuuggccuccacaacuucauucaaacagauuccucuaucagaacaccaucccccaggucuccaccuguuguaauucuaccuauucuugaaggcccaguucaaaauuuacuuccaauucucuagaguuaacuugcaauaacaguuguugaucaauuccaacuuaauucauuuuacaaaugaguaaacugagccuggaggucaaggcagcucaucuaugaucacacauucccaaagcuagccaguuucagagagaagucuacaguccuugcucucgggugucuucccccuuccccuuccucaucuuggccgccagccuccacucccuucugauuucucgucuucuuuuuccguagaaaucaacggaacccagauuugccccaacgaccuaguggcguuccaugacuucuccucggaccuggagaacgugccacaccugcgcuaccugcggcuggauggaaacuacuugaagccgcccaucccgcuggaccucaugaugugcuuccgccuccugcaguccguggucaucuaggcccuacuccgccaccggaucugcucugaccgcacuugaaggcuggggcccaggcaccugugccggccauucguuuucucucucucccuuucuuucucccagcuuugccucccuuaucccacccucgaggcagggaaaagccaucuauucuucugcagccucaggagcgagacuucaaggacucaguuugguuccacccaguugaaagacacccagugcacacccaaacuccuggccuucugugguuucccuuugcuccagaaacacagaugugucuaaagacuugguguccccuucucucuccucccccacccgccacuccuggguacaucugggccguggacuaucugaucuugguccuggccgagcaaacagcccggagguaagguucagaaagucccccuggggacuccuccaucuucggcagcucuggcucaaagaggccgagaaacccaguucuccugggccaaggaucccuucuggcaaagcugcugcuccgccgcuugguuccccggcaccagacaucgcccuggcccugcuggcccggguaucgggaaggaggagcgagggaaugacggagguagggugcagggucagggcucccgcaggggccugcaucuggccagcaggacacagggaugcgcagggcgcccccuucuguuccagggugaacauagcacacgcccuccuggcugggccucaggaggaacagccaaggagaagaauggcccaaggaacuaggaagcagccaugggagaggggaaggguucaagcccgggaugggcccgcgugacgucgauggguccugcggcccccuugcccaaccucggguuuagggaggaggguucacaguguuuuugugggggcgggggaaggaagaggcagccccgcccccgccaucuguucuccaucagugugcgcggcccagccauuuccacccucgggaggcggcuccugagaaacagggaggaaggggcggagcaccuggacgucucccagaagccccuccacguuugaaaaugcgccuccuccucggagacagacgcaucggugccaccuaguggcuggugggaguaacagcuggucccagucuugcgccuggcccucuuccuggggugauuuuccucgguggaggaggcccguggggucccaacacggaagagccaugggccgugugcauggugucgcucuccucuagggucuagcgggcacaaacguccccaggcugggcucauucccaucgugagugagcccaggugaggacauagucggcucccguuuguuguaggcccuucccaggugccuucucagcucccucaucuguaaaccgaggagguggauaagaugcucccggccgggcgcgguggcucacgccuguaaucccagcacuuugggaggccgaggcgggcagauuauugccugagcucaggaguucgaaaccacccugggcaacauggugaaacccccgucucuacuaaaauacaaaaaaauuagccaggcauaguggcgcgcgccuauaaucccagcuacugggaggcugaggcgggagaaucgcuugagccggggaggcggagguugcagugaggcgagauugugccacugcacuccagcuugggcgacagagugagacuccgucucaaaaaagaaaaaaaaaagaugcuccucugaggucccuccggcgcucauguuccgagucugcagcuccacacuuuaaaucauacucgaaugcaggacaaguccuaaauauuugccccuucccuugcaguaauuuauuuucuguauggacugucccucccccagaggcuuccccacccuccauugccuggcccaggugagcagcuuggcaggucuccaaguggaacccgguccagacagggcugccucgacuucaccuuucccccuaacuuccuccaagggaugcugccccuucucagcccccugcguguguauauuggugggaggcauagaggauggauguucuagaaaugaguaagacacagugcccacccccaaguuaggaugaaaaaaguuccagagguuuuuaagaaauuggauuaagcugggucccuaacuucaagaaauucccauuaugcuccuucucaccuuucuuuuuugcuaauuauggaaaauagggcccauuucaucauagccuccuucccccgugcuccacuacaaucgccgcauucuuucuagcugcagcugguuucuucaaggcuccugcuuaaaguccacacguuauuauggccgaaagcaaccuggugcuucggccuggauaagagccccuucugcaucuuauucacagcuugcagccucagccccuuugaugaggcccucaggggagaggucauuaccuugauccugcaaacccagacucguugagcagcaacgcaaucaccaucaucccacugcccaaucuagaauaugucugcucuccuuugcucucugcagcuguaagccagaggggauucaagguaaauaggcuuuacaggcuccccuccuccaaacacacacagaaugggcugguuucuuucaaguuuaaaaaaagcccccuucuccaugcacaaguucauucccuccaugcugucgucaucgacauauacagguguguacguagguguauguguguacucugcacguauaucucuucugucuugaagacccuguuaacuuugugaaauaacuuccacauuucaacacacuucacaguacaggaaauaaaguaauaugaaaaacacccugcgugaacucaacggugugaacaggucaagaaua

SEQ ID NO: 12859 - RNA, 3594 nt, Homo sapiens
agcagagauuggagaaaguuguuccacguaagaaaugagaggaauucggauuuugccccuaagaagaagacaacaaugaagagggggaaggggauuagcugaauaacaugcaaagagucugcacccugaguuaugaaaaugaucaauggauuuuuaaaaagucauaccagaaaugucuguuguuuaguauuauuuaguguuuaguguuauugcuaugauguaaagcucuucauuucuucaaagcuuccuaaguuuuccacaucacagaagccuugcaaguauuucugccauguucuccaccuggaugguggugguguggaacagggacagucaccaggaauggccagaggacccuggaucgaacaauucaucagaagcaggagcacccuccagaaguuuguggaaaacuugagauggacauuagacuuugcaaacuccaaagggugaugcugguucaaggcacauuugcccugaccugaagggucaaugugaccacuucuagucuuuaugagcagggcuguguguguuucaguggcagugugucucuaagaagugugggcuuucauugucuguauaauuaaacccugugcuugcaauuauccuugaagguauauguguuuaugugcugcuuuuggaaugauauauugauaugacugcauguugagucccugugggagaggcugcuaaauggucaugugaccauacuuuucuuccucaccuaggaacaccaagccccuucgcacuccaugagaaguagaggccuucccgggaucaaaacagcacucccucucugagccuccccaaguaacauacacuaccugccccauuuucuccuucuccugccccugccuguuuccuugucuucuuccuccagccccaagaauagcugaggcucuuaacuaagaacaagaaaacaaaaaaucgggucaccagaugugcuucauuccaccucucccucucuagcuauccuccccacaagccaacgcauucugagcauauauacagcaagcaccuggcauccccccaaacccagcugugccucugccuggcaacagacccaacucagguggaaauuugggguaccccacaagcauaccauaugguucauccugucucuagcacuauggugcagcucuuuuguucugccuagacagccuaagcagaccccagaaugauuuuucccauccugaaugaaaggugauauguugaugucaucuguacugccggucgccuucucccuguguagacacugccugucucaguguaggaggacaaugaggucuccaggaacaagguccccguccagaggcaggaagacagagagaccagcaguccugccucagcucaugggcaggguucacuugagcugguccccaccuggagcccaaaaugagugucuugugcuuuggagugaacagacaucugggauucucauuggggacuguuuacugguugauuugcauggcacauuaacagcccacagcagcccacuuucugccagggacuuucaggaaccauuucuccaagccagcguggcccugcgcgggcaugagcccuccccaucccuucuucccuccccacaucagccacguggaugugacucacacaggcucucugagccccugccagcagcagccagaggacugccuggauaaaguugggaugggcuacuucaggagcagggaacaguccagagucccuguuagaauuccgugggccuccgugcccuccuccuacuacuacucccagugucgccugcagcccaaaccucaugcagcagcgucucccugaugcuugggcgaaaguucauccuuuccuaucugcuucucuccuuucucccguagcacauaccacaaucagggacaacuaugugaguucucuugguuuuucccugugauauuauauaaauaacccacacuuaaagcagaauauucauauauauuauuuuguuuuauccucaugaucacucuaugagauaauuguuauauuucccauuucaaagaagaagaaauugaagauugaaagauuaagugaggcaaagcauagaggauguuuagguaguuaaacuacuccgcaugauccuauaaagguggauacaauucauuauacauuuguccaaacucauagaauguacaacaccaagagugaaccuuaaugugaacucuggacuuugggugauaaugauguuaaaauguagguucaucggguuuagcaaaugacuguuccugugggggauguugauaguuggggaggcugugugugugaggggcaggggauacauggggaacucuguacuuucuacucaauuuugauguaaacauaaaacugcucuaaaaaaaaaaaagucuauuuaaaaaaugccacucuaggcaauacagagagacccugucucuuaaaaaaaaaaaaaaaaaaaauuagccgggcauggucaugcacuuccauggucccagcuacuugggaggcugaggugggaggauugcuugagcccaggagguugaggcugcagugaacuaugaucacaccacugcacuccagccugagcaacagagugagacccugucucaaaaaauaauaauaguaauaauaagaaauacauaaauaaauacuuauuuuuaaaaauuuuaaguuuuaaguuuuuuaaaaaguuuuccuugauucccagaguuucccuuguucuaaauguacugcaugagcuucugaauguacuuggagauuuaccaguaccucuccuugccaguuguagcuccucaccccagccugucaucugucugccccacccuccucaaccucuggacuauaagaacucugagccuugacuuaguugucucuguauucuuagcuugcggcagugucugacacauaguagaugcugaauaaaugucugcugggagaaugcaugaaugaaugaaugcauggaggaagaggaaggagaggaagagagagaagaagauagugggaaggaagagaggaagaggaaauaaaaaacaggaaaaggagauggaagaagaaggagagugcaguauagggucggaaagaaaaaaggcaucccuugauuugaucuuauccccuuugucuuccuggggacuggaaggcccuucucaguuccuuucuuuucccucuccucccaacaggauaaggacuuuggccacagcccugccuaucccccagguauccccauaaagucuuuaacccuuagauauagaacugcucugucccuuuucuacaaaacaaauguguuauuugggcagaagaggaaaggagaaaauuugaaguggaaaaaucuuugguuuggaaauucagcugacugcccucauuuggaauaaaauguccuucagucccuggcuguguggcaggcaggcccggccaacagcaacaccggaugccgggagacugggaggaggccuggggauuuucagaggagccgccagagugguaugaacuuggaauccaggaagagagugauggggcucaucuccaagggcugaaucccuauccucuuccucaucucuguccagacaguggucaguugucccgaugugucaggcagagugcuguccugggggcacagacaggaccaggagaagcaaguccuga

SEQ ID NO: 12860 - RNA, 1964 nt, Homo sapiens
cccgagccgcgcgcgacaugagccacgggaagggaaccgacaugcucccggagaucgccgccgccgugggcuuccucuccagccuccugaggacccggggcugcgugagcgagcagaggcuuaaggucuucagcggggcgcuccaggaggcacucacaggugagcgcaugccgaggggccuggcgccaccgggggucggccccaucccugccagggccgucuuucuucuacuccugcggcagggugacccacgggagcagcuuugggacucgguggcccuccuccgacccccggggcggcccgcaguccccaguuuccuggguccuccuccccagcccugugcucgggucucggccguggcgguucugauggggcgcgccccucuacgcucucggaggcgcagacccugguccuggagugccagcccgaguccccagcuuaugccccugucucauuacgggcucgucucccucgcuggacccucgagaucuuaagacccucgauggauguuguugcgggccgcccggucggccgaggggucccgaugagggaagaaggugcagucgagccuuuucaacaauuuggagucccagugcgguucuuccugccggucggggugcgcugugccugggguaguccacugguugcugacuggcuucaaguuggaauuugggcccccuuuguguuaucuuugguuccccuuagccaucugccaccuauugugguagggaggagagccucguagcucgugacccugccgugcgggccuucaaguugggaggugaagagauaagcagcccgcucgcuggcuggggagagaccucucucccagcuguuucuagcugguuacugucaguuuugggaagcgauagccaucucggaacgcacccacacagacccugccuucugaggaaaacagauguuucaucaaaacaacccaguuuucacucccuuaggcacugcuaaggaagguucucugacucuucugaaggaagcagagggaacacagggugggagguccagugacuugcuguggacccaacaauguuggcagccuuccuggcccugaaacuucagcucacaggucuccagaggcccugccuggacaugccagucccagucacacccuucccuugcuuugggggugugccaaaagcaauacacuggccacuagagaguacccuagagcucuagaauccccucccaacacgcacacacacacacacacacacucucucucucacacacacacacucagucacacacacacacacacacacacacacucucucacauacacuuguccuggaagcaggaaaguggaucuuuccagcuuccauaaaauuuucucugcuaaguggaaagaggguccuagaacucagaggaauccaccucccuuacuuaaagggccccuuucucuccuccugucccuugacccuccaccccgcccuaugguaguauccauggccuagcugcucuaaccagggcaucugccccugguccugucuccacagagcacuacaaacaccacugguuucccgaaaagccguccaagggcuccggcuaccgcugcauucgcaucaaccacaagauggaccccaucaucagcaggguggccagccagaucggacucagccagccccagcugcaccagcugcugcccagcgagcugacccuguggguggaccccuaugagguguccuaccgcauuggggaggacggcuccaucugcgucuuguacgaggaggccccacuggccgccuccugugggcuccucaccugcaagaaccaagugcugcugggccggagcagccccuccaagaacuacgugauggcagucuccagcuaggcccuuccgcccccgcccugggcgccgccgugcucaugcugccgugacaacaggccaccacauaccucaaccuggggaacuguauuuuuaaaugaagagcuauuuauauauauua

SEQ ID NO: 12861 - RNA, 3378 nt, Homo sapiens
aaccauccuacaccgagggguauuccuacacugcuguuacagguggggaaaccaaggcucagcuuuugaaggcaggugaagcuuggaggguugcauggcugcagugugugaggggacccugguguggggagggucaucuugucuaaggguccuggacacacugugaaagccagagaguuuugacucaggauacauuccagacaccuuggcuccaucuguucugccuacagccucccucauuguccuuuccucguuauagaucugugaccuugccucuuccucuacucgccuccaucacaaacuuccccuucucucagcccugcucucugugccucacaggggagcugggaguuagaagacuuccagggggaaggaccaaguucuguggucuccaucucagcccaucucucgcaccuuggaauggacuuaccagcuguugguguaggauggguaaacugaggccaggagaggaaaaguggccugcuugaggucacgcagccagugaguggcagaguagagccuagaagccagcuuccagcucuucugacucucggucaagugcucuuuucaccgcaccaaaugacccugcugcccaggagaucucagcaccgacccuccuaccuccgugucaagccagaggacugaggagaccgugugcuucccccaaggcagcuuucuggaauagacccugccuuggccaguucuguugucaaauaggcuggucuaaucccugaggcugggaacaggcagggguggaaggauggagaagauaagggaagaagauuuuggcuuauuuugcccagaacugagaaacaaauuaccuacaggcauuaugcaaaugcauccacuacaugucagcaaccugugguaagaugaaucggaggugggaguguauguguaugggaggugguggugggugcucaguugcccuccagagcugaagaugcugucaauaguuagacagggugaccccacucacccauccccguccccaagcugggcccaucugggucuucacagucucuucugacaucuaguugagugaccauugggaagcugaguguaaacugagagagaaagccuugagccaaaaauggcuuaagucaagcaaaggguggagaggcaggggauggucgcaaaggccugcaugucuggguggcagggggaguaggcaggacgucaggugcuguugggcguguugacaaagucagcaggggaagugcaaggggacgaggaggaaggagaguuuacacuuccuaauuucuccaacuagcuucuagggaaggaauguaauuuugcugucugaggcacugauuccuugcucccccuaaaggcagaaauggaaguuauuuuuccccacagagggcuucccccuccuccucagaagacucaacugcccuuccucccugccucccagcuacccagguuccgggucccacaucauuccucacugugauucagugcagcccccaaugggagcaacgugcccacccuccucugggcagaacccuuuuccuugcauucugagauccagugaggggggcaguacccccagaggccagguuggguuguggcuagcuaacauugggguccccagccugacucucuuugccuuccuagaacccuugcccaauacccacaaacaaggauuucucagguugggaucucugcgaggcauccauccauguccagggucuggucauuaguuaauaucaguggacugccuaaaccgaaacuggcagaagguggccaggggaggggucuggacccaguggagagagucaggagccugggauucuuauuuugguccuguuaggauuugcccugugacccuccggaagucccuugcuucccugagccugcuucuuuaucuguaacaugaggggauuggacuggaugccuuauggcuuagcgcugugcuaugaagaggaagaaggaggaaggaaaaggagcgcagagcggguuacacugccaggagauccugggaagcuaggucacuucccugagccucagcauccuuaucugcaaaauagaaauugcuaauagacuaaaaggcaauucugaaagauggaugagaaaggaauauaaugacucaggguagagccugcaaaacaauaugggaugagaagaugcagggacugguuucauggagagagcaggguuuuaggauugggggagggugccagggcuaccgacugcuuugggagaucccagagggggcauucugaaguccugcagaagagaugcugugccgugaggggugaggggucgcuggaggccagaccagggcucccaggaguccugcauugagaagggagagaguggacacaggaaggaugcgccucuguccaguccugaggcugggcgcacacaccaggcccuucgaaaagcucacauuuuuuccagcuuuucucacccaguaucacuuccuuuguuaagaggagggggugggggaggagacggaggaugaggagggaggggcuggcgggugccgccgccgcccccgcccccucccggugugcggagcccgauugucacucagcuccugcgccgggggcgacagagccgcaggcgcccgagucgagucccagccagcuaccaucccucuggagcuuaccggccggccuuggcuuccccaggaaucccuggagcuagcggcugcugaaggcgucgaggugugggggcacuuggacagaacagucaggcagccgggagcucugccagcuuuggugaccuuggguaagucugagucucgguucaccccuggggcuccccaaugggggugcaggagaggguugaaagaagagaccggaaugcccccuuggggcaggccaugggcaagguuccccgacagagcuggaacgggaccagaggacugcuaagauccaggcaccagacgggucucaagugggugggcgcagggcaggugcgggcacgcuggggaauagggagaaacgccccagccuuguccugggcuccguccccagacccacgucugccaccccagucccaggugcgaaacaggggcgcuaccucuuuaaaagcguccggggcugagucucugccguaccaugugauugcuugaaaggccgggcugggagcgcugcggcgggagccggaggacuaugagcugccgcgcguuguccagagcccagcccagcccuaccgcgcgcggcccggagcucuguucccuggaacuuugggcacugccucugggaccccugccggccagcaggcaggauggugagcucccugcauccuguucugugcacaggggugggcagagccagucaugggagaccccucugugcgugugucugugugugcgcgcgcgcugggagcugccucacaccugauaaaaaagccaguggaggagug

SEQ ID NO: 12862 - RNA, 52438 nt, Homo sapiens
aacucuggcacuucgccaccuccuaggcugaaccaagauggcgcgcggccucaaagcggcgcucucgucacgugcccggacccgaggcgcuugggggcgggaggcguggccucggucgcggcagcccagccccgccuagggggcggagccgggggggguuguccgcggaggaagggggcggggccccgcggccgcgcgcuugggcggcggaggcugcagcuaccucggcgccggcucggcucuaggacgugucgggcugcacgggucgggggcggcucccugcugcuuccgagccuagccgccuggccuucggcauuugcaggcaggugagcgcccagagccuggacugggguaggaugcgucuuuuccccaucuccagcuccccucgacaguuuggggaggggucucgucuaucgcaccucgggaaacagcccuuuuugacuccguaugugcuaccuccggcaggcgucgguacugcuuacccugccgccccucgcccuccuuugcggugcccugugcccuugggggugaggauaggggcgaugccugaucugcggggagggcguggagugcgcccucugcuccaucggcuucaggggagggggccgaguuggcgagucucccggugggaacggagcagacugcgcccccauuuccccuccaggagagucagaaaaagcgccucucggcuccggggccaaccccacuccuuuggggacgcgauucugaugggcugaggucuucgcucuucgcgggggucuuaaucuuucccgaguugcucauagcaccccuguuccugucgcuagcucuccauuccucgaacugccagccucagucugugccagagaugcccccaucuccgcagugccagggcggugggguggaaggagcggccaacccgaggccugguggggguggggacaggggugggcgcaacaggaaaagagggcuggaauagagaugccugaacugggagggugggaguggggcgcugacuuacguccacgcaguagggauguuuuccagcgcagauuuugagguuuugauggugggugggaagagagaggucgggcuggaggacuuggagacaugguguaggugguuuucuucgagaaggaggagggauccaggacaaggugccacuaggagcugaugucaccuuugaggagaggugugcugguaguuuccaucagaggagcaggagaguuggggccguucuguguggagagcaagugguuaaggaggcgcugcuucgcagggagauccccuccuggugugagcuuaaggguccccuccaggagccagguuucagggauuucccauaguccuuuccagaguucuuggaucugguaccuaguacuuugcucaacauccagcaaacauuuguuggacaccuacuaucugccagauacuaugcucggugcuaggucuucugaaggcaauuuacagccacggaguagcugaaagguacacauaggaggcacacauagcagguauucuguuaacacccuucucaccgcccauccccauucuguuacauugcuguuggauuagaaaaagaaagaacuguguccacgugcuuucaaacagcugucugaauuagacuccaaccuacacacccccuaccacuauuaacuggccagguagucccagggaagcugccuaagcaaaagggcagcuugaaugauuucccuugguuauuuucucagauuuuguccugaggcuugaggaggcuucgugggguaaacgguaucucaaaguaaggagauaaugaaugacaaaaugguuauugggggccaagaauguccuagacacucuguguagugggagacgccaucucuggaagauggaauagugugggggaggaggguguagaagggaauucgcauccaguggaguugggguuugugcugcugagcaugucgugaugucagaaccguguggugcaugaggucuggcugcugggcuguaaaggagggcuggaggggcagggcauggcaggcagccaggcuccugggucucaucucugaguugauugcugaaaucuuagaguuggaaagaguugucagggauggcuuauagguccucacagagccucugaggauggcagagcuagagcuaggcaagagaaugaguagucaggcugugguggugaugagguggggaugaaggcucagcagggcuggggagcuggguguuaaggggguuuuaagauaugggcagcuagccgaggccuucgaaugccaaggacauucuucccugggcuuuaggcccuacuguguuggcuccauaggugaguugcuguagaaacaagguguggcaauugagugguauggggugugugugugugugcacacgcgugugugagugugugugcuugugcauguguuggagaggaggagaggugaggagcagggaggacugagggagugaaagcugccucaaagucuggguccuacguagggaauugagagaaauggaggggagggaguggggucagagggagggacaaguguguauugcagccacaugaagucaccaucugucccccucuggccugcuagcucacggaccuauaauuagcucuggagggcauacggugcuggcucacaggagcgugggacuucggguggccagcagaguggaggauucagagggaccaugguccuugauguacuguggaaggggcugcuucuaggggacccucugcauuugcuguacugggaggggccugaggcaacugagaaugucacagggacagggcuggugggggaaacagcagugggggaaggagcucuaagcgaggauggcaggagacuccagggcuggucugagccugagaccuccccguuuguugccuggcugcuggcccacugcacaagaagcacgauugcugcccagcucauugcucugccuucagagaggcucgggugcugcaaccucggggccuccuugaggugucuccauccccccaggugaagucagcuguagcguggaauagccaucugccuuucacuugguggcugagaggccuuggcuggggaugcuucguucugagagaguuggaggagaagcugccaccaguuaauuccguuggucaaacuccacguggugcucagcacugacccccuggcugugccagagacugaguguuuggucacaugcuucucuguacugcucuccagugauuacauguguaucuguguucucucaaguagccugugaacuuucugucuuacaugucuuuugcuuucauaacaguaucggaugcauggaaaucacucaguaagugaucauuggauugaauugaagaggucugucuucugauccccugaguuccaugaagcagggccuccuugccacuggagauauuuaaccuggagcagcgaagccucuggggacccaggacacugguguuacaucccuuugggggcauuagauucugugggcaguagaugaagugaaaacuucccagucucucauaaagcauggcauauggguuuauaacccugaacaguaauaugaauguauagauaugguauauauguauucuauauuauguaaauagauacuguauauacuacuguagagugauuuuacaaagagugcauacgcacaauaugauuuuguagugaagugucagaugaaauagcugauuugauuuuagaggccuuuauugcuuauuucgcccagcuguuaagaguugaauucucauaaguuagauauauacuugaugugccuucauggccacugucuucagauagauaacugucauuucaaagagagauggguuuuccauucaauuuaagaaaaagcuuccuuagaacgaugaagccuuccucauuugauagugagcugcuuguuccugaaggauaaucaagucaagacugggcugccagggauguugugaaaggaacucccacacagggugggaaguggccugugugaccuccgagagcccuucugaguccaggugugaggugaggcuggaugggagagggccucagcagcugcuucagaagauggcucuccuuuggccuagaggagcgcugcugggaguggaggccuggggaguggggccgggccuggagcuuugcaugagcuguuccgugaggagugggcauuuugggacaugcaggggggugaccccagaaaucucauggacauggaggccugggcuugggagauggugcagugcaucccugauggguggggguagguagaaagaugggauggccccaguuccaugacuucagcuuaaacuaggcuaguuguggagugccccaaauuuuugguccuacuuuggggcagagccccuggaguaaguggagcuuucauucuuucaguaucaccccaucccucccuccucucucgauuauaccuucucacauagguucgaggccacacguggacuuacgcugucucaugagcagcaauacacuuucaugaucacacacgcauacuugcacaagcucucacagcucccaugugcuccugggagcauguaugauguuaugaaucccagaugcuuaugcauguaugaccacacacauuuacugucauggcuguguacccacacauguguucucaugaccacaauuauaugcagucaagaucccugauguacuuaugaccacacacaucuacacacugucaugagucuauauaccuacuugcucucaugccugugcucucaggaugccauucuuaugaccauaccuuuauacacagacauacauacaacauauacucucucucucucucgguccccuuuuccccucucucucccuauugcccaggcuggagugcaguggcaugaucauggcucacugcagccucaaccuccuggguucaagugcuccucccaccucagucucccgaguagcugggaauacaggugcaugccaccaugcccagcuaguuuucauauuuuuaguagagaugggguuuugccauguugcccaggcugguuucuaaguccugagcuuaagcaaucucccugccuuggccuuccaaagugcuacugcaccgagggcuuaugcccgaggcaugaacuaccacugcacuggcuucucuuccuuuuucauggccacacauauauaccaugcguucucaugaucacacacacacucuguugcaugacgacacaugacacccccccauucucuuuucguacugcccgccacuucugugaccacauacuaaugcacauuuuuuaugaugccuacauuccucccugcaguucuguacucuggacauuuuacaccuggugccuauuagcacuccggacccguccucuucucuccucugcgauggcucccuaaucugauggguugaucuacgaaugcagugacuuugagcauuuuuuuaccaccagaggacccuguuuaauauuugucccacauggaucccuaguuuugaaauauuuuuauucuccaaauuugcuaugcuuauuacuuuguuucuucuucugcaaacauuauuugaggacauuuguguugauuaauggcucugauuagcagaagaugucuaggguuuucucugggaauguacuuaaugauguaaguucagcaaaagcugugucuguauucgguggugcagacucauauuuugacuuaguaacuauaugaucucuauuagacaguuagaguguggaaaaugguuggcuccugguguuacuuguguagcauucccaggguugucacuguugcacugauguacagccuuucugagagaacguguguguguguguguguguguguguguguuuuagcagggggcuucuguagacaauauuuaaacuagggauuuucuaaccucuucauggacuuggaauccuuuuauacaauugaaaccuuaaucagaugucccauaaaacggacagauuaggaguugaugggauuaaaguaagaaaagggaauuuagagccuuuugaguuugucacaccucuucacccuccuuuuggccuuggacugccccuaaagguacuuugucguaaagccuaguuugcaaacaccagucuuaaguuaaaaagguaggugugaugucuauaauuuuggguauuucagaagaggaacuauuugcggaugggggcccagaggcuuguaguucucccuuccccgcuuuuuuguuguuguuguuguuuuugaaauagggucuugcucuguuacccaggcuggaguaaguagugugaucuuggcuuacugcagccuccaucuccuaggcuuaagugauccucccacuucagccuccugaguaacugggacuguagucuguagacgcaugccgcugugcccagcuaacauuuuuuuuuuuuuuuuuuuuuuaagagaggaugucucaccauguugcuuaggcuggucuugaacucuugggcucaagcagucuuucaccucauccucccaaagugcugggauuagaggcaugagcuaccaugcccggccuuccccauuaguuuugacauuaguccuacuaggguggcaauggcaagggugaccauauggcuaggugaaaccuguguucuggugugauuguuaacagugguuuacugucuaaaccaugacccucuaaaccaagaggaucaugguuuagacaguaaguucugugcucacucaagugauaggccaugucuugggaagagguggcccaugucuaacuccuggggagcagcuggagagcugggcuucacagacucaggcccaggggagccugucugaacagaugcuuccuuccguguccccugaaugagccuggcauuaggaggcugaguguauucggcagcugguacuaaccugugcuugggcggcauuuuauacuucucagaacuguuucaugucuguuaccucuuugagccucaugacaaccugugagagcacuggagcguauuguguguuauaauguucauuuuccagauuugggaaccugaucacagagggguaaagucucacugcuagucguguugggggcccagagaacuggaugcuuuugaagggaucuguggcuagcaguggaaacucuuaaguggggcuuuuccaagaguuuuuucucugggaauggcuuccuguagccagaauagauuuguaauuuucuuauuguaguucagugggcccagccuugaggcgcuuugggagccuagggugcugagaguucaugaacacuuaccgaguuuugcugggugcugaucucagcacuuuguguaggcugacucuagacauccugugucccagcugucugagguggguacuguuaucauucccauucacagagguuggggaauggaagcucagagagauucaggaucuucccagggucaccugcaucaucagcugcucuggagucugccuuucaagacaggagcagcccccaucuugcucucaagaagguuuaauuuucagaccaggugugguggcucacaccuauaauacuagcacuuugggaggccgaggugggcagacagcugaggucaggaguucaagaccacccuggccaaaaugcugaaaugccaucucuacuaaaaauaaaaaaaauaaaaauagccagaugugguggcgugcaccuguaaucccagcuacucggaggcugaggcaggagaaucacuugaacccgggagguggccaugucaguccuguuuuggaguuccccuucuuugaagucagucagggauggacugcccuggaacgacugucagcacaggucuguucaguuccauggguguuagggcccuguguuagaguacucagagaugggucuacagaugagaugauguaaaguaagagaagccccuugaagagagguauaacuagagggcaaugcugggucagcggaagggcagaucucacacacuggagggaucagaagagacuccauggaggaagugguguuugagaugagcuuagcaaggugaucuaagcucaugagaccaacauggaaagggagaugagaggcaggccagugaggagcugggcaaacaggagcuauagguggguccugggagcagaccucagugagcagggcuagggaagggcuagggagcagcaggagaggagguagggcuggauuucuggaggagaggaugggugagggccaggcuucuggggguacaaagcuagacagggaagaaggagaagcuucugggcagccugaggcaugggcagcugggcugcaggcccacguuggggagaaugucugagagccccaaggacgagggcuccgaagagugucuguuucugcagcgccuaugggaguggggggcaguggggggaacucagggaagcugccuacaacuugguguggagccagcuaggggcugggagcagagauuugggugcguggaggauggggccuuccaguggggccuuucagucacccauggccucaugaccauguuggcugcucugcagaggccuuccccaggcuggaggaggaggacagggaaggccgaggggagcuguccuccggcugccaucacccugaugaggguggggaagguuucuuggagaagacaugaagucugaaggaguugucuuuacccucucucuucuuccuccuucuaccccucuuuggcaugagacagacaaauugaauccugguucuucauuucacuagcuguguagacuugguuacaugacguugcaucucaguucucacuucugugaaaugggaagaauaauuacaucuuccuugcaaauaauuaugaggauuaaaauaaauuaauccauaccacuuggaagcacagugcugggcacaugguaaaugugagugacuuacagcagcucuggcgaccauuauuuuucuggaagacccccgcccuccccauuucuucagauccuccucucaccuccagcuggguggguguccgacccuccuguuuucccucguggcugccaccuggaggcucccuuuuugcccagcugaauagccccucagacgcuccuagcggcccugccccgggcuguggucuccgcaggggcuggcaaccuugccuuuguccagcucucuccguggccaggccugccaucugguaggcaggagggagccaggccuguguguggggccagccagagcaacagacccaaaugcccaucccuccuguguguuaggaaaaggugggggugacuuuugggaugccaaagaggcccccaaguuaccucuuuuguguuucuaaaggcccaaggccuacuuuuuguccaaucccccacccccacacacgcacacucacacccacucacucuugagcccucuuccucuguuucacagccugcccacacuccuccccggcaaagccccuugcaaaugcuugcuuuggggacuggcagcuuucgccucugaaucaggaccugugaguguuacuuagaaauugugcgggaguugaggaggcuucuguuaggcugagaugauaauugcgcuauuuaaagacggcccuggagccagaaggagcuggaaggagccaggugccccacguggcuguccuggggcucccuucugcucacuguuucuguguagcagagaggacaggggcaggagguccuggacagucaucucaggggcaucuugccuggcaguccucucugggcuaucuucagaccagcuuuacaugaugccauuuggccaggggaaguggaguugcucgcuggcaccugguuuagagagaggccaggaaagggcuagugagaagagaagcaaccaaagccagcuucucaguugcuaaaaugaccaggaggauuuggggaggccaaguuggaccagauagccaguaccucacagugggcagccugagguccuguucuuccuuccugagaacuucuccagccccuuuccuguaagaagcuuuaaaaacuccacccacagguggccaacacuaagguaauucacauucccgugcaaucacagggugcuuucuacucuucauuugcugcccagccaugaucucaucccucuaaggaaggcaaaaccaggguuguggguuuugucuuguagccgaagccucaguaggugauaacaagccugagaucagccagcuggucuguggcaggacuguaccccagucuccugagucccugcucugggcuucuuccuuuaugcuaugcuacgggcugccuggggaucugcugggcuggggccauuccugggauaccuaagcuccuuccuggcacacuacagucuucuccaaaguuagccucugccacaaggggccccuucccuagccuagucuucucuuuuggccucucguggcaucuugguguguguggaggggugggggaagauggggaggugggccuggauguggaugagcuuggggggguaggcuggggccauauggccuuucagccucagggcuggagcauucaggguggagggaccugggcauggugggugggagaauuggaggaacggcuguuaucagcaucagggagauggcagcucuggacagacuggggcagcagccccuccucuccacucccagcugcucugaggagcagggaggugcgaguaggcugcccuggcagcagcaguguuggggaaaggaggaggcagaccaagcuucuacuuuuuacuucuguagccuucugggacccugcccuccacaguggcugucuggcuuggggaaggauccccuugaccagaguuuguguccaguuucuaugcaugggaguguguauguggccacauguguaucuguucuaggucucuguguuucuaucuuggggcaugugugugugcaugcccacgugccugcuugcacuacugcgccccucugggaagggcugcgagugugagcucugaauuuucaagcuggugcacuaacuuuccucagaucuagaccccacauugcucccuagucucccucuuccuuuccccuguuucugccuagagcaucaguacucuggggaggggguccagguaggagaggcccggcccuucucucuuuucccugcuggguucaguccugccacaggccugugcagugucugaccucuuaccucacacuggguccugaugcuucuuguccacccugacccuccuagucugccuguuauucucaccccgaggguagacagaaggcuuucauugugucucccauaagauaagagagaggggaaggagggaaaauaucauuuuugggccaccuccagugugccuauugcugugcugagggcuucacaccccuucuguccugcaacugggaccucugaagacaguccucucugaaaaacgacuaaggugguagcuuucuaacguagacagggagguuggaaucugauuguaggcagagaaaucccucgcugcaugcggccuuuuucucauuacuuuccuguuacuucaucgccggcuuccuuugcucugaccauugggcuccugugccaggcucaacguaucagcagagccaggcuaugcacaugcugacugaccucacuggugacuucugcagugucagcaauggguaaugacgccaagagagcagauucucagccaugauaggggccacacuguagccccacccuaggagaguggcacccugcaccucuauaucaccccuggguuccuuuccaucauucagucccugcucugaugcaaagguaggaggcugugaacuccgaauccaagccugcugucugcuaggccugcgugcuguccuccuuggcagguuuuggaaauggggaaugacuugagccagagccuccucccugaauuaugggcaauguagcaggucagggcucucugccugccccaguacccagucugugccucuccaaacccuuagccauguugugccaguauccagggcaggaacuacucugccccuguuuccuaggaccccaagaguccagccuuuaggacucacagccacucccacuaagaguccuuucuacccaucugcauuugccuugguuggcuuaagugauggggaaaagguuggggguggcacagagacccuauuuccuccccuccaacccccaggucucaggaggacucugggcauccugccggcugcuccccugccgcugacugaaucauuucuauauuuggccagugagccacguggguaggggaaccacugccacugcggcugcacuucugacagcuguggggagcagggggaggcagaggcugggcaguaggcaugugcauuccuugggagaacuaaggaggugccaucagagugaguaagccuggagaaggggcaugcgccagcaccucccucuccucccccauguucuaguucagguccugucuccucugcuccacccccuccccugaugcccuucuccacccaguugguacucacagcagucucuuuucccacagacacacugcccuccagaaacgaugggugucgcuagauccagcugggacucugccagccuccggcacucagucuaagagaagggccaucuuccagcccugcugucccugccugucauggccacauucggcugcugucugcaugucuggggacacagggcacccagccccagcccugagaaguuaagccaggccuucuggcucaguuccacaggggcacuccagaccccaggccccuuucagagcaaaagcaacugaugcuaugggagaagccccugcccaccuguccacucgccuggcacugcccacucugagacccaugcacuggguuccccuggaggugccaacccugugagucccucccuguccccugacgcugagaaggcccugccaacccccaccaugugugaggugaugcccacaaucaaugagggggaccgccugggucccccucauggcgccgaugcugacgccaacuucgagcagcugauggugaacaugcuggacgagcgggagaaguugcuggagucucuucgggagagucaggagaccuuggcggccacacagagccggcuccaggaugccauacacgagcgggaccagcuccagcgccaccuuaacuccgcccucccccagguaaggcccgaaggccugcgucucucuuaaccccuuucccuccucuagcccugcuagauccacugggcccucagcucaucugcaucuauuugcauaucaauaauuggaauucacugagcauuuacucuccuucaucucucuacgugaauucuuucccugucacucccaugcuccucagucuggaaggugaaauggauggaauuugauguggguagaaaaacgcagccauaggugucagcuacagugagcucaggcggccaguagguggcacccuagacuggaaagaaaccuccucccugcguacuccucuccagugcccuauucuuggagguggguggggaaucacagacaguagagaugggugaguucuuagagaucaucucguccagcuccguuauugcauagaucaaaaaagcaagagacaucacauggaagaugauaggcagggcugaaucuagcagccagaugucucgacauccugucucacacucaacagcacaaccaccagcuguccuguagucccguguacuguguccuuucuguggaccaagcacuuuauaaggauucucucacuaaacucuuacaacccugaaguuggugcuguuaccaccaucaucccauuguacaaaucacggaacuaaagcuggggagaugaguaaguugcucguggccaugcagguagugugugguggaggcaggaacugagccuggggcuaaguuucucaccacugcaccuauuucucccucacugcauuggccugggagcucccugcugaugccugcuuaucacccacuugguagauauuccaggcauggcgcaugcucugggaaugcaggagggagcaggagccuggaugauuugguucuugggcuguuuagcugcugcuugucaaagaagcugugaacucugccugauaaccagacccagagagggcuggggguugugugucugugagacagugcucacagugacugugggaacauccugcccucucugccccucguaugagcagagagauggguauugaaagccagcuguggacacauggcauagccuacccugacccagugggggcgcugcugggguugggaaggcagcccugaggagccgaagagcucaagccucagcgccaggcccuucccaguguguggggaagagaacaagggcugggccugagugggugaguuuccuacacaaaagugaugcuugguggacaagaauacagagcccuggugaagcaguugggugggcagguggggaccuccucuuucacugugcacgaggcucugaaguugcccuagagugaaugaacuaguuccugccaccaaggagcucauagacuaggaaggagauacaccacccaugugaccggagagaaugcagaggaagauaagagaggcccaaaaggguuauuaagcacaguaucagugauaaaaauagcugcuuuugaugggcuugggcuaagugcuuucuauacauuggcucauuugacucucauaccagcaccuggagggaggacuguuacgucugucuuacagaucagagaaugaggcucagagagauuagguaacuuauucaagaucauacagcuaacaggggcagagcugagauuugaucccaggccuacuugacuucccacacugaagcuucaugaggucagggguugugucuuucuugucacuauauccccagugaucugcacaggaccugguacaugauaggugcucacaaauauuugugguugaaugauggacucccaaguugguguucuugaccacuccuccaaauggcuuucaggagagggagagagccuccccguggggagucuggacagcucccagcaaggcuguauccuuugagaugggcuuugaaggaugauuaugauuucaucggguggugacagagguuuuuccagggggagggaguccacugagccaagaugugauauuaggaaggcaugcugguguuuagaagcagcaggugauccagguugacugggucuuaggugauauggaaaugacaugagagagaaguuugaaaaccaggauaagaaguuuguauuuguaggcugggugcagugccucacuccuguaaucccagcacuucaggaggcugagguggauggacugcuugaggucagaaguucaagaucagccugggcaauguggcaaaaccucaucucuacaaaaauccccaaaauuagcugggcaugguggcaaaugccuaugcugccagcuacucguggggcugaggugggaggaucgccugagcccaggagguccaggcugcagugaguugaaauugagucacugcacuccagccugggugacagaggagaccgucuccuguguuuguagacagcauugugcuuugggagauuuguagacagcagggugucagauagguuagagguggaagggaggggacagguauccugugguggggggagauaagacagcugcugagcuugaggccaggagagggggcagcaccagccuuuuggugguggugucaugguguagggcuggguggcaggcugucaagcccugucucugguuacaagcauguguacaugacugugugugccugugaaagugugacuguguuugugcauaagcugaggggugagacagcaucaggccugggcuucuggaguaugagaugcuugaccuugaccaccuuuggccauggcccugacagaaaggcaguaauugaguaauaaugucagagguucaugguuucucaugcucuggcaucucuugucccuucugcccucccacaacccuucuagccccuuuugcccuaucuggagugaugagaggggauugggaguucuuccuuuggucaugaauccuuggugugugagggaggcugcagguuaggacagggaugaggccuguugcaucgcucuuagaccuuggacauccacagaguuggggccacucauuugaaaaccucccuggaaggaggugauguuuagcuaaacaggauaugaugagccuggaaugugggagcagucucucaccccuguaugcuuguccugaugggggagggugggcuggcaaggucucugaaguuaucugggccugacaguguggaaaugggccccucuagaagugauacuugguacauggauauuugguaaagccagggcaacugccuuggcaucaggagcugggauguagcccuugcuugguugagcagggcuccuagaaagccugacugggcaggucugcauacucucuugcuccuauguagguagguccuuugaucugcuuauuucacccgcuacuugcaguuugcaaagccuugggauggggcuggaagagcucccuggggcacucaugcaggcauuaucuucaaaagcucuuucucuucccuguuucuuuuauuuauuuauuuuuauuuuucgagacggaggcucacccugucgcccaggcuggagugcaguggugccaccucagcucacugcaaccuccgccucccggguucaagugauucuccugccucagccucuggaguagcuggaauuacccaggugugcgccaccacgucugacuaauuuuuguauuuuuagucgagacaggguuucaccauguuggccagacuggucucaaacuccugaccucaggugaucugcccggcucagccucccaaaguguugggauuacaggcgugagucacugugcugggccuucucuucccucuuucauauccaucaguuucuguuuggaccuuaauccaccaaaccagaagcagaauuccccuccaucaguuucuaaaggaaaaugucauugaauuccuggagaaauggaaaugccaggugggagggaggauguaaucuggucauauugguggcuggauggggaagggucugcagagcagacucagugacuuucucacucuuguguacaacucuguucccuuggauucuaacacauggaaugcauggaggacccagagauguggaccccucuggagaagcacaugcuagcuacagguuuacugaccugcaguguggauggauugggauuuugugggggaggugguggaaguaagggaugggugagaggaucccaccacugacuugcaugugcaggacacugcuuugggggugaauccugaagcacugaggggccuuggggguuuucaggaauuugccaccuuaacccgggagcugagcaugugucgggagcagcuucuagagcgggaggaagagauaucagaacugaaagcagaacggaauaacacacggguaaguggggaugaccuugugucgcgcgcgcgcacguguguguguguguguauggggguguguugugaacaccuugaccaagagagcaggcaagaguggggccaggcacaguccuagcucaagccccauccuucccucuuccugucucccauccuggggugagaguuacaucguuuaaccaccagugcugggcucuccaccuguaguugcugguucacagaaagcucaggguccuggggagaggccggggcagucaccuugaguaguaucaguuggggcgggagcucugugcccauuuggaaguauuucaguguuuucacagugggguggcuguaacucaugucugcucggggaucacauggacccugcuuguagccccuggggcacaugcuuacagcccucccucucacccuccccugcucucccugccagcugcuucuggaacaucuggagugccuggugucccgccaugaacggucacugcggaugacuguggugaagcgccaggcccagucaccuucgggggucuccagugagguggaggugcugaaggcccucaagucacuguuugagcaccacaaggcccuggaugagaaggugcccaccugcccgccagcccccacauccagccaggcugcccuggagccucccauguaucccuucucugagauuuccacauccgguauuuagggagcacuggcucccuccaaacauugucuuaacuucaagguccuccuguuaggcucccuccugcaaaugugcugcuuaguaggcccuucacuguccucaugcucaguggugguagaccaagcccagucucuuccagccugacucaaguggggucccccuuucuuccuccaucuccccuuaccucgagcaggugcgagagcggcuccgggcagcgcuggagcgagucaccaccuuggaggagcagcuggcaggugcccaccagcagguaaucugccugcucacccucagucugcagcuccuggaaguccaggcugguucaccccugugcccuacucuguuucuugucagauuucucccugccauggcuggaagcugcuaggcaaggcuaggcugagcaccucuuucuaggagacauuuuuuaacuaagacaggggcuuuggaagggucuggaauguaugggagguucucuucucuuugacucauugcccuggggcuugugcccuacaggugucugcccugcagcagggggcaggggugcgggauggagcggcagaagaggaggggacuguggagcuggggccgaaacgccuguggaagguaggucauggagagcuguguagcaggggucauguguuccccaaggugggagguuggaggcccggcucugccuuaguucaguagacuaacugcuugaauuaaauuugaggcuuucucugauauucccccuucucuuuucuucuucucccuaccccaucugcaaugaaaucuguagauuuuuauuuuagugcccaacacaugcugggcacaucauacgcuugucugcuugaauuguuaggcaccaucugccucauguggcagcaucaggcaagauuccuucucugucugaaccuuuguucccccagucacgccccuuucuggguuacaagaggcuggcauagcagauaaaacuagaaacuuguuuucaagagagacaaaggauagcaagguguuuggucauugucaggagugaccuccuggggcccagagggaggcaguuguagccagaggagugcugugauguugggggcagagccuugaccugcucugggugugcuguuccuccuuccaccccugggauaggggaguggggugggugggaugcugcugugacucacagagcuacugucccuaucccuggaggaggauacgggccggguagaggagcugcaggagcuccuggagaagcagaacuuugaguugagccaggcccgggagcgacuggucacccuaacaacaaccgugacugaacucgaggaggaccugggcacggcccgccgggaccucaucaagucggaggagcugagcagcaagcaucagcgggaccuccgggaggugcgugagggcgcaggccugcucugugaccucauuguggagcguguggagggagagccaggcaaaggcucuggggcgugagacugaacaccugccuccuugccuggcuccauuguuggggggcggucauggaaggggugggccaaagccagaaacugacaggagaguguagcucaugccccuuaauggguuccaaucagccagguguggguggggagguguagacaggaugggggcaaggaaaggcugguuaccguccuucuuguccccucuucucccaggcucuggcccagaaggaggacauggaagagcggauuacuacacuggagaagcgcuaccuggcugcucagcgugaggcaacauccauccaugaccucaaugacaagcuggagaaugagcuggccaacaaggagucccugcaccgccagguaccuccucagggugggguggggaugggcauuguacuuagcccuggagguguccucgugaaccuacuggugauggcugaggagccccugggguccugcaggucacccuuugaaaggggaagucaggcgucucgggcagccaacaaccaagauugucccuugcugcuucugaccugucaucugcucucugcugaggcuggggugggggugggggcuucagugcucccuuuugaaucacuucaccacccccacauugcuagugugaggagaaggcccgacaccugcaggagcugcuggagguggcagagcagaagcugcagcagacgaugcgcaaggcagagacgcugccagagguggaggcugagcuggcccagagaauugcagcccucaccaaggcaagugggccaggggccugggaucugccucugucccccauguucugagcucucagggagccaggcagggaagggagcgcgugggaggcgcacugggccaggagccagaaaacugcuucccgccgugugauuccagggagcacacugccuugugccugucaguuggaagaguaaucccuguccucaucacccugcagggaugugacagucucauaagaagggguguaaaaguacuugaaggagaagaagcuauguugaugcaaaguguuuuucuuuuucuuuuuuuuuuuuuuuaauccucuacaccgucguggugaacacuuucuuucacuuggggcuggagcagaaagauuaggacuuucaucucuggaaaggugaaaccuuagaagagaaaugguauauauaucccugaagggcaaaggggugagaguuagguugaguacaucuuugauugccaaauugaagcuucuagaucuagggacugcuccugguuguuugaaggcugcaguuuuaggaugaagaaaaaagaauacaauuuuauuuaauggauacuuuaugaaguaguaauuccugagaggugugcuggcugaaaacauaauagguucuggaagagccagguaaaugccuggauuuagacaugcagggguuaaucaaaauaauuuaggagcguuuucagcuggucagccucauaugggaucuucgaacccguggcgagaagaaaaccgguguuuaggaagcaccaggcacagugcucggaagggagaggcuggccggccagugugcagcucagcugcuucgaggacggaaccugcagccuggcugugucccagcagacccaggaccaagacugcuucugccacugacugucucugcgaccugggaaaagucauccccucccuuaacugggccucaguguccuuaucacuauguuggaguuagacgggauggucucggaggucuuuccagccucgaggaaugaaggauuggguugaaaucacagcagaggauguuaugugugggcugcugagcagucagccuuagugucucccaaagcugacaugaaggcacgggcugaaaugauuaauacagucaagugagucaucgcaggaggaguuuaaggaaggauuuccugacuauaagagauguggcuuucuagaauaucuugccagcagagacaguagggucuccaucucuggacauccaugacuggaaagggagacuaccccaccugggcugguuuaacagcagagccguaaccaugcggggcuaacauuuguugagugcuuacuauguucucaguguucgccuuggauuauuucauuuagucuuugugaugguccagugggccugggugcuauuauuacccacauuuuacaguuguggaaacgaaggcacauagagguuugguaacuugucuaaggucacacaggugguaagagggagccaggauuugaacccaggcgguguggcaugagcccaugcucuucagugugguucuauccaucuggaggcguagagguuuaugguagcucaugcuuucaaguggagcuuuuucuggaagcauggggauuauuuacagucucuugaacugcuagcuucaggauguuuuaaggcuaggccugagcgaggaggaggcaggggagaccuggcagguauugaaguaccugggaagaaaggcaauggggauggugguccugcuccaagaugauaaguggaggcugagcgucacugguacugggggccaugauccccagggccacccuggcaccagggugcaggggaugcggggccugagcaggaagaacagagaucugcgggcugcaccgacccaucccugccccuaggcugaagaacggcauggcaacauugaggagcaccugcggcagcuggagggacagcuggaggagaagaaccaggagcuggcacgggugagggcaccaggccgggcccucaggcccccuccuucccgcaggacaggcucccagggcggucuguggaaggggcacggaggaagggccuggccagggacacagccacagagagugggaggaggcuggcaggugaagggggagguggucaggagacuggagagaguggcucccagaggaugagaagaggacaggggagggagucaaaccccagcaggagagggugguccucccugggagggcggccuggugcgaggcagacggcugugcaggugcgccagcgggaaaagaugaaugaggaccacaacaagcggcugucggacacaguggaccggcugcucagcgaguccaacgagcgucugcagcuccaccugaaggagcgcauggcugcccuggaggagaaggugcccagaggggcgggguugggaugcgagagguuagugcuggguguggggcggggggaggcgggacugugaugggcgcaggcggggucucaaugggguggguggccagccuggagagguggggcugagacugcacacccagaggcucaggucuggaaugggagaggaaggcaggggccuggcucacagcugcucucccccagaacacguugauccaggaguuggagagcucccagcggcagauugaggagcagcaccaccacaagguacccggcugcggccagccccgcccagccugggagggccggguugcagggaggaaaggacacccugcuuuuaacgcugcugcucugauaccuggcaguguuagugcauauguuagugcacuacauacauuauuccgugauuucucacuagagcccaucaugguaggugcauuacugcccacagggaaagaagaaacugaggccagaagcauagggcagagguggacagcagagaggcagggcccagugaggggcuccaccccaggauuuggagggagcuucaaacccuggugcagccagagccuggugauucugggaggauuugccuccguccuggccucggcaaugucugugaggucugagggggugcuggggcccucugcugcccagccucaucugcugugcaucugugcaguagugaggggucggcaggccuaggcuagcagagcccuccccagacagacccccuccuggcccugccccugcccauccuuccacucacucucugguuggaccucuucucuuuuggugucaucugugggccuggccuggggccccuggcuuuggacuuugcaguacauucuucagcuucuccccaacucugcuguccucuuugucccucucugacucccacccucccucucugccccucccuggcccccacucccgcccccaccccgggucugcuggcacagggccgccugucugaagagauugagaagcugcgccaagagguggaccagcugaagggccgaggggggccguuuguggauggcguccacuccagguacugcagcgccagaggcugggcaugccaggacgggguccugauggaccgugaggaaggagacuuccuuccaacaaaagacugcccaggaccucaggguccuccuccuguucagggugggacacugaggcucagauaacuuggucagagucacccagcuuacuugggcaguuugggagggaacaccuguccuccgagggcugcugagaggcgagucaucagacagccagugcucuguccccgcugugguaggacauaggccaugauuucugcuuccuugacagagggcacaccccugagagaggccugcacaucccuugcuuagccauguccuacagggcccacugguagggagagccauucacuccaguucucuugagagucaaggaccaccugaguucaggcagcgggcagaaaggcagcaggagagauuggaaugaagcaucagaaacuuccuuacuggaaguugagacgccauggcaauccuauggacuuggcaucccuuuucuugaaaccauugugagagauggagcuuaucuccuaaugcuugaauuaggcccauguuuagggaaccucgggauuucccccacauuuuguggagcgauggguauugaauucagaccucgagccuguccucaguacccaggccagagagguggggugaagacaggggagacugaaauggauggugccacucaagguucauggcucuuggcuguuuucucuccaaaccaaagucucuuagaucagaacccuugccguucccuuuggucaugugcuugcuguaucagggaaauggagaugaacuaccaugaagaaagguuaauggaaauauccauauagauauguguggaggggcagugguugaaauagggaaggggauguugagcuugaagaagagaagcccacgggugucuggggugguagagacuuaagugccaucuccacgcucgccaggaauuauuguauauggguaugaagggaagcagaggauggagacaggcaacaguaguuggcauuucuccuacuucucccauccugaccagaagagacaaccccucaauuaguaaaauacggcccacaguacaccaagccauuugccacugcuuggcuuuuuuuuuuuuucuuaaugguugggaaugcuuggguucgacuauagaaucauuggauucaucguggaauuggggcugaguugcagggagaaaaggggaacaugcaggaacuucccucucccuccagugaccucguauggucuguuguaggcucacugugucccuucacucuggacucccucaaggguuccaaguaggaaggcacagggaggaaguaucacuaggggaggcuuccagauauuccaggggauuguugcuuggguccuaaaaucucaggguuggaauagacucuuggggcaaaguauuuucucuggcuuguguuucugacaguguuagggccuccuaaagcuuccuaggcauagggguaugccuggcuugaauuuuaaccagggacucaguccagauuauggggagacccgaggaaaagugcuggguagaagaccaaaaaacaaagacccucagagugaaaagggccucuagacaucaucccuuccaacaucucccagugccuggagcccuccugcgccacgugugucagauggccggagagccucugcucgaauaccucuuugauggggagcucaacuuuuuaaaagccaccaguugcaucguaagccaacucuugccauuagaagauccuucuuaugccagacggaaaaccgcucucuggaacuuucuccccuggcucauucugaccccuggagcaccagggcauacgucugcucucuugcuuacacggcagcccuucagacauuugugacagcucuguguccugcuaagaugucucuucucugagcugaagaucccuugacucuuugggcccacugggugugagcugggggucucaguccucagggccugucuuuucucucccccaucaccgcucaaggucgcacaugggcagugcagcagacgugcgguucucccugggcacaaccacacacgcacccccaggcgugcaucgccgcuacucggcauugagggaagagucugccaaggugaggggguggagggaucuccucagggaguuuggggucaauucggccgcgugccuggcuccaguuacgcagacggcugguguguggggcaaauccuuccccuucccucccgugucaaugacagcugcagcccugggguugaggccaucgucagcugcaacagcugugcccccccccccgcuugccuuggccuccuggugggcaagaggugggggcuggcaggcagccaacagucccugaggccccacugaagugugugugcgugugccugggcgugcaggcguguguaucugguggucgggcguggggggugggggagcuucacggguaagauggaauuggcagacuuucuggaacaaaagcugugguucauggcggagacgagggagggaugacagguuaacuggcccuugggauggcaccuggaguuuuccgagaagcagcugugaguucaugcugucugagucugccuagggagauuaggggagaaugaggaaagauauggggcagaaaaaugccgaguuugaucuuuugggaaagugcaauuauucgucaugcucuguccugaauccagguccucuaaauaucauuuagagcacugggguauuagaagauauagauggagaaagagggaacuccuagucucaggggaagauucacucugcccuuaagaaauccucaguccgaugggggagucacagucugaaggugccucuuuuucuuucucccccgacuucuuugcucuuucuguuuauaagaauauagcagcuauccaggagcugagaggcugcaggagccugaaggggagcuagggggcuugggucauagaggauggguguuagaguaccuuucugucccuggcucccuuccuuccuucucuacucuucuguucuccacccuccccucuucugggccuuuguccgcuggauagguuuguaggaugauuucagagaagcugccgccucucaggguugaccagacuguccugugaugaucugaaacucugcagacugucuauucaggccugcuuggccuuucuguucucuggguguagucagccuuugaguuuguauggauggaaacugauagcauuuauguagugcuugcuuugugccaggcacagugcuaagggcuuuacauguauuuuccucauuugauccucacagcuaucuaugagguaaguacuuuaccaucccuauuuuacagaugaagaaacugaggcacagagagguuaaaaaauguuccuaugguugcacaacuaguguuugguggagaugagauucaaaccaaagccgucucucucuggauucucuucuuaacaguuagagcaguauuucuuagacuguaaugugcaaacaaaucacccaggggucagccgggcacgguggcucacgcuuguaaucccagcacuuugggaggcugagguggguggauugcuugagcucagaaguucacuaccagccugggcaacauggugaaaccccgucucuacuaaaauacaaaaaaucagccgggcgugguggcgugcgcuuguaauccuagcuacucgggagucugaggcaggagaauugcuugaaccugggaggcggagguugcagugagccgagaucacgccacugcccuccagccugggugacagagggagacuccaucucaaaaaacaaacaaaccaaaaaccaaaaaccaaaaaaccacccaggggucuuguuaaaaugcagauguugaaucaguaggucugguggugcggccugagauucugcauuuccagcaagcucccaggagaugccagugcugguggguagagguagggaggguccugcucugcaguuaucugggugucuuauuacgacuccuuuacccuccuccuuugcuaaggacugggagacuucuccacugccugggaugcuggccccggcagcuggcccugccuuugacagugacccugagaucuccgacguggaugaggaugagccagggggucuggugggcucugcggauguugucucccccagcggccacucagaugcccagacccuggccaugaugcugcaggagcagcuggaugccaucaaugaggaaaucagguuagggcagggcuggagggcuugggaagugcauugaagggcaggggggcccuuuguguuggaaaaacccuauauggguuugcccaacucuuauagcugcaacuuagaguaccacaguucagggacccucugugggucaucaggcccgcugccagugccggagugagaggagcagggccucaguggacuucucaggcuucaccuccccucucagggcuugcgauguggcugggcucaggaggaugcaugcuguguuccugcagcccugcagcugaucuuaaccacuaagaguguagcuccugcuuacugaggcuagcucagggugagagcuuuguaaaugucacuguccaucuuaccacagugccugagguaggcagcaugaucccuguuuuacagacaagggaacagaaacucagagagguuaagugacuugcccaaagccacacagaagugacagagccaggauucaaacucaagucugaacuuggcccacugcaccaugccuccugucccuaauaaggcaucaaacagaaacagugacagggaacguugugaaaaccuucacuuuguccugccuuuuuaaugaguuuauuaauguuaaugacaaacagcagggcaauaucugagcuggaguguaucagagcuuuauaagcuguacaggacauccaguucaaugguucaauguauugcacagaccaguuacaaagaagacacacacacacacacacacacacacacacauacacacacagagagagagagagaaagguacaaacguaggaccaccagcuuuuuauuuugcaaaguaaaacauuaaugauaaugacuaucuauuaucgcaaucauuuugcaaaagaaaggacauuuuaacauuccugaaguaagaaagacauacucagaauaaaggcgaguccuucuuugugaaagggagugggcaucuuuacuggagcaugugugugugagagagugugugugugugcgugugcaugcacuccuugcugagugccucccaggcacacacguguaccauuuuuauuauuucucucauuuuucuguggaacagggaaaaccccaccaggggucagcaucauuuaaaaguccuacacuuggaaacugcugacuuauaccacuucagacauagcauauguugggaaacugaggcacagacagcaaaauaccugacucaaggccacccuauaguuagggguaugucaagaauucugauuuucaggaugguuuauguuccacugacgaaagugccuccuuccccagcagcugcuuuuguuaaacggagggaguaggcaagcuaacaagaaagagauguguuucuaagcuccagugggacagacaaagccuggcggguguacaccgcaugugguccuugguggcgagugcaggcaucgacccgcacugccuccugcugguccuggcuggggcuaguggugaggucugguuuugccucccuuccaggaugauucaggaagagaaggaguccacggagcuccgcgcggaggagauugagacgcguguaaccaguggcagcauggaagcccuaaaccugaagcagcugcgcaagcgugguuccauccccaccucucugacggcccugucccuggccagcgcguccccaccacucagcggccgcuccacaccuaagcucaccucccgcagugcugcccaggaccuggaccgaaugggggucaugacccuggugagaggcagcugaggagcaggccuggcaucacuggacccugcaccgggggagguuuuaagggaugguaggacucacgugcucucagcugggccugccaucuucuucccauggugugugcagaccccgacaugucaggccaccagccuguccuucuggguuugggaagggccuaggucauaucuucuuugcccucucccuuggaugagcccagacugcuuaagaaacucacccacugcccucaccucuuccuuucuuccagagaaauaagcccuggcuuguuuuucuaggccagcuuuuuuuuuuuuuucuggcgugauauucucuccgggccugugugaggcacugaauccuaucuucucauccuaagaccacugggcuccccugggguuggcucuagggcacccagagggugagucugagcuuacccaucccucucucuugcagcccagugacuuaagaaagcauaggaggaagcugcuggugagugcugccugauggcccagguacuaacggguucacugcucccaugcccuuuccuuucagcuuccucccccagggcccuugagucugagucugaacucagagaggcacccagggccuccccacugcauuucuccaugcuccgccaccucuucugggcuggguaggcaggcccgagaucucucccucuauccccugacggcuccacugucuguucagucgccagugucucgggaagagaaccgagaggauaaagccaccauaaaaugugagacuucuccuccuuccucacccaggacgcugcggcuagagaagcuuggccacccagcccugagccaggaagaaggcaagagguaaguagagcagaccccaccuccagucucuccauccacaggguccucuccucccuuccucugccucugcagggaccgcaucuccccugucccaguuucugaaugucuuacuucucuuugaaacaccaucagggaagggaguucaugugucuccuuuucccccaucccaguucugacuuaauagaaguucuuccugaggucuaacuuccaucuuuccugcugucacuuaaguauguuucuucuuauuccgcccccuucuggcugucacccuguagugccuuggaggaucagggcagcaaccccagcagcagcaacagcagccaggacucccugcacaagggcgccaagcgcaagggcaucaagucguccauuggccgccuguuugggaagaaggagaagggcaggcugauccagcugagucgggauggagccacaggccauggucucuguccccuuccuaacggaggucugggcgggcauuggggcaucagaagcaggaagguguacuuggacuggccuucucugccugcgucccagggaccaguugggggaagccccaggcagguuaccucagaucugcagaagcaguuuuugguuagagcuauucauggcgggguggauugccuugugaggggguaagcuucugccucugcaagcgucaggaaguggcuggauggcuuuauuuggcaugcuguggaaaggucuccuguauugagugaaagauugggugucugggguuucuuugaauuuggagauuuucugagguacugugcucgggaccuucaggagaaaucucuugguuguuucuuuagaagagucaguucuugauuggaacuuauuucuggguacaucuggccucugggacucaaaaugugauaacaccuaauuauagcuuuguagacauuaaauucaaggaagagcuuaggcaagcguggcaucguuaucaccucugugauaguauaaaugucuaguacaugcuuggcauguggugaguacacguuaaauguuagcuuucaucugcccccucucuucuauuucuucuuuucucuuuuccuuccuguuccuccaccuuuucuuucugucaucuauucagccauuuguuccacaaacauuuauugaguaacuacuguaugucuuaguaacaggugcugaccaacaguucacuccuucaaggaguucagugucuaaugaaaaggaagaagagacaauuccagaacaaccuauugauagagaugugcccagggugcuugugggacucagaacucggcuauggaaugguggggacaacaggggcggccuccuuugguagcgacaccugagcuaaagugugagggccacauaggaauuagccgagccagggagacaucuguguguggaggaagggguuggucugggaaaggcaaaaguuugugggugugagagguugguauguacuuaugcauauucugaguugagaaggaggagggugggcggaguggggagaugggacuggacagcuaggcuggggccagcugugagggccuugcagcaucuguuuuaguuuaagaguuccccugaggcagugggagcauugaugaauuucgugcaggggaggaacucaucaacuagaauaaaggaaccuuuggacccaaaugcauaauuagaccuuucugcagcucaggaagaugugaaucagaagacagcuagcuggcugaggaggaggaggagggagagcacgcgaggaggagguuggggaaagaggaaggagaaagaggaauuugcugagacagggagaggucugugugugaaggaaagggguggucugggaacggggaggaggaacauggccaccucugcucagaauaugggagugucagcccagagaaugagguccagcuccuucuuccccaguccacaggggugaggggaguuguggagcuggccacagacaggggaagcugaacgguuugaucaggggaagaagcauuuugggugaagccuuaugauuuucgaugcucuccacacacguuggcaccuaaaccugagacagcaccucagauugguuucuggauuacccaaacuuguugccuacugugcacugugggggggugaccgggacuuaaaagaauucuaagauucugccucuggccacgaauucugaaggguucuagcaucaauucaaggagauguuuaguagaagacagaacucugcauguuccccuuugugguuuugugcaagugaaugcacccagagaaggaggcucagagacacagcucucaguguguggauuuccacaccccugacccaagccagggucauccuucucucugagccuuguagcccacuuguguuuggggcucuggguuuccuuugcaccuuggcuuggaggaaggacagguucugucuaggauucuagggucgauaacuuggguccaucuggcuggaaaacacccccaaggcugaggcuccuggggagacucucugaacuggggaugacccgcuugaugccauucucugagacugcuuggaugcagggacacugagcagaagcuccaggaauaauggucccgucaggccauggguuguccucugccaaggagccuccugcugcuucuguuccccaccccugauccaggcaagggaggagaggcagaggggcuggcugacacacacaucucuuuccuuguaguucugcuaacagacuccgaauucaguaugcaggagccuauggugccugccaagcuggggacccaggcagagaaggaccggcggcuaaagaagaaguaagagccacaggccagggucugccaggguggggcccagcccccuacccacuucccuuccccugggcugcugugaaacugagcucagagacccagaccccagcaaggcccuuccugaacugaguuggucugguccaugugggcacagcagggcugggaggagguucuuaggaugagccuagggagaaggaggcaaggggguuaugggacagugaccuggguccucugggucucuggcagggcagauugaaaucucuaagucaaugucaggucacaugcaaacagagagcuccucgcccucuugggguggucagguguuccugccccauuucuuguuguauuucuucagaggaagaaggaagagcagagcagaggaaguccaggguggggagcaaggguugugggucuccagcucuugcacagcccaguggucccuggagcaagaacaguuaagggagaaggaagaacuagugagucuguuguuccucuuccuauaagacaccagcugcuugaagaugcccgcaggaaaggaaugcccuuugcccagugggaugguccuacuguggucuccugguuggagguaagccugagcaaagggaguccacucaggggucuggagggaaggaugcuuggggugggcagaggggugguguccuagaacuuuuacaguguguuucuccccugccaaguggaagugugccauaccuagcauuuagccccccucccccuccccaacacacacacauaccagucgcaggagagaguugaugcuacuuuuaaucuguaaaaugggagagugagggguuugaugaccgccacauuccuaugaucuguauuugcuauucgaguccguggaugaggccuggcccuugccccuugcuguugccaaacucuuggugguagggcccaggccuugaauuaccucccugugcccggugucugcagcucuggguggggaugccugccugguauguggcagccugccgggccaacgucaagaguggugccaucauguccgcucugucggacacagagauccagcgggagaucggcaucagcaaugcccugcaccggcucaagcuccgccuggccauucaggagauggugucauugaccagccccucugccccacccaccuccaggacugugaguggccccuccuuugcccaggacauuuucagagguccuggaacauaguuugcaaggucuccuguugggcuuugggaagauggcagcauugagcccugccccuuccuucccauccucacaaagggcucucccuggucuucaggaggauaugauguugauucuaggaggauaccagcagccuugguucccugccuuucacauaccacccauggggcuccaucuccccaucccuacucugccaaaauuuccacgucucugggcaguuuccaggaugggcuuucugggguuuuauaugguugucagguugggggaaacaaagggaagagggcauuugugaauauugucuugguccucuaacacaagaaugcggacugcucugugggccccugggguggagucuuucauugucggccaucuccaugauugagaccagcccccauuucagaggacucagggagggagcuuuguccuuguccuuugggcucccagccugauggggauccuggggacccacacccaggaccagcuagguuuccucucugccugcagucuucugggaaugucugggucacccaugaagagauggaaacucuggaaacaucuacuaaaacagugagucuggcccuuggccuuugucccugggccugggguugggacugauacucccaugaggaugaggggaaggcugugggcagucagagugggcugccaucgaucucacgugagguugguaucccugaggugugaucugcugucacgguggaggguugucgggagaggggugaggcugggagcggagcaguuuguaugugugugauccuucccaggaggucacaagcuugcccugggccacuggugugcuacagcggaggagaguugggcuggggagggcuuugcccugcuauggaccugagccacagagucucugcccuugugcuuccucccugguggaggaauggggaguguugggagagcugggcaucuugccuggcucccagucaagccugggagguguguguuuuugccacacacacauuugccccaccucaacgcaaacaugggugcacacaccaaccuuguguucucucuuaaccauccugacgagcuuuccccagucacccagccagauacugggaugucuuuuuccucuccuugauggggccuaggguagagcugauggguuucuugacuuugccuguuuccccuaacacgcugcacucguuccugcuaggacagugaggagggcagcugggcucagguaagacucccuacccugucuagaaccagcucccaaaacuucaggacaguguucuucugguagguucucuccgcagcaggaaucucugaguccuucauaugaaaagcccuggacauagguucucugcucccaucagagugccccccgcccccacccaguucccucaaacugcuuguucugguuucucaggguggcaggugaggagcccuggaggacuguggccccugcauuccuggcccuucuccucagucucauucuuuuccugggaauaaucagaccuagauuaguaugagucuucuuccucucccugucccucucaggggcacccuggugaacugagcgaaggucuuucauccauuucaugagcaaacguuuauugagcaaauauaaggauuaggccuuuccuggcucucuggauauagaaguaaagaaagcaagcccucauggaggcaguaaacaaauaaaggaauaauaucaguaaacaaaccaugucaauagggauaaaaaagacagucucggcugggcgcgguggcugacaccuguaaucccagcacuuugggaggccgaggcgggcggaucacgaggucaggagaucaagaccauccuggcuaacacagugaaaccccgucucuacuaaaaauacaaaaaaaaaauagccaggcaugguggcgggcgccuguagucccagcuacucgugaggcugaggcaggagaauggcgugaaccugggaggcggagcuugcagugagccgagaucacaccacugcacuccagccugggugacagagcaagacuccgucucaaaaaaaaaaaaaaaaaaaaaaaaaaagauagucucaauaaguaaacaaauaaagggacaauauuggauagugaugcgagcugugaagaaugaagcagggagcagcacuguguauaucugcucagggaaaaccccaccagcaggagacuggcugaaucauucaugccauaaaacacccuuggcagaggugaugggucgggggggauccgagccauagggugugaaaugaagaaugcagauccuaaaagaugcauggaauuugaucccaaaacucaaaaccaaacaaaauuaauaauauguuguuuagggaaauauacauggaugauuguaaaaaguguaaaacaguuuuuuacaaccaaaggaauagucagaaaacucagcauagugguucccuuuuagaggggcaguaggagaugugugcugacagcgagcaucagugugcaaacaguacaguguggguaaugcucugcugcuuagcuugguugguguccacuguugcuaacuucauuuauaugcuucauaaugggcacauuacauauagucuuauauguaucagcuauuacauuguaaaagagaacaaaauagacuuuuucuaucugaaaacaucaaguaaggguaaggaaagagugagguagggucgcuaugaaaacuaaagcuuucucaaguuggguggucacggagcacccugcccaggucaggaggccacguccacauggcacaggcccugcaggaccacacggcagggugugcgugggaaagcaacagaggaccuggaguguucuuggagcagaggcucaggccuuagagaaugagugcugcuggcuauucaggcacaggccaccacccuuuauuuuuuucagucuucugccaacauuuaacuuccuugcuuccuccaugaagccagccuugucccggagugagacaggcuuccuuugccacgcugcagguccucuguaacacagccucuccccugggcucagcgggcuugaggcucacugagagucaggaaggcacgucugcugcacaauaccgcaaaugcaacccagagucaacaggaaggauuucauauuagcugcugccgggauagcuacuucuguucauuaguguagauaauugauaugugaguggaaccguaucauuucgagaucuuaaaaaguuccauuuaaaauccucaccucccaccacuaccagcccccuuauugaagauaaacugaaauuguauuggacugcccuuccucccucauggguggaggauggauucaugugucucccgaccagcuauaccagccucagccugcuggcucuaccuuccucccccauaauagccuccugcaucucauuucccuagacccuggccuauggggacaugaaccaugaguggauugggaaugaauggcuacccagccuggggcucccgcaguaccgcagcuacuucauggagugccugguggacgcccgcaugcuggaccaccucaccaagaaggaccugcggguccaccugaagaugguggacagcuuccaucggugagcgcggcugggacccagggccaccucccucgugggggccuccccuagcucugagggucugccuccaggaacagaggugccuccaucucuuuccguggucuguucugaguggcaacaggucucccccuugggaaagucucccuugucaaauccuugucacauccuguaauuugaggauucgauccucagauugaccagguuucuguccuuauaaugacuaggucauugugucuaguccuaaagacacaaaaagucauuuuucuuuagcuucaccuccuuugagauuuuuccccaggucugaauuuuauugcuugucuuugggcuugcugaauuugcuguguuuaccugacaagacucaaacugaaccugguguucaauuuaggugucucauuccaaguugagagggaaggucuuccugggccauugccaugccgacaucccagaucggaaccucuccgcuuugggcucacaucccuuuuuauaggauaucauccaguccucuccuccucuuugcugaaaagaucuucuguucaaaagugucugcggcgcaggucccaaacuggcagccugugggcagaauuuggcccacagacuuguuuuuguuuggcccacauaaaucuucaccacucaaauugagcugccaguauuuaaacaguagauuuuauauacaauucuggauuucuggcuucuuuugaaaacuugaaagcucugucaacacauucuagcauggaagcaaccagcuggagcugaagaguggaguccacucaggaugggugggccugcuccagggccucccagccccccagccugcuucucucacuuguguuaccugccuguucccagcaggcauuugugcuggagaaugcaguagguggccacgguucuaggauuuggcaguuuuuaggaaguccuucuuaacauccagcuucaagucguguggguggcucuuugagccaagucuuuugucuugacuggauaauaagaccaggaguaggggucuucgagguucucucagggcucuguggauguccuguggucucuccaacucagaaaucuuauagaaaguuaaaucuggaagggaucuuguuaguguccccauuuuauggaugagaacauuaaggcauggggaggagcaguagcccaaggucacucagggaugauagcagaguacaggggaacccagguacgcugacucaaguccagugcucuuggcacugcacagagccuccuggcuuagaacccuuggccuaugugaccccagcaugagggcugacuugugagggaagaccgcauccuccccucugcacccgcccccacccaaaucagcuagggcugaaaaggaaucguuuuucucugcccggaggcugccaggcccagcugcaccuguccccuacucagugauugauagggcuggggagagaugagcuguugccccaccaagccgggaugugccugggcugcuagaggaucugucagccuggccccagccaggacuauggaaauccuccccgcaaccccucugccccauccccaggagagaauugugaccugaacaugggguucuagguucagcucugaaucuugaguacuucagaguuucuaaagcauuuucacaucucaccgccaaacuaugugucuaccugcuuuuauuccacguaacauuucacaagcauguucuuacgucuuuaaaauuucuuuuaaaucaugauuuuuaugacaagaaagggauauuuuaaaaccuuauuuuacagauaaggaaaacaaguucaauagagguugauuuccaucaggucacccagccaggugauuacagaauggggcucaaauccuugucucuugacacccuacucagagcucuuuuccuugggacauggugcucuauugagcaggucuucuagaagagcuccuguuuugguaggacaagcaugcaugauagucauaaaugucacccuaauagugcugccacuacugagugccuguaauguucccaagggcuggcuaagcccuuguauuuauugucaccugcaagagaggugugaccccaucucacauuugcugggugccucucagcuaggaaagggcagagcuuaagggcuuuguauuuuugccaugguaugcagcagcuuugaaaggaacuggacugaaaauuauagugagugagauugaaauuagacagaaggcauuuccagucaugagcugugugugcgcaugccccuucacaguggaccaaagcuuaaaccagcggcuugagcaacauaaggguggcuugggccagaaaaggguuccuggaaguggcaucucugagcucuguucuaggcagaagagccuccugcugagaagugaggggagaaaaggagggagcagucugcacaauuuaaucucacaaagcagugcccucaauaagagucaaaagcagguagaguugggagggacuuuccauucuaauucucuaaagaugggaaaacucagagaagcugaaugacaaaguagcauucaaggaaggaagaacacuacagcucuuccaagauggaaugagcugccuugagaaguaaugaguucgcugccccuggaggcauucaggcacaggcucagugacuacucugaaggaagcuguaggggugacuccugccuuaggugggagcguggacugauggccuccaggguuccuucugacccacagaaucugugguucuaugccuggcuuaguuacugaaugcuugcucugcaccugauacuguuuaaguacuuuuaguaauuuaugcgaauuaauuauuuccuuuaauucaucaagcauuuguagagucccugcucugugcuagggguuuaggaucagugaacaaaacaaagaucccugcccucauggagcuuaugaauucuaacuggaagagacagucaaggaauaauaaauauaugguauguuaauagacaaaacaugcuaggaaaaaauuagaccagggugagagggauugggaguaugggcuagggguggugauggugauaauugcaauuuuaaaucggaugaacaacgugacuagugaguuggacugagaaggugacauuuaagcaaagacuuaauggaggcaaaaggaguaagcuacacagccaacugggggaggaguguuccaggcagaggcagccaccagugcaaaggcccugaggccugcaggcccagugagccugcuguguuugaggagcagcaggggugucaguguggcugcagcagagagagcaagagggagaguggcugaaguggguguuaaauggguaguggagcagaucauggaguaucuuauaggccauuguaaggacuccgagugaaguagggauacaaagggguaucuuguuuuugcuuuuccuuccacuugcaggugguaggggucuuugucguuccagugccuggagagagagggacauguuggauucauucaaagaacuuuuuuucccaucaauccauccccaggcccgcucccugacugagagggaggauauggguuagacagagaaagggaguaaccucgggaugggucgcaggcaaggcccuggggaaggaggagcaugaggaggcuggggugcucuuugugcuggaggcaguaggucuggacaugcuguggcugaugcuggaugugagacagguggugugggaauguggccccacugaggcucuggcuugggggcugugugccugcagaaccagucuucaguauggcaucaugugucugaagaggcugaauuaugaccggaaggagcuggagaagaggcgagaggagagccagcaugagaucaaggguaagcucgucaggcuuggagaggguucgggagcagccugcuuggcuggucccugccuugggccaaguggaggggaggcauucugugucucagggaaucuuccagucugaaaaggaagaugcagccucaccuuagggagcucccagucugauggaggagacauaguccaugccaaguugucuauaauuccccucccucaaccccacauaccagauagcagccaccaacuggacaaaugcagugaauccucugggacgguguuauagacuggugugccuguggaacuuguugaucuggauggggcuggaugggagaugcaagucuuagaggagaccuugaagguggaaagaauaagaaggccauuccagcuugggucagggggaugacccgugcaaggguucuggggagaaagcuuggagccuguuggccugaccccggguccuguaaacuggcagggauggagugagugggggguugguuccccaggcacccaggugccagggaggagagaaagaagauauggaaauuuagggauggagugggggucagagagcaggguggacugcggcucuggguuuagggagcucugcuucuguccuuggagggcccuugaugaaacguaguaucuccuuccgucccuuuucuucccccacacuccagauguguuagucuggaccaacgaccaggugguucauuggguccagucuauugggcuccgggacuacgcaggaaaccugcaugagaguggugugcauggagccuugcuggcccuggacgagaacuucgaccacaacacacuggcccugauccuccagauccccacacagaacacccaggugggcagccuuuuaaucagucaacuugagucucucccuguaucccucacuugcucucuuucuuucccucauacacaaaggcuuagguaucuugggggguggggagcuuuucuagggccuaugccagaggggaucgcaauguccucaauucuccaagugaucgcugugcauaagcaagcccucaugggaacacauggccuucacauacagagcacaccuagcgugggccuggcacacagugugcucuuacaaugcgcauccccguccugcccuggguaccucuaucuccuccuaaccccacuucauagcugagacucugagccuuccuuuucauccugcuucucugaucugacuuuucuuagaggggaaugagccccagggccccuagggaccagagagcccauaucaccuuugucuaccacccuagggaucugcuccugggcccccagccuuaaaaaagcuaaauauaccaaauuacacaacccagagccucuccacaccagggcuuuggcucucugucaacagcucaaaugauuaaacaucucaugaaauuacauuucaucauuuuuauggagcugucaucuaagaauauaucuaaauucucuugaaccuauuuauauuuuuggccuuucuaacuuccuguggguaauagauucuagaaguacugcuuguuguguagaguacuuccugauuuuauuuguccugaaaaugccccugucaggccccuggggaaggaacuaccuccucuugaugguuuagguuugguaaggauauuuguauuuaacuaguucucaccuuuuaugauuucauaaacucugauuguauugccucugggcccaagccuuugucucuccagacggaguguucuuaauucuuuuaggcuuuccucauauagacucgccucuguccccugauuguuuuagcugcccuugucuggacuguuugcagcugucagaucucuuuugaaauucagccaccagagcugcacaggcuauucugggagcagacacguuuuggcuugaaugaggguagggcuguguugucucguaauucugggcaguguguuggccuuuugggggugguggcagugcacagggccauuguguccuguaggcauucugcagugacccccccgccccgcccccaccccaaccagucaaaauagauaggacagaucccuucauucuccaagaggagccuggauuuuucccccaagugcguucucuccacuugcccacuucgggcaagccucgucugccacuuugcugcccacucaccucucuuugugagacgcuucugaaauuuacaccuauccuccucaccuuucacugcccagaggagcagugucauuuggauacuugaaauuuacugugcuucuccuuucagaucauuucuaaaaauguuauguucccaauacuggcacagacuguccuuauggaacucuacgcuuaauauuuucuaccuagaaauggacuuuucucuuucuuugauuuccuaucucuaaugcauucaguuuuggaggauagcaguaauucuguaaauaguagcagggacaccucccuauggcuuucuaaccuuucuuaauuuccugaccccgucauugagcuuagcuguugggagaaguagugugugacccaauacggaaucccucauuuaaaaugguuaaaaauggcucggugugguagcucaggccuguaugcucagcauuuugggaggucaaggugggaggauugcuugaggccaggaguuuaagaccagccugggcaacauagugagacccagucucuacaaaaaguuuaaaaaauuaacuggguuugguaaugcgugacuguagucccaauuacucgggaggcugaggcgggaguuuugcuugagcccaggaguuuaaggcugcagugagccaugauugugccacugcacuccagccugggcaacagaaugagacccugucucccucaaaaaaaaaaaaaaaaaaaaagguuaaaaauaucugguagcaguuuugaaaacuuuucuguuuuuggcauuucugaaaacucugaaugaguuaaucuccugggaggccuagagagagucuguaugcacacagcccagggacaaccaguauccacagcugagcaggcuuccuaauuuuaaguuuuugaugugaaaacuuaucagauauauuuauuuaauccaaaucagucauguucugguuauccaugguuuacaugcuuacuuaccccuccagaaagagaaagacaggcacaauuuuccccuuucagacaauuuuuuuuccaaguaggugacgucucuuuaucuauguguucuaugaucccacuuuuuuguuuuuuuuuuuucuuagagacagggucuuguucuaucacccgaucuggagugcaggugugaucauagcucacuguagccucagacuccugggaucaagcuauccuccugcccaacuaacugguagcugggacuguagguguucacaaccaugcccaguuaauuaaauuuuuuuuuuuuuuugagacagggucucaguauguugccaagacugcuauuuuuuuuuuuuuuuuugagacagagucucacucugucccccaggcuggagugcaguagugccauuucggcucacugcaagcuccgccucccggguucaagcaauucuccugccucagccucccgaguagcugggacuacaggcgccugccacaccaugccuggcuaauuuuuuguauuuuucguagagacgggguuucacuguguuagucaggauggucuugaccuucugaccuugugaucuacccgccucggccucccaaagugcccggccacuacuuuaaaaaaaaaaauuauguuguucuaauuugcuguauaugaaagaauccuaggcuuacagcuuuacuuaugaguuugcuugaaggagcagcuucaaaaagguguguaaaggccucuaaugggcuaaaugcacuggagccuugcaucucugaccuuggacccuuggaaaauggugaaagauggcauaaagguaguuaacuauagcccuucccaccuuucccucuccugcucuauggacugcaggcacgccaagugauggaaagagaguucaauaaccuguuggccuugggcacagaccggaagcuggaugacgugaguaccuggccaugaauuaggagccuuggggauuuggucaucuucguuggauugagguucaugaguucugccuucccugggcuaauuguuggaaggcuagucuaugggaggagagccagaggggauggggauaaugucaggggguugaggagguggaccagcccuagaagaacuugucuuggguaguaauaggcugucgagaagucucugugaaacuccugugcaaaagcugaaggcccauguguuguacuuccagcaucuuccaauucugugccccgccuuccuauccacauaggaucaaagauuuuccccaaaggccauaucuuugggaucacaccuuuuucuuaaucucucagaccauguaucuucagugcugagcucagcacaccuccagcuugcucaguaagauuccagccuguccuccaggaguguggguguguggaggcggaugcccugcugagguuguuaaaugacagguuugcucucucgcucccagugcagucugcacaguuaaacacacgcucgggcuuuuaccaucccagcuuucucuaguuucacccuugggucuaccuucacaccaaguuaaaguuuuccucucucugcccuccuggucacugaaggaacagucccuugcacuugauuucaucaggcauuccccuugaguugagggaagacccuggcauucuaagccauaugguccccuuugagaugccaaccuaagcauccuacuguuuuguuuugcacugguuugcugaggucauagccccuccuuggcccccgccuccucuuccucccuccucacuuuccuaucacugcccuugccugucaggucugcgcuaguugaucuggcuccaaacaaguuaaaagaaagcccagaguguguguguuuuucgcugcucugucuucaguccaaucacuguuucuuaguaggguuuaacagggcgaaaauccaccuuuguagaaggauugcucugccucggggacacagggcacuauaaggaauacacagaauuuguggaaguguuuucuucacagagguaccuugaaguuugggagaaaagaauagacuuauauauguauuuuuuuugguuauuuagauacuuuaaaggggcuaaacuggcagcccccccucccccgacccagagcugucccaacucugauagaucuguuuucccaaugccccugugauauugacccucccacuaauuccacaugcacucaggaucucugcuuuguuuguugcugucuggagaaaugacucccauauaucuauuaguguggugcugucuaauuuagaagcuauguaguccuucaauccuuacaaaaauauucuuugaaugccugcccugugccaggcauugugccaggcauggugguuagugaugacgaugucucacuuuaugguaaugaucaccacaugagauagguuaugaugcccaucuuacagaugaggaaauugaagcucuaagagggaacuuaccugcuguggcagagcaggaccgaagcagaugcgagucugauuucugagcucuucccccuuguuccacuuccucugggaagcuuguggagcuaucuggccuaucagccuccagacauugggguggaguuauuguuuagacauuggggugcacauagagcugugcaguggaguuuuugggauucaacuaggugugggcuagagaggaggguuuuugugggaagcguagaguagaagccagguccugagaauaaggcaagauuuaggggugaggggagggucugggguccaaggagacugcuuccuguccaacugucuagcacaucaucagcaaccuugaguugucucuugcaaccacacccucugcugauuuugguacuuagugucccuucucaagcuucaaggcucuuaagggcgguauccaguucucccugcauauggagaugaggacucaagggaaauaaggaagaggggagcaggaaggaauaacaucugacuguuaggggacaggggaggagugcagaaacagguccuuaggguuggcugaagguggaaauggagauaaggggaaggcgggagagagaaaagaggcucugggcuaggguaagagcaggaucauggggaggacagcagugacaagggaaguuccuaacaaacucaggaaugggacuccugcauaaagagccagcugccaccuauucauuuaaugaauauuuuuauugagugccuaaugugaucccaggcacugcucagagguuggugauacauugguuggagcaaaaaagguuaugguuucugccccauggagcauagaauuugagagaaagagcgagaaagaaagugaaaggcauggagguagggagaagggaaggaggugagaaaaggaggaggaaagagauacagucaugcauggcuuaaugaugcuuagcuacggggauaaguucugagaaaugcaucauuaggcaauuugaucacugugugaacaucacagaauguacuuacacaaaccuaggggguauagccuauugcacaccuaggcuauaugguauagccuguugcuucuaggcuacaaaccuauacagcuuguuacuguauugaauacuguuggcauuugucaguauuuguauaucuaaacauagaaaagggacaguaaaaguauuauaaucuuaugagaccaccacuguauaugccauccauuacugacugaaacauuauguggugcaugacuguauuaaugaaauaaucucauaaauauauauaaaaaugcuacuaggaugagugcugugaccgagagguacauggugcugagaauuuaucagagcauuugacccacuuggcacacacaacaaacccuagcggggaagggcugggagggguuguugaggcaagaacaggugggugaauguccauuguuccugcuagucccacucugccugcaucagcucugagaacaugggguggagggagauugggcauggcuuccaagcaggguggauaaaggcucugaagugugggguggggaggccugugcagagggggauccuguaggguuguggcccugggugcccuguggcagagaugguuauuuuggagacauggcuggcaugggugaggggggcagguggcagggggcugccugccauguccuuuggaggagacugcaucugcuugguggucugccugacccaucccuguuacagggugaucucaucugaucccauuagugguaggcagccugagaaacagguagggcagauguuauuauucucauuuuacagauaaggaaacugaggcucagaggggucacucaccugguacagggucacauagccaguaaaauggcagagccaggauuagaagccaggugucugacucccgcccgacauaguacucuucugguauacugggcuacagccauucggaggccccagaaggacaggacaguguguauagggaccggcugucaccucccaugggcugaggcagaggaaugccuugaaaggugaauggucaugccaagccuacuuugagaagauugcggugggcugggaaacaguucaacugcaggauggcagacccaacaagacucucccccgccccacacacccccuccauccgccacccagagacagggaauuucagagucgcaggguuucccgauucacuguacagauggaaaaacucaaggcuagaaaggggaagugaccucgcucccucuuuccaaaggggugggaguggugccccuugaaccagcagcgacuggcccccuccaggcagggcgugaggauggcaauuccaacagggcccucgggccucuggugucccccauggugcagggggaugacaagguguuucgccgcgcgcccuccuggaggaagcgcuuccggccgcgggagcaccacggucgcggcggcaugcucagcgcuuccgcggagacccucccggcgggcuuccguguguccacccuggggacccugcagcccccaccggccccgccaaagaagaucaugccugaaggugaguaacaggcgggcugggcauggccgaggcccagccgagcgcgggcuucuuccuggcaccccagggccgggccggguggagaggggcgaggccgaggcuggugccccgcgcuccugcgcugcagcugcacuaacgcuccgcggggagcgugugugcgcacuaacccgccgcucuguguguucucccgcggcugccgacuucucccagcugggacggcggggucgcagagacuggagaccuccacgguucggaccuacuccugcugaccccccauccucccgccccgggucugacgggggagugcccguggcucgggguaagugggccaggcccggggacgcgggcaccuugcugcuggcccucggccccacgcaccugcccuuggcugccggccuggcccugccgcuccagucccgcuuaccagcacugccuggcuugccccuuccugcuucgucuggccuggggcgcuuugcgcuuggagcacgcugcguugccgcugucgcacacauccuacaaccucucucgcagaugcccugcaaccugccucacagugcgaugccugucucucucucucccucagcucacucccacuaucucuacggacacaugcucuccgccuuccgggacuagccauggcccccagggcuggcuuccuccuucuggguuucacaggcuccucuggcccugaccccucuugcucguuccccuuccuuccgcagcuccuagucucguccgugacuuuccgguugcccuggaucucagaauauauucguccacccccucggcaccccauuaccccgagucccaccguguguccguuguaaguccgguggauguggcugggguuuccugguauuguggaggcacccagguuguccaugcuugggauucugggggaaggagagaagggcagcucaggguggaugugaagccacccuuccucuucuggacccagccuggucugcacugcaaccuccaccaggaccaggauccugggccacaggcugggaugguccuuccaagaaagggucauuucagacgcagcccugcuugggcuauucaaucuuagggugucuauccacgucuggcugugccaaauggucuggcagcugguuuuggcauccccagcaucaccacucucccaacccaucaccgugacugcaguuccugcccccauucucuuggggucagggaggggcugggaagggcuacugaaggccccauucucccacaggauggugaggcugggaggaggaagacugagguagagauuccaggcccuggcauaagcugaaucccaaauuugaguuugggaagaaccagagagaaauggaucccugagcucugagccaagggugaggauggggaaacucuaagcucccaccuaauaagaagcauaggcagaccagccagagggagagccaauggccucugguagccuuaagcccaaagggcagugggaauguccccugccccaaccaucggguggagcuccugcugggcuauggggaagggagguugugcggaucuugacucuagggcagaacagaucuaaccaugcauugcuagcucugcucccagcaucccuuccccuucucuccuccucugccucacuucuuuaguaaucccaacccuauaaaaaugaaccuaauggguggauugaauauacauugagcccaaagucaaguuuggggaaaaggcagacuaaggccuccuuucucugaccucccaggaagaaaauagcuucuccuacagugauucaugucccagguccaggaaauccaauguuggugaaggcagccacucucuugcuuguccccaaaucaccuaacccucauccagggcuauuuuggugggcagggacugccuccucccggaauuccuaagauccgcccagcugccaccauuuucauugcuuuccccagcagcaugaugggaacccaagcugagggauacagguccugauuugguaggaauauuauucccaagaaauacccgcuccucaccuacucccucauccuaccaaggugccugaaaauguucaagacuuauguucagggugggaugauggaaccgagggcuucaucaaagugagaggaaaggaaaagcaucuggcauguguuucuuggauaggggccagugcagugccauccuacagguggcuggagcagcugcuuugcaaccugaucaccuugaguucugagcagggacuaggcuugcaggugagauaaugggccagggcacccaguccagaaggagcaauggcaccugggcagugccagggcuuaaagcccgcugcuccuuuucgguagaggagaggcccaucacuggugugguggggugggcucucccuuaggcuugggcaaggcagccaccugcccuugcucucccuuaguguucccuggccucccugccaucagguugcugggaguggagauggagggauuauugagcagaaaaugaguuggauggagauaaacagcucccaucccuggguaauggaugguaagaugauggagauuccuaagauugguggaguugggcaaugcauagccaucugacuccuucagggugcucuugaugggcuggcuguaagggagacucagucccagccucuccccucuacaacuccugccacuguuggccaugucguaaggcagcagcugugccaggauagcuggguccauucagagcaccuugagaaguguugcagggagguguuaagaagagaacucugugcaaacagugauggaaggcuguugucuugguguaucccuugccucauagucaauauauuuuuuuuuuggcgagucaccagugacccgagcccuccacaccagccuccuguaucucaucaggucccuucucaguacuguauuugcucagugcaucaggaauggguguaugggugugugugggugggugugaguguggguguguacguaccaauaaacaaccugguuuuaagacaauguacaaau

SEQ ID NO: 12863 - RNA, 6042 nt, Homo sapiens
ccuuucaauaucacacaggggccucagccccauuuauuugcacagccagggguuccugccacaaacagcaguuuucgauuaucaguagcuguuucccucuagccugggcaggggcugagagagacacacacagaaauaugauauuucagacuccuuugagaucugaagaaaucauuuccuccuuucuugccaucuccauaagaccaccucuggaaguaugcuaugcucaacuuauacucacacauacagauuugcucauagguugaacagugaaguuuaaguaaaacccauugcacagacuguuccuuucaucacagacacaaagaaggugagaguaagaugcuaucaaggaacuagccaaucuuggaccaagcguacaugcucccuuccuucuuacuccauggaagagacugcuccaugggccucuccuggaccuguugccacggggagauuuaggaggccauccaaggagugacugagccuuggcccucuuccauggcuacaggaauauuguuccugcagguacuauccagauuucagcucuagauguaacugaaaaaaccugaaacucugaggaaaggaaucuaaggcuuauagugcuugaguacugauggggaacaacugcagcgaacagcaccagggaagcuggaggaugcucaguaggugaaucgcaucuuuugugaguagcccaguuuguccaaguugggauggcaggccagcugcaccauuggggguggcccacaaagcaguaccagcacaucauccccuggagcgggcagguguucccggaucaugucggcagucacaaagcccuugcuguaggcccaaucugaaguauggggagaagaaaguacuuaauacuccagauacaugcuggcaaggggguguggugccaugagacuggggagggcccugaaaggcucuggagaaagugucaagugguagcagcagcugggaauggguauacucagccugccucaagcugagccuuagcagcaccgccaucccugucacccaccugguaaacaggaacccaaaggaaagggaccaggagaucacugugucugugcacucagacuuccgaguuggcagugugaggcaagguugauuucaaugaagccagaauucacaaaggggcaaggcuuugauuuugacgaugaggggauagugggauguccagaaaugggaaggauaccuuuugggggaugauccagagugaaccagagcuuaaagcgauugggauagcgggccugcaguuccucuaaguccucccgcaagaugauauccuuuucugucugaaaugcaaaggggaaggaaagucuuuaggagucuucucaggcccacauaaaaaguuuucugcuauacaacuuuccaacuaagaaaaagaauguuaagggaaagcaaaaguucuaggaaauaagcaagacuugcagugcuuuuagggaguuaggaugaggagaagaggggaacagccuuuaucuacacauuaugaaggaacaaagaugaauauuuaaccaagaagaucuaaguuucugugcuccagacuagauaccuuaaaaguuuucuucuuuccuuggggaccagggaaggaauuugauucagugcucuguccuuuuccuccuuauugaaagaggacccugugccuuacagaggggaccuugggcagaggcuaaaacagggcacugggccaguucugcccauccauaccacgucucucagcccuacccacacagcaacuuugaagucuuaggguggaggaaaacaaaccaaccugguuggcaaaaagcagaaagcacuggguuggaucuucagggacuuucaggauggcccggaucagcuguagcauuggggugauuccugcaugaagauaccccacagugaaauguaguggccacacucucugcccuguccuggcuccuuagcugaccagcccuuucaucuucauucugcucauucaccacuccacuccauuuuccuuuagcauucucauccucuaaacucuuccugcauauucuccaacaucuguauuuccgggcacccuucaaauucaucuaaguucauauuguagaaaucuuucuuaggaacuaaucuaagacucuucugaaaguccuuuggaggcuaggacuccagugucacaaaugacuacaaguaccuccggauucaaugaugaggguucuagaacacuguauuugcagagguuaagugcauguacuuaggcacuaggcagagccaaauacuaauuuugcuccaggccauuaccagugaaauaacccuguggaaaucauuuagccucucuggaaccccauugucucucuguaaaaggaaaaggcuaguaccuacuucauagauaccuauauaugugucuaauuuuugugucuaauauauaguaguguauuagacuacacagugucuaaugcacaguaguguccaaugcuaauuuucuuucuuccuagcuagucauuccuagcugcuucucucuucucucaccuaaaacuauuagauccauucaaaaugaggaaagcucauuuaauuuguuucucuaauuccaucaguuaaaauuuuuuuugguuucuaccugcuuaugauuuuguuuuucagauacuagggaguucuaagcauugcuggaaauccccugaugaacaacagcuuggcuaugguuaccagucuucagagggucaccuaggaauuugcauggcaacagucaacaauggugggagagaaaggcccucaguguaaugcaccugucccgccggcaaucauucccaguuucuucgccacucgggguucugguggagauuucuuguugggcugaauguuaaaaugcccugagaggucaggugaagagagcaguggaagaauaaagucaauacagcgaacuuagaaaacaaaugcagaguugaaaauaugccugaggccaguugagcagcugcuaugacaucugauccuggagcuuggguggaagcuugaguugagccagcccugacaauaauauaguugagggacaauggggccagggcuaucugugagucaguucagcgccacacaauguaucagcugcuucuggcaaagugucacucccuggugaaggagacaggcacagagccaggugugaaucuauuuucccaaguggcacacagcagcuccagggacuugcuaaugcacccagcuguucccaugggaagggcugaaagcuaucucuggcucacuccacagcucacccaggggggcaaauuuuugaagguggggaagaggggcacauguuugcuuuaguaaucuccacagcugccauggcuagggaauucaaguggaggaggaacugcuuccuguggcaaauggggcugagaaacaugccuuucuauuguaucagcgcuauguuuagaaggaagggcggcccuggcccuuacgugcauacacauguguacacacagccauacugugccaagaggacuaugggaacugauaaagugggagacaggcucaaggagaagacaggucauuaccuuuuccaguguaagugagcaacccgcuuggcccccgaaacuccaccacauccccaaccuucaggcuauccagguacugagacaucuucccucccucaggaaauuuggggugcacacccuucagguagaccuuacaagacagagagaaaaauaccuuauuuggaaugucacugguuucugagccccauguugacuaaaccucccugaggcuggggcagggaucagauaugugcuaucuuuuccccgucuacauacuuucuuucuuucuuuuuuuuuuuugagucagaguuuugcucuugcugcccaggcuugagugcaguggcgcaaucuuggcucacugcaaccuccgccuccuggguucaagugagucuccugccucagucuccugaguagcucauacuuucuucacauccacagaguacauaccauuuccugcugucaggcaaaucuuagaaauuucuacaaaucccagaaagaauggguaagcagccccugggucccuuccuagccccuuaccuugaugacaagauccacauagccuugauccucaucacuggugacaggaguguauggccugaugaccaggcugccaucaauucggguggagagguagauauguuugccuggggaccgugcagagagcuacauaaggguugucugugaugugcugcaucccucaaaauacucaaagagauuugagagaacaagaugucuugcuuccugcuguggucccaaggagcuacaaggcagggaagauuugccccauugagcccucaguuggaucucuuauaagcgcccaguugaggaaacacuuauuuccagcguuuccugccaguuacugccaggaccuugacagaugagccaaaagggucugggcaaugggaaaaaguuaguagugcuugcucagagggaguaauuagcaaauccugcagggaagaggcaagacuguugaguguuaaagcuggaugggggucauggaagccacacucuagaggggcccaguggcaccucacagcuuggaggaugcagagccaagugggggaaggggaaugguguguggagcaaaccgguugaagcagcguguuucaugagaucccaggaggggagucaccuucugaggauaccagggaaaggagcccauuccacacuuuccuuacccacaggcagccccagaguguggugggcggugggcagggcaaagcggaaccucuugguguuguggcucacagucuggaggguggaggacacaaguguuucaccaagcgcgccuggcgcugccacgucccuuggacaucccaaccaccgugggugcuguacccuccaugccaggagcacucugguccccuccuucacccuggcccuuucuuccccaacuuaccgucuugucuagcagucguagcagguacuuuucauugggguccaggagagugaccugaggccggcgggaccuccgaaccaaguaggagcccacagccaggccgagcagagugaccagccccacccccagggaggccagcaggacggggcucuguggguagaggaggcagcgugaccgccaggcuggguaagagcccggggcuuggguggugaccgucccagggguggcgaucccgagcuccagcgcggaggcaugccaagggcagagggguaaccuggcggagucccgagcccggaugugcgggaucgggaccccagcauccacggugggcccagagcccugcggggcggggucggcagcgacagccccugguccggagcugaguggccagaaccagauggggaggggucccccaguggaggauacugaaugagggucuuaccgucuggauccccaugacggagcgccuuuuccuccaccaccugacaagccgacagaucccacaaugcgccgcggggcgggucggagggcggggcaggccgggggcggggccgggcaggaggcaggaccucgcggcugggggggcaggaggcggggccuggcgggggggggggggggugucugucgggggcggggccuagcaggagguggcggcggcggggccuuuugggggcgggguccggcagaggcggggcugggccccucugcgcgccacccuuucccuccgcuacucgguggcucagggucuccggugcuuauucaauacuuuuuuuuuuuuuuuugagucggagccucgcucugucgcccaggcuggagugcaguggcgcgaucucgguuacugcaaccuccgccucccaguuucaagugguucuccuggcuccgccucccgaguaucugggacuacuggcgugcgccaccacgcccggcuaauuuuuuuuuuguauuuuuaguacagacuggguuucaccguguuggucaggguggucucgagcuccagggcucaaauaaucuacccgcuucggccucccaacguguugggauuacaggcgugagccaucgcgcccggccccaagaucuuuuaagaccgcagcuccagccucuccucccagcgagguggucccugccacuucgacccgcuuauauccgaacuggaugggaguucug

SEQ ID NO: 12864 - RNA, 17742 nt, Homo sapiens
uugggacuccgcgagagggccuaggauuggagggcccaggcagagcccgcgaggaggugacgcggcugcggaggugacgcgggaggucgcgcgccccuuccggcgcggggagggcgcugaagaucggggccgcucggccgcaggccgccuccagcgccgcgggauguagcgcgggggaccgcggcccccagcagagcccgccugcccggcuguaagucucccaggggcugcgcggugggcagggacucggcgggagcgcggggaccccgggggccccgacccaggccugcggaggagacagcuguugggggaacccgcuccgacuugccagggggcucgggccccagccaaggagccgccuggccuccaggcauccagccggucagguuguaaacauuuccggccccucccacugcgcgccgccuccgaggcggccuaggugcggugggcgcucguccccggcugucccccgacucccggcaguccugugagugcugcgccuuuagccccacgggguggagaugcauggguuccccagaucgggaccagagagccagaguuaagccuggccccgaggccgccgcgcguggggagggagggcugcgggccuaggucgcgaaccgccucucagcggggaacagccgcauuggguugccaggaagcccuaagguuccuccaccaacaaucuuuggcaggucaaguccugacagugcccucacuuugauggggugggaagggagguuggugaucgcucugcaggguuaagguaauccugaaggcugaaaugcggggcagaaucgaagguacuuugggggaaaaugaaauuucauuaccuuagguaucuaggauugauguauucuaucuucuguuugagaauuuuggucuucaagccuucgauuuuuaagaaaauagauaaguguuuuuuuucccucaguuucuggugcucuuugggagaaugggaaacugacaaggccaauuucaguuuacaccguuucagaugucaaaggagcgcuaggaggccaugguacuuuacuagauuaaccauaguacuucccucaagugauucagaagacgggcuagaaaauacagcggagaauacauaggcugccaucuacaaaacaaaugauuguaauggcugguucuuuucugaaaugaaguaauaguggggucgguucacugcuuuucucuuuuccuaguaguuggguaggcuacgauggugcaacuucgguuccugagguuguauacuaucuguauacugccaggaauuuaggguggugcuaaacagauugcaaugucaggguaccggcuugcagcuacuaaauguauuuacuccaggaauaacuuuuauguacccauauugugauuugcacuugggaaaucagucauaaaaacugauguuaccugugaaggcccauguuaugguagaccuccgcaaaacuauaccuaauuguagaguagaaacugaaagcuuucuauucucaauggucaagacuuugccugcagguaggagagaaucucagaaaaauaacagggagcaacauuaauccacugauccccauugcugauuuauaaaguacaccaccuuaaguaggcuuuuaggcuauuuucaguuuuuuaagucuggccucauuuuaccuuuccaggacucuauggaaaaaugaauuguuuacugcccuggggacuguguucuuucauggcauguucacaccauauacccuccuggaaugcccuguuuccaucucuaucuaucaaucuccugucauaaaaucuuccacaaaacuuuuucugaucacuucaacuaaaguugcacuuuucuuuugaauuccuccugcacauaauggcacuaagccuuguagugauauuaggaaaguuauuucccccauuuagaggccaacaaccauuucaacccucugacuccucuuugccuugucucuguggccacaacaccaugcguauuguaaguaaucaaucgguauucucagauuaaugaagguuagaaauugcccuucuuucuaggccaguguauuuguucucuauucccauaggaaauuuccuuugacuucuaauacaaagccaaacugaaacccuuuaacacuccugcuacauuauccugucccaucuacuuauuaucacacagguaagauaagcagucgucuuuauaucuagacgcuuugugaauuauggugaguuuuuuuucuuggaccaguacucaucaacguuguuauguccauuugucccuaaugucaccuccuggauuuuguuccucucaccaugcuaaaaguugauucccauuuuccugcucagaaauguugggggcauaggccgggcacaguggcucaugccucuaaucccaacacuuugggaggcugaggcgaguggaucaccugaggucaggaguucgagaccaaccuggucaacauggcaaaacccugucucuacuaaaaauacaaaaauuauccggaugugguggcaggugccuguaaucccagcuacuugggaggcugaggcaagagaauugcuugaaccuggaaggcggagguugcagugagcagaucaugccacugcacuccacccugggggauagagcaaggcccuugucuccaaaaauaaaagugggggcuggcauuggcugggcacgguggcucacaccuguaaucccagcacuuugggaggcugaugcaggagaauugcuugaguccaggaguauaggcugcaguaagcuaugaucgugccacacacucuagccugggccuggaacuggcugaacuugggagcaagacccugacuccaaaaagaaaaaaugggcuggcauuaaaauccuucauaugccuguauacuguucacuuuuuuuuuugucaugacauuagcaaaguuugccugucugucagggcucaaaaacaccucuucagccaggcacaguggcucauaccuguaaucccagcacuuugggaugccaaggcugggcaacauagugagaccuugucucuacaaaaaaauaaaauuagcugggcaugguggcacaugccuguagucccgguuacuaagacuugggaagcuaaggugggaggaucgcuugagucuggcacauugaggcuacagugagcugagaucacaccacugcacuccagccugaaugacagagcaagacccuuuuaaaaaaaaaaaaagacuucuguuggggaagagcuacaaaggaagucagacuguuuuuccacuucagagucugggacgcuuggcaucgaguaggagagcugaggcccuauauacuguaguucggugauuucaaacaugugccuuugcuuugauucauauuucuccaacaaagcugugaaauuauccugccuaagagacaguagauaggggaaaaauggcuguauucuuuaucuauacugcuagacuggucuugcuuuaggacaagaaucaagcuagguauggauagaggcuacccauagacucucuaaaggcccaggaacuaaacucuuagaaacuuugugucuuugccuccaggaaaggugugccguagccuggaaaacuugggaauugguucacaauauaaaugucuccaaaaacuauaagugaaauaacucuccagcuaacuggcuggugauuaaaaaucaaucuuuuccccauguuuggcacaggauuaucuuauuuauaggaguacaaacaaccucccugcuccacagcuuuacucucuaauauccuagguuuacccaguuggaaagcuuagugguaaagguuuauuagcuugaguugaagaaaucucaucaaaaaugcacucagucgaguuuggcucaaauauaauuugcaguauuggguguggcaagcuugaggggaaaggcauuuccucuaaaauacguaaggacauagaaagcuggcagaagguuggcucaccuaggaucguucuaacaccuuagggguuuguucugauuuuacaccauagacuaaaacacacuuguaauucuccauuguuugugagugauccaccccauagaagugguauuuucagauccuaguauuauuugcucuucuuucuugccagacguccgaucccuaucucucccuuuccugucucuguguuacuacaguuuagaagaccaaacuggacaauggacuuugcucacuaugaugacaugaucuccauugaccuccauuguauguacuuuaaugcaugaugauauauuuuguaugaugaguuguagcugauggcugguuugugaguuaacuggggucucagguuuuggugacucugggucuagaagauguagagaggugguauaggagcuagugauagaggagcuagagggaaucggaagaacuaauaguaaaugauuuggacugaaaaaggaaaagacuuugaugauagccagaagacuugagggcauaaaaacuuuucagaucaaaugaugaaauuaguaagaaugccaaucuggauucugcacaugaucuuuggacccuaauugcccaacuuaaauuuucucuauauuauucucauugccucuaguaaaauaguuacauagcacucaaaguuacuaaauuuagugugugaccauucuaguugagggguucucucccuccacugcccuccuggagcaaucaaauuguaucacuuauuuuugugcauaucacaaacuaccuauguuaucuggcucuuugaaaacaauacuauaacuuguucaacuuguauuuugcacagugucuuguauuuugcacagugucuuagaaugccuuagggugcuaguccuaaauacacuugcuaaauauucaaugaauguguugacuuacucuggggaaagggauaagagaagccaccacaagcacaagaaaaugcacauaagcccuuaucuaaguggcuagaagcuaagucauaugcuggcaagcuggaaucugccccauucauucauucauuuugaaauggguucuaacuaaaauaaaguauauuuauuauuuuaugauccauguauugcaucucagaaccagaauuuuguuuuguuuuguuuuguuucugcccugguagccugaucuaaguuacuuccaacaguaacuuaguaaguaacaagcuaagugugccccucuuuucagauuuaucuaagaugcccaaaaauauuuauguuuuuugcuugugauauaaaguuguuuuuugguuuuuuuuuuuuugcuugcgauauaaaguauuuuuuaguaaagcugcugauucaguaguacuucacuuugaggaaauauguuuugaggucagccuauugagaaagauuuccuugugucccucucacacggguugcccauccucgagguuuucauaggcuuccagcuuccuguucuccuuagcucaauuguucacuaugacugugugcuggcaucucgucagagucuugcacauuuaaaggaagaggaacugucuauguguugacaccauauaaaggucugcuguauagcaaguuauuguuuuugucucucuuggacuagauugccgguugcuuucaacugugcuuguggguugagcauagcaugacucaugacuguuuagaagcuugaggauugcccuuaccugauguguuaguaaguguucuccagaaagcaccaauaggauacauacauauggauagagaugggauuuauucggggaauuggcucaugagauuauggaggcuaagucccacacuaugccaucucaagcuagacaaugaggaaaguccauaacugguucaguuuaaggcugaaggccugagaacccaaggggcuauuggugcacgucccggaaucccaaggcaggagaaccuggaguuucugauguccaagggcaggaaaagaagggugucccagcuccaggagggaaggagggggagagacagagagaguuagggagucagagaaagagauuuauaaucccugagaaggaauugugauuacucuuagauaaaaaagaacugacacaagauaucaaagauauuuguauauagugaauagccauggaugauauagugucucccucaggagcaaaguuauguuuacugcccaauauaaaagauuggggcucccuaagcuuaaguuuccucucccggaaugcaacccacuccaugugcaguuguuaccuggcccucccugcauugcaaugugguuauuuggguuuggguggggcuuggguaaccaaugcaagaaaaugcuaauauucuggcuacugcuauugcuauaacuaauaaaguccuuuguauggggguagagguggggagagaacuaauaauuuacagcauaguggaaaucuuuggaaacuuucucccucuuucccucuuuuuuuauuugcauuucccugaggccuguuuaaagacuacugugaaaauccaacccaggaaaaccuaaagugucugagauuuuuccuagaaaauggaauucuggguuuuucugauuuugugugugccugucucuaguuucugaaauacucauuugaguagggcuuagauuauggguuguggugguugaaacaaguuauuguggagcugguuauuagguauguguguggcaaaggguaaauuggggcugccuccuugucuucaccuuccugcuuccagguaaguucuugcuugcuugcaggacagauugugaugaaagcuuguuaucccaggguugaacucaggcuauaauccuguaauagaauuaguagacuucgcagagaaauuaaccacuaggcaucugucccacaaccaaguuccuuuuguauguaugacacauuuaucagagcauuuguagauaaggucuaacugaguucaguuggcauuuaauucauuucuaagccuggaugaucuuguaguaauugcagccagauguuggcuuuauauuuuuauuccucggucucagagcuaggccuuucuugggcagagugagcuuugggagugauagaugagauucuucucacuaaaugguuccauaccugugggagggaguugaggguggguagcuguuuuucuauggugacaguuuggugcaguaaccauagaucauaugaaagcaagcaacuagguguuacauuuucagccuuaccuauaagauuagugagguucuggguaaagguugacauuaaagagggaggacaggaauagauuucauuuaagcaauuaacuggccuuuagaauuggggacaggauaugaguugauuagcuucuuauucaguauuagaguauagaaaugaaacuguaagaggaauaaauugucaauccuucauguuuguauuuucuuuuagugucuaccaucagagggagaucucugcccccuggggcugagagaccccaaccuuuccccaagcugaagcugcaggguauugagguaccagccagaugucuucccacaaaggaucugugguggcacaggggaauggggcuccugccaguaacagggaagcugacacgguggaacuggcugaacugggaccccugcuagaagagaagggcaaacggguaaucgccaacccacccaaaguaagucaucuucccaggagucauccccuuguucaguuucucuccuuagaacucugucauuuucucuuuuuuaagagcucaccguccaaaaggaggaacauugcauccuggaaaugucucuauccaagucccuaugauacuguuauaaacaucuuguugucugcuuuccccauuguaagcuuuugggaaugcacucaucuuuguaacaccagugcuuagcacaaggccugcaguccaauaaauaaucaguaaauaucugaaugaaugaaggaagcagucaauuaggauuagguuugacuucauauaacacacaaaaauccuuacaguuuugacaggacagaagucucucaagcaaaagaauuucagaaguaaccaauccagggcugauauggaggauccaccacugucaggcaccuguguugcucucccaucacucuuaauaugugcccaucauacccacauucuaccccccaugaaagggaaacgagaagaaaggcccucucuuucccuuuuauuuuuauugagauaagaucucgccauguugccuaggcugaucuuaaacuccuaggcucaagugauccuccugccucagccucccaaaguguuggaauuacagguaugagccacugugcccggccaacucuuugccuuuuaaagggacuaucagggccgggcacgguggcucacaccuguaaucccaacacuuugagaggccgaggcagguggaucaccugagaucaggaguucgagaccagccuggccaacauagugaagcccccucucuacuaaaaacacaaaaauuagcugggugugguggcagucgccuguaaucccagcuacucgggaggcugaggcaggagaaucgcuugaaucugggaggcagagguugcagugagccgagaucgugccauugcacuccagccugggcaacgagugaaacccccucucagaaaaaacaaaaauaaauaaagggacuaucaggaaguaccucauaagacuucggccagaacuuacuuacauaacuauauucagcugcaguggagguuagaaagugcagccugaguaaaauugcaguaacauugccacccugaacaaaaccgugggcuuuguuacuuaggaagagagagaauggauguuaggguagacuggcuggaagcuguagcacaaaaucuaagauggaccauguguuuacuagugaccaucagcaacaggagagaaauagcccagaaaaggaguugaacugccaggcuuucuauagccaugauucggagccuugggauagagagagagaaaguucucucccuuucacaggcaagugcucuccuggguguguuuuuuuuuuuuuuuuuuggagacagagucucgcugucgcccuggcuggagugcaguggcacguucucggcucacugcaggcuccgcccuccaggguucaugccauucuccugccucagccucccgaguagcugggacuacaggugcccgccaccucgcccggcuaauuuuuuguauuuuuaguagagacaggguuucaccguguuagccaggauggucucgaucuccugaccucgugauccgcccgccucggccucccaaagugcugggauuacaggcgugagccaccgcgcccggcccucugggugcgcuuuuuuaggcccuggagucaguaccgcuguuuuccauggaaccaguucugaggcccugguacuccugggagcugcuguagauacaaaguuucaaucaugacagcaucccuagagucagugaacagggaacucugaacagaauuauuguuauggaacucucugagacucugugucuuuuucguuguuuugaaaacguaggcugggcaugguggcucagccuguaaucccagcacuuugggaggccgaggcaggaggaucacgugaggucaggagauugagaacagccuggccaacauggugaaaccccaucucuacuaaaaauacaaaaauuagucaggcaugguggugggcgccuguaaucccagcuacuuggaggccgaggcaugagaauugcuugaacccgggaggcggagguugcagugaacagagaucgcaccacuguacuccagccugggugacagagggauauuccauuucaaaaaaaaaaaaagaaagaaagaaaauguaauggcuuagaaaagagaacucuuugggaaacugaggaaaguuaagaaccacuauccuaaagaaaaggaugucauucaguaccuagagcugguguauucccccaaugcuagucucugugacaguccuucuuuuacgcacugcauagaauguucacuccagcauuuacgaaguauuaauaaauuucuaacuaguguuguaaacucaguguguaugcuuuuggagaagagaccacaagacccucuguaggaaagaggcugggcagaaggcauuagguuuggguuuuucugggucucucugcucuggaauaguacaauuuaugagaugacucccuggauuguuguggguuuuuucccccauaggcugaagaagagcaaacaugcccagugccccaggaagaagaggaggaggugcggguacugacacuuccccugcaagcccaccacgccauggagaagauggaagaguuuguguacaagguauggccuaugagcuucuguccuggaaggggaagggcagcaggccugucugggauguccccagccagcaagcuugcacugggucgaagagcuuuuauuccugggaaggaguggauuuguuuuuugguuaagaugagguaaaucaaugugaagacuggcuaaauuuuuacugccuacucugugaggcauuguucaaaauauauucuuaaaacggauucuuuucuaugcaaggggcgccuuuggaagucaucaaaauauuucaauaugacaguaauaugaaugccuuuguuaacacauuaaauauacaugaaugaugagcacuaauguauuuuauuaaaauuuguaauuucuaaguaaugaugaauagaaacaguauuuugagauaccugcagaacuaaugugugagaguaucugauuucuauuggugacaaagccacaaguucuacuaauacugugguuuguugcuuaugcuuauaauugaggaaaaugcucaauuuacuuagagguaaauggaaauacaauuuuuuccaucuauucccuggauccuguccauagugcauggauccuagauuaagaaccccuacucuaaaaagaugugguaagaacuuagaaucuaauugggggagggaugagacaugagauagaaucuccuggagaggggcaaaggagggaucuguacguuuuuuaaaacaacguuuauaauuuuuuuguuuuuauucaguauaucaauuuugaaauuucaaguagccuaaaggagguuguaccauauauauauauauauuuuuuugagacagaguuuugcucuugucucccagcugcaguggcacgaucucagcucacugcaaccucugccugccagguucaagcacuucuccugccucagccucccgaguagcugggauuacaggcaugugccaccacgccuggcuuauuuuuguauuuuuaguagagacgggguuucuccauguuggucaggcuagucucgaacucccaaccucaggugauccgcccgccucagccucccaaagugcugggauuacaggcgugaaccacugcgcccagccugguuggaccauauuuucuuaaaagguugagaaacacuuaccuaaaacuucuccagauaaacuaacaugaaacaaagacaaagagauuuuuuguuuguuuguuuuuguuuuuuuguuuuuuuugaauacagagucuugcucggucgcccaggcuggagugcaguggugcaaucucggcucacugcaacccccgcccgccagguucaaaccauucuccugccucagccuccugaguagcugggauuacaggugcccgccaccaugcccggccaauuuuuuguguuuuuaguagagacaggguuucaccauguuagucaggcaggucuugaacuccugaccucaggugauccaccugccucagccucccaaagugcuaagauuacaggcaugagccgcuacacucagccaggauuuuuuuuuuuuuuuuaauggucaaaauaugagucaggacucugcuagccccauucaugcuaugucuuggauaucccccaguccaggcugguucuccacuauuaccuaggaccauucagagccugacugacaucuucuuagacuaguucuccaucacugcuuguccuuggggaagguacuaucuagugcccuacccagagaaaguguauauguucuaggucugggagggacguuggagggucaucccauaugaugugcucccugacuggcuaaaggacaacgacuaucugcuacauggucauagaccucccaugcccuccuuucgggcuugcuucaagagcaucuuccgcauucauacagaaacuggcaacaucuggacccaucugcuuggugagugauuuggauggggaaagguggaauuuguugucucccuaacugcgaagggauuauagagcccaacaaaguuguucagaucgauuggcagcugggauucuaccuuuaaacuacuaaugacuuuaagcuaauaaccuugguugacccuugaucacugaucuuuaagacugagaguaaaaggccuagaaaccaaagaaauugggacuagauauuuuuuugugaucccuggcagaacuguucuagguggagacaauuccuuguacuucguaauuuccaacuguaaaaguaaaaugccaacauuucaaaaaauggucuuuuuugucuggguuucugugaccagugccacuuucuuugaaacauuggacugcaauuacacagcuaaaccucauagcuuucugauuuuuuuuuuauuucaauagcucuuggguuacaaagggguggggggggguuugguuacauggaugaauuauauacuggugaauucugagauuuuaaugcacccaucaccuuaguaguguacauuguacucaauauguaguuuuucugucucacaccccuaucucccccucccgcuucuaagucuccauaguccauuauaucauucuauaugccuuugcguacucauagcuuagcucccacuuauaagugagaacauauacaguauuugauuuuucauuccuaaguuacuucacuuagaauaguggccuucagcuucauccagguugcugcaaaagacauuauugcauuccuuuuuauggcugaguaguauuccaugguguacauacaccacauuuccuuuauucacucauuggucaauggacacuuagguugguuccauaucuuuagaguugugaauugugcuacaauaaacauacaugugcaugugucuuuuucauaugacugcuuuuccuuuggguagacaccugguagugggauugguggaucaaauaguagcucuacuuuuaguucuuuaaggaaucucuauacccuuuuccauagagguuauacuaguuuauaauuuacauucccacaaggaguguauaagcauuccccuuuuaccauauccaugccaacaucuguuguuuuuugacuuuuuaauaauggccuuucuugcagaaguaaggugguauuucauugugcuuuuaauuuguauuucccugaugauuagugauguugccuguagcucucugauucaaaaacaucaaccaucaaaguguacacauucccuuuuuucuuacagguuuuuuuuauuuuacccuccugcagguuucgugcuguuucucuuuuugggaaucuugaccaugcucagaccaaauauguacuucauggccccucuacaggagaaggugguuuuugggauguucuuuuugggugcagugcucugccucagcuucuccuggcucuuucacaccgucuauugucauucagagaaagucucucggacuuuuuccaagugaguuaaaagaacaccauaggaaaauacugugcacuguugucacaucuugagaucccagugcuuacugggugauaggagcucauaucacuccuaaagguuucuugauaugccagaggaaaggcucucuguucuguggcgauaguggggugaugaagcuuuucucuuaaacacuucaugaacagacuuacugcauccucuucaacagauggagagaccaauuguggaauauauuuucuaccugaaaagcacuaucuuuugugaggcuuagagugccagugcacuggcugcuuuccaagaccuuguacaagcguaacuuacuauuagcccaagccaaaguagggugugguaaauagucuaugcuucauucugcuggugcuccuacccagcagucaaguaaagcuuaucuuugcugcccaugcauugcuggaagcuccagauguccaucaucgugugcuuucucucuugcccagccgugagccugagguucuauuuguuugcuuguuuuuguuguuauuguugguuuugguggcgacagugguguauuauuuuguuuuuucuaacaacaccaguaagaagguacauuuuccucauuuaaaaagucaacuaagauagaaaaagcuagaguaucccuuaauacuacucccaauuuaagaauuuuguuuuuagaacucauucuaucagaauaggagaauuuucaaagccuuuccugagugugaugcugggaaccagcuggauugugauggaauuucuaaauucaagugucuacuaugggagauacggcuguucacuaguaagggaaagggauagaguucuuugaauggggauucuuagagauuuuuccaucguaaaauagaagugaccuuguggaauuuuaauccagaauacaggauagauuguaugggagucuacaauacaggauagauugagggaaugguuaaaucugggagcagguggagaacagaaagagcuaguuaaaugagccauacaaauucauuucccccacugauuuguuucauuuuugugguucuuuuuagacuggacuauucagggauugcucuucuaauuauggggagcuuuguccccuggcucuauuauuccuucuacugcuccccacagccacggcucaucuaccucuccaucgucuguguccugggcauuucugccaucauuguggcgcagugggaccgguuugccacuccuaagcaccggcagacaagagcagguaggucggaagauguacguacaccucagagguauuuagaccuuaggccugauaggcucaaaccuauuugagccuuaagguuugcagcuugagaaccccacccaaacccugauuuguguuucagaacuuucaaaacagcaucaauuucaaagcucaguucucaacccccagugucauacuauuucaguagaaugccaauaggacagaucauuacccagcuggucaauuaacugcaagcacagauguagcuacucuuauacuugguuugugacaguuuaaaaauguagcaagcacaguaauuuuagugacccgagucccaagcucagaccaagggauuaaaauuaaaacacucagaggcauuuuacuaagggaauggaauaccugguuuggugaaugaaaauaccuugagcauaaacagguaacaaaguaauagcuacaagcauaaacaucuuuguguugucucaucucaucuggacucuuauuuuaagcuuuuauuacuugcagcaacaccaccaauuaccacuagucuuuagucccuuuacaauuaauaucugcuauguuuuaaccuucaguuaaaauaauuaaauauuguccgggagcaguggcucacgccuguaaucccagcacuuuggggggccgaggcaggcggaucacuugaagucaggaguuugagaccagccuggccgacaugguaaaacccuguuuuuauuuaaaauauaaaaauuagucggcguuguggcaggugccuguaauuccagcuacuugagaggcugaggcgggagaaucacuugaaccuggucgggggcagagguuguagugagccaagaucacgccacugcacuccagccugggcaacaaagcaagacucuaucucaaaaaaaaaaaagaaagaaagaaagaaaagaaaaaaauaauaauaauuaaauauuuaucaagcaccagccacgugccaugcacugugcuuaaacaaagguauuuacaaagauggagagguggucccugcccuucaguuauguguaguguaaugaugagacacauacccauucuucccuugcucuugccuuacuugugugucccagcagcuacaggauaacugcuaaucuggguauaucugucuacucaggaggucagaguucugguuauguaagacuuuuaugaucuuaacaggaagccuauccuaugcuucucugacuugggaggcaacugaagccuugacaucuaaguucuguacccaaguuagccaucagagagucuugacauaccauuuuuaccuaaauuccuuaacagauaaugaagaauaugagaucuuuguucuuggugcuuaaaagguaguaagcacuuacacagcuucuucccauucaggacauagaagaaauaucuguugaguguuauccaucuuguagcuaaguuuccuaaacauguacuauucauccaaaaauagcuaauuaucauaaacauugaaauuccagaguaagacagcagugccuuccaugcgguggcuguuuccuuguuugacagucuuaugucuguucuguucaggcguguuccugggacuuggcuugaguggcgucgugcccaccaugcacuuuacuaucgcugagggcuuugucaaggccaccacagugggccagaugggcugguucuuccucauggcugugauguacaucacuggagcuggccuuuaugcugcucgaauuccugagcgcuucuuuccuggaaaauuugacauauggguaagaaaugaaucuuccagcagguccugugauggugagugaacagcccaaaguuaaagggcugaggaaaaggugguaugagacugggaucauauaguguuuggagguacauauaugugcauugaagguaaaucaucaauauuaacauuuugguguaucucugacaaggacuguguuuuuaaaacuuucuaaauauaccacuuuaauguuauuaacaaauuuguuuaauuaaggauaaacuagaagaagcaaaugcuuucuccuacuuguuucuuauuccuccuugcauuauccuaaaggcucuuuucuuuuuauuccuacaguuccagucucaucagauuuuccauguccuggugguggcagcagccuuuguccacuucuauggagucuccaaccuucaggaauuccguuacggccuagaaggcggcuguacugaugacacccuucucugagccuucccaccugcgggguggaggaggaacuucccaagugcuuuuaaaaauaacuucuuugcugaagugagaggaagagucugaguugucuguuucuagaagaaaccucuuagagaauucaguaccaaccaagcuucagcccacuuucacacccacugggcaauaaacuuuccauuuccauucuccuagcuggggauggggcauggucaaacuuagccauccccuccucagcaaggcaucuaccggccccucacagagacaguacuuugaaacucauguugagauuuuacccucuccuccaaccauuuugggaaaauuauggacugggacucuucagaaauucugucuuuucuucuggaagaaaaugucccucccuuacccccauccuuaacuuuguauccuggcuuauaacaggccauccauuuuuguagcacacuuuucaaaaacaauuauauacccuggucccaucuuucuagggccuggaucugcuuauagagcaggaagaauaaagccaccaacuuuuaccuagcccggcuaaucauggaaguguguccaggcuucaaguaacuugaguuuuaauuuuuuuuuuuucuuggcagaguaauguaaaauuuaaauggggaaagauauuuaauauuuaauacuaagcuuuaaaaagaaaccugcuaucauugcuauguaucuugaugcaaagacuaugauguuaauaaaagaaaguacagaagacacuuggcauucaaagauuucacauguauggucuugauuauuugcacacaacuccaaaacauuaaguaagaccugugauaauuucagauucuccugaggcacaaauuugaaucauaggcauugacaggcuggcacaugcaggccaauaaauggaccuaauugaauuccuagcauccauuccccaauacagcuu

SEQ ID NO: 12865 - RNA, 840 nt, Homo sapiens
uauuaacaucauagucuuugcaucaagauacauagcaaugauagcagguuucuuuuuaaagcuuaguauuaaauauuaaauaucuuuccccauuuaaauuuuacauuacucugccaagaaaaaaaaaaaauuaaaacucaaguuacuugaagccuggacacacuuccaugauuagccgggcuagguaaaaguugguggcuuuauucuuccugcucuauaagcagauccaggcccuagaaagaugggaccaggguauauaauuguuuuugaaaagugugcuacaaaaauggauggccuguuauaagccaggauacaaaguuaaggauggggguaagggagggacauuuucuuccagaagaaaagacagaauuucugaagagucccaguccauaauuuucccaaaaugguuggaggagaggguaaaaucucaacaugaguuucaaaguacugucucugugaggggccgguagaugccuugcugaggaggggauggcuaaguuugaccaugccccauccccagcuaggagaauggaaauggaaaguuuauugcccagugggugugaaagugggcugaagcuugguugguacugaauucucuaagagguuucuucuagaaacagacaacucagacucuuccucucacuucagcaaagaaguuauuuuuaaaagcacuugggaaguuccuccuccaccccgcaggugggaaggcucagagaagggugucaucaguacagccgccuucuaggccguaacggaauuccugaagguuggagacuccauagaaguggacaaaggcugcugccaccaccaggacauggaaaaucugaugagacuggaacu

SEQ ID NO: 12866 - RNA, 4557 nt, Homo sapiens
gggugaagaggguggucuaggugggcuauuuaacucaugucaguagcuuguuguuuucaucgggguuuuucuugucccuuuggggugggacagggacggggguggugucucugaagucagcccuccugguuugcauucuggguguacacguguucguguguuugcacacauguaggugugugcacagcauccucacuccuggaggucaaauauuggaaaucugcuguguguuugacaccaaacaucgcccauuaacauguuccugaccucugcccccuacaccccagggcuacacccacccacccacccacaggaauucauugccucucaggcgccucucaagaaaacgcuggagaacuucuggcggcuggugcgggaguagcagguccgcaucaucaucaugcugaccgucggcauggagaacaggagggugaugcgccuuacaggcuccuggaaaggccaccagguggcgcacguucuccuugugggaauggccccguuggcaucuucccgcagggaaggcggggcagacuggagugaggccaaucaggccuggagggugguggaaccaccucccacccagacccaggaugggguggucccugggauggggaggcagugggaggaaccagguauguaagcuccagcuuggcuuaguuucuacgggcuucuugcccugggcagagaaggcaccaagggguagggacugcccagggccggugucaaagguaccaucauggauccuuccuuucgauaagccuggcagaugcagggcccugggacacgcagagaggcugccgagucuguccucuugcuggagcagugagcccagggcugcuggccgcggaauaagggcuguucuguuuggcacagcaagcugguggcugacucagaauccugagggucaugagaggucugagggcaagggugccggagcccaggcaagggagagcagcuccuggaggagggagccuuggagcugggucauuacagagagcagaaucccagcagggugucagggaccagaaaggugggcagggaggggugggacuggguaaagcagggggcagcagugauagggcugggcucacagccacccuuccccucuccaaccuucuggucccaggugcugugugagcauuacuggcugaccgacucuaccccggucacccaugaucacaucaccauccaccuccuagccgaggaggcugacgaugaguggaccaagcgggaauuccagcugcagcacaugcgugccccaaggaugagggggugggacaggcauuagagcugagaccccugagaagguugccucacuuccugggucccuggagcccucucuuucggaggaccacaaguacucagccaccacccagggaaguguguguuagggaagggguagggagguacagagaagguuaagggcuuaucugaggcugcacagugagggaaaggaagagcacgagagacaugaugguuccugaccucccccaugccagcuccgggcuccugccucaccccaugcccccugugcccaacugccuucccagguugugcacuccugggacaggaaagcaagggacccgaaucacuccucugcuugggcacucuauaugcagagauuacccaggaggcuagagaaggacccgagggcucaggaagcauccugaugagagagacauagcugccacgcucaaggaacaguuggucugcaucaucccugcccuuaggcagcuggggaagaaagugugaggucugggccaugggagccuagaguuaggaagauaaggagcagcagcagggccccucugcccccuugcccccuugcccccuugcccccuugcccccuucccacccccuucucagguuguccagcaacagcagcggaggguggaguaacugcaauucaccaccugaccugaccacagcauccucaaggcccccagcucccugcuuaccuuuauggagcugguacaggaacaggcaagggccacccagggcaugggacccauccuggugcacugcaggagggcaggugagugcauaggguggagagcccccugccuggccuggaggugucgggggcucucggacuguggggagagcuggggacaugggcagccucuucacccauucaguuccucaggggcuguccccgcagugugggcaugggccagacgggcaccuucguggcccuguugaggcugcugcagcagcuggaggaggagcagaugguagauguguuccaugcuguguuugcauucuggaugcacgggccccucaugauccagacccuggugagggccucgcaggcugggcugggcagcugggacccugaaggagugggagggagguggguggccacagggcuacaagagggaccaggaaagagagcucauggggcauacagaagacccuggggagaggguuucaaacacaacaccauccuaucugggcugugcucccuauucugugaaaggggaggugggacaggacccugucagcuuugacaccauagagcgguggagggaagguuucucaguggcucccucuccccuccuacccgaucccugccuugcuggucagggccuggaaaaucucccugcaggccccccucgcuccucgcuccucgcuccucgcuccucgcugagcagccugaugcccuucccccuggcagagccaguacgucuuccugcacagcugccuacugaacaagauucuggaagggcccuucaacaucucugaguaagucccagcuucccugugccucccacaggcaggcucccugcuccuguucaugggcagagccgagcagacuagaacagggagcuggggaaccuugagugccuucucccucuccaacccccccaccaggucuuggcccaucucugugaugaacuucgcacaggcgugugccaagagggcagccaaugccaacgcuggcuucuugaaggaguacgagguacacuucaggccaggaagugggugacagccaagggcagccuuccccugcugagccagcccugcagugggaccucccagccucaggguacccaucuccuucccagcucuugcugcaggccaucaaggacgaggcuggcucuuacgcaccccugccuggcuaugagcaggacagccccaucuccugugagucucacuguggacccuguggaggggcagggggccagcaugggcugggggccucuggcagcuucacccucacugucuucccucagaugacuguucucaggggcaguuuucuccaguguaggagagcaccccugacgacaugccugaagccuggcucuucccugugagaugaugcugguuuugccacuguuuccugcccucucugaccaccuguacuucccgggcuggggcugcugggggcucccagaguugugggcugggcaggggacacccucagucucuggaagccaaugagcugugcucugcagggugggcccucuggcugugaucauauggugcugacuggccucgcagggccagaggagcucugggagcugguguggcagcacggggcucaugugcuugucucucugugcccacucgaugccauggagaaggugagagugcagaggacagaggaagggaggcucaggaguuagggcugagguuggaggcggguaguuuguggugcugucuaaccagggcaggggcagagaucucaggaaguugccugagcagcccuaacuuggucccagccacaggaauucuggccaauggagaugcagcccauagucacagacauggugacagugcacuggguggccgagagcagcacagugggcuggcucugugcccucuucagggucacacauguagguguuggggccacagggcaugggguggugugugggagaagaguccugugugggcucccucugcccucuccagcaccaaugccgaucaugucuuugcccgagggggagaguaggaaggaaagggaggugcagagacugcaguuuccauaccuggagccugggcaugagcugcccgccaccacccugcugcccuuccuggcugcugugggccagugcugcucucggggcaacagcaagaagccgggcacacugcucagccacuccagguguugcuggacaauggucuugggggaguggacacuggaagccccucccugccccucuggcauagccucagaucucccugggcccugcuuggguuaugggccaaaaggacacagucucacaaugccccugucuuccccacacccuacccuguccucaggaauauggugggaauuuaccgccucccucccugggcccaggcuggcuggcuggcugaccaaguguucggugucccuucucagucccugcacccagguuggauuuuugcagauccccggacacccccgccacauccccggacaccccugccacacccccuuuagguaccucauccaacucuaggucaguugcagcaagggugcgacccagcugggcaccuuccuggccauggagcagcugcugcagcaggcagggucugagugcaccguggaugucuuuaacguggccc

SEQ ID NO: 12867 - RNA, 21546 nt, Homo sapiens
cauuccagguaagcagaggaacuggcccacaggcuucuaaaaaauaguagagaaugagaucucauugacacucggaaagauggugguggaugggaaaacacugggucagagucagcuagguaggggcguuuugggaagcaaacccagaauccugggauuuauuccacaagaaugacuucuuuucacuccucucugccucauuuucucccagucuguuuccuuacucucuccucucaccuggacacacagucagacccuuaacuugccuggagagcugccacugcugccgcaccacugccccaagcuaaaacucacagggcaggagcggaggcagcaccccuccuacagccuucugagugaaggcaaccccaguggcccuccuuauuucuuucuuucuuuucuuuucuuuuuuuuuuuuuuugagauggaguuucgcucuuguugcccaggcuggagugcaauggcacgaucucggcucaccgcaaccuccgccugccggguucaagcgauucuccugccucagccucccgaguagcugggauuacaggcacgcgccaccacgcccggcuauuuuguauuuuuaguagagacgggguuucuccauguuggucaggcuggucucgaacuccugaccucaggugauccaccugccucggccucccaaagugcugggauuacaggcgugagccgcugugcccagccgccaguuucugccugggagguaccacuuccaaagaaaaaacgaaaaauguccugucauggaagacacaauccauuagacauacccccacuucuugcugugaccugaaccuugagucacucuauuguugguuugaugaaguccgcguccucugacaguaggauuggucaggacuuuagcagcaccuacuguucgguuggaggcuugcauuuuaaugcggggacuccggagcuaaugguaguuaauaauuccagaguacuuacuaugcaucaggcgauacgcuaagcuuuuaauguuuauuugcucauguaauccucauaaccaucacggaggcagggccuaucacccccacuuuauagauaaaacugaggugcagagaggugaaguaacaugcccguggccucccagcugguuaaugacagagcagggguaggaacccaggcagccugguccuagagccugggugcuuaaguacagugugguugugaucgguaggagaaugugcacgugaauagagcauccaccaacuuggcucugacaacacagugcuaauuuggagcgaaaagcacuuucacggucgaaacggcacagucucuagaugucguuauaacuaggacccugcuggagcgaauaguuacaugggaaaguaauguuaaaugcuggggaaagaguuugggauggagagaggagaaacuugaggucucugggaguugcuuaaaccaguugaccguaaccuggccagagaauucugauagugucuucucuccucccaaacagguuuugaguuugaucgauggcugaauacccccggcuggcccccguaccucccugaucucuccccuggggacucacucaugaagccugcugaagagcuagcccaacugugggcagccgaggagcuggacaugaaggccauugaagccguggccaucucucccuggaagaccuaccagcuggucuacuuccuggauaagauccuccagaaauccccucucccuccugguaagaaaaaauggugaaccagggcuccuugugugcacagcuuuaugucaggggcuagagggaggcucacaaaaaguagugaugcuugccccuagggaacugccacguacacuagggaggcuggcacuccacaaggaaugugccaccgggagguuauggguuaggggacugccacguacacuagggaggcuggcacuccacaaggaaugugccaucgggagguuauggguucuacuuacaagcaccucaaggacaaagucacaaagccuggcauugcucaaguccgaagcuccugcaggcgacucuuguaaggcuuuugugucuauuaagucauuuaauucccacaacuccucugggaaguaggcggugugauguuaauacccaggugacagaaugaacuugagguacaaacaguucgcacagaacccagucauccagagcucucaaccucuaaugcuuuguggcugcucagucaacauaauauucaccaagggguuaaaaaaaaguuagagccaagaugacuuuuagcagaugagugguaggagaaaaaaugggacagauauugggggaauaugucugcuuuaaucuugcucugucgaccaggcuggagugccguggugcuauuggcucacagcaaccuccaccuucugaguucaagugauucuugauucuagcaccucagccuccaaguagcugggauuacaggcgugcgccaccacacccggccaguuuuguuugguauuuuuaguagagaugggguuucgccauauuggccaggcuggucucacauuccugaccucaagugauccgcccaccucagccucccaaaauucuaguauuacaggugugacccaccgugaccagccacaaaccauuucuuucucuucuccagggaaugugaaaaaacuuggagacacauacccaaguaucucaaaugcccggaaugcagagcuccggcugcgauggggccaaaucguccuuaagaacgaccaccaggaagauuucuggaaagugaaggaguuccugcauaaccaggugggugaccccugccucgcuguucccgaaagcacacugggacccacucggccauaugugaaguaaucaugugggcagggcucaucuaggacucaucugaggcacagagggaggggcaaaugaccugaggacccuaccacucagccucuuuacuaguguggcuuugaaggcauugcccuagggacaagaggaggccugcaggcuugcagugcuuucugcaauucagcuggugagaccccagggaaaaaagcuggccagagccaacgcagaggcgggaaagagggugacagugucaugugggaaacacaagagggaaaggggccagaggcggagcaagaggaacaaaggcuuggaggauaggucccugcugcccugugacuugggcaugaucgggacagcagccagacccucugucacuaugugaaaguugcccuguuggggaaaggccccgggcucucaggaugaacugaaugucaucagauuccggagcagggaggggcuggaccggagacgaagcauugcucugcauaaagucagggcugccugccuguucggggauauucugagcccuuugauggcuuccucaaggcucuggauuuuaggaacuugugaugucgcuggcuuauauuugugugaauuugaccuguggguugaccuguggguuuuccuuugcuugacugcagcuggaccguaugcggcugugagcuuuaugugccgcagcugcugauaucugcuauucacgugguggcucaccaccuacaccuuuccagaagucuggaaucccauuguguccacccaacucauucauuuuguugacuguagacguccccauguuaguauggauugggacgcguauugagauccaucuccauggaucucuggcgcccaagaagaugccugaauuagagcacuucugaugagaagcuccucauuccagcugugaugcccacaucccuuuuagcaccuagccauggcugcuguuagacuggcacugggggcagcagggcuggacagauccaccaggcaagcuucuuaggcauguguauguguguuucuugcaggggaagcagaaguauacacuuccgcuguaccacgcaaugauggguggcagugagguggcccagacccucgccaaggagacuuuugcauccaccgccucccagcuccacagcaauguugucaacuauguccagcagaucguggcacccaagggcaguuagaggcucgugugcauggccccugccucuucaggcucuccaggcuuucagaauaauuguuuguucccaaauuccuguucccugaucaacuuccuggaguuuauauccccucaggauaaucuauucucuagcuuagguaucugugacucuugggccucugcucuggugggaacuuacuucucuauagcccacugagccccgagacagagaaccugcccacagcucuccccgcuacaggcugcaggcacugcagggcagcggguauucuccuccccaccuaagucucugggaagaaguggagaggacugaugcucuucuuuuuucucuuucuguccuuuuucuugcugauuuuaugcaaagggcuggcauucugauuguucuuuuuucagguuuaauccuuauuuuaauaaaguuuucaagcaaaaauuaaguuacggauugagugacuauuaaauuucuuccaccagagguccucacuguguuuguucaggaaaggucacugggggaggcccagagaaugacaguauuuuccuguccucagggaacagccagggugaaggagguggguguccuacacaugcauaugaaaaaaaauauggcaaaauggcacagcuggugcaggaaaaugaaaaaggaauagcauuccaguucuccgugaagcagcugaauucucuaucugcagcagcauucccauuaucuuuuccaucacuaagaaaaaaaaaugggcugggcacgguggcucaugccuguaaucccagcacuuugggaggcugaggcgagaggaucgcuugagcccaggaguuugagaccacccuggccaacauagcaggacuucaucucuaccaaaaaaaaaaaaaaaaaaaaaaaaaagccaggcgugguggcucacgccuguaaucucaacacuuugggaggcugaggcaggcaaaucacuugaggucagaaguuugagaccagcauggccaacauggugaaaccccaucucuacugaaaaaaaagauagaugcaaaaauuagccaggcaugguggcucacaccuguaguuccaguuacuugggaggcugaagcaggagaaacacuugaaccugggagguggagguugcaguaaacugagaucaugccacugcacuccagccugggugacagaguaagacuucucaaaaaaaaaaaaaaaaagcugggcgugguggugcauuccugugguuucagcuacucaggaggcugaggcaggaggaucacuugagcccaagaggucaaggccacagugagucuugauugugccacugaacuccagccugagugacagagugagacccugucucaaaaauaaaaauaaagugucuuaugacuuuuuaucuacccuucugcccaugcccaaggcuucacugggccucaccugucuuugauccuagauaacuauuugaaugguaaucaguaaagucuuuagaacuuagcacuaaauucugauuuccuggccucaacauggggaccuaaacaguuagcaaucuggguuugggagugggaugaggggaggguuggaagaaauauuuaguguguuucauuugccuuucuuaaauacagggcaccccugaaacaggcuuuguucgcagcucugcucuguccucggauuuagguuaucgaacaggcuuccucccuccccugcacaaggguugggaaugagucgauuugcuuucacucagcaagagcaagggacuaguggugaccaagugguagacuggagaggccucugccccguggcacacagcuccaccaucagagagggugaugugggucauaggugagggaucuggaggcccgguaucggaagagcuucuccaggcacuggcauuuugacagcaaacugcuuccguggcucuuucaggacuguuccuggcaauauguuauuggcaaggacuauuuuagggcuauccaguugucucccccucuccccaaccuuuuaucuagcuuaucaguagcuaucuuuccuugcucuguacaaaaaccuauagcaccaauaggcccaguaaucaugaagggucagugcaaggaaaggcuggaagcccuuccucuaacagccgugcugugacuccacuaacuuuguggggucucccauuacauagcguggguauccugagcugugcagccugccucacucaccaccuugguaccugacaggacuacuggaugugccuguccuuuuguaggacauucucccaucccaaagaugaggcugugcugccgugugggcaagcucuguggggagaggggaggccaguggguuguuuuugccaucacagaauacugggaagccccuggcauccugcuccauagcucucuucaccacuauccuggaaccuucuccccacccccauccccaugccuccaaggcacugaccucaaauccaagucuuucucacuuaucucaagcugccagccuguagggauuccuuaucucagcuccaugucagcggugaggaagccccaagaaggcaagggagcugacagccuucucauuuuucucguacauccuccuguucaccccgccaucccgggagccccagccagaugcucuucagggcagggagcacgugagcagcccuggggcuagaagccgguucucccacauuccugggugagggacuggguggagggugugccugccucaggcuccuugggggaggcccccugaagggcuggggaaaauccuacugagccccaggcucuccugccugcacuggcccagugcgggggcgggggggcggggggauccuggacauuaacucucuccuaggcaccugggagcuucagagaggaagaagguaagguaagaagcagauucucugcgcaggacuuucuuaguccucaggcuauagaguuaaagaaagaaguaucuguagaagguggagucaccuuuuguuugaguaaccguuucacccacccuggcugaggguggccaggaacuccccaaguugugcauuaauggaggggggucacacagauccuacauuuuuuuguuuuuguuuuuuuuuuuuugagacgcagugauuacaggugugagccaccggauccuacauuucaaaugcauaaaaaucuagauaugggcugggcgcaguagcucaugccuguaaucccagcacuuugggaggcugaggcaggcagaucaugaggucaggagaucgaguccauccuggcuaacauggugaaaccccgucucuacuaaaaauacagaaagccgggcauggcagcgggcgccuguaaucccagcuacucggaaagcugaggcaggagaaucgcuugaacccaggagucagagguugcagugagcagagaucacgccacugcacuccaaccugggcgacagagcgagacuccaccucaaaacaaaauaaacaaaauacuagaucuggaagagaucuuagggauuauuaaauucagacaaccucauuuuuuauagauggggaaacaagcacagacuccaagggucucauccaagaucacacaguugcagaugcuggcuacaagucuccugccucaaccaccuguauuaccccauucagggucucaagaagggucuauaagacacuauccauuguguuucgggcugaguccauagagacaaccacagacaugggggacucugcccacagggaaggcaagggcucuggccauggagcuggaugggaagacucugaagcccgaagacauugaauccugugcagggaaagagcgaggguuuuguguacaacacaccugcauaccuggaugugaaucucagcuccaccccuucaccaacucuguguggccugggcaagccauucuaagggaacccuccacacugcaacuuucaugucuauaaaaugggaauaaccaugcauuccuuacaggacuuuuuuggugugaggauuaaaugagagaauauguugaaaagugcuugguaaauauauuaauacuaugcauucccucuucuuugaaugacgugacccagguagucaggcuucugaccacuagagggcagcagaagguacuggaaaacugggccgagugaaccagagauuagaugggguccagagagcagggaugaacuuacccguguggauucuggcaacuccggcagggagggcuccagcaggcgcugagggaagaacuuucaagcagagccgggucucuucaggagcgacugcagcaacccugaugcuuggauggaguccaggcaggugaugguagugaagaccuugccaacagagugggcgcuggagaaggagcccuuuaguggggacccuggggccacgacuaggcuggcaggcccagccagcaccaauuaauccaugaguauugcccagcauugagccuggagcaccuuccagccccuggccagaguccuggguguucugggaaaaaccccuaaaccuaguaacuccucucccuacuaggccucuuuguugcugaaucucuggaauuuaggggccagcagcuuucugacucaggucagccagggguucauguucccucacuugcccucccccugccuggcccaucucuggccuggccccugggaggaauuuccugggccagagggcagccgaaagcacagaugcccaccccagcaacguucccgccaccugcccaggccagugccccgugcccaaccccagagggugcgggaugacagacucugacaaucauuaaaccagccgggccugauuucccagcacugccugcuaagauccgggccaaguggcacugaauaugcaaaucaccuggggccaggagcccagucuaaaggccaggaaauccccuccauccaaugagacaccagcucagguuacugcaggggacacacuauaaagcccugagcucagggaggagcucccuccaggcucuauuuagagccggguaggggagcgcagcggccagauaccucagcgcuaccuggcggaacuggauuucucucccgccugccggccugccugccacagccggacuccgccacuccgguaggauuccccgccugucauucccuagcccagcucuugggaaacugcagagggguccagaggauuugcaguucugaaccugcacacuccagucuaggaucuccgagcaagagcguagguguccugagggucaaagaacagagagagauugucucugggaaggcagaauggccaugacgccgcuagucuggcuccagggccccagagaucugaggagggaagcccagcuggaggcuccugugguccugcccuggucugagaucuuggagcccuucuugaagagacgguguccgcagaguugcugaucuuccugccccugggggcuacucuugcccaggguugggcaaagcagaguagcugggaguguaaggagaggacccucguccccucaccaaccucauccucucucccccuacccacagguagccucauggcugcaaccugugagauuagcaacauuuuuagcaacuacuucagugcgauguacagcucggaggacuccacccuggccucuguucccccugcugccaccuuuggggccgaugacuugguacugacccugagcaacccccagaugucauuggaggguacaggugggucucagcggggugggauggggcacggagugggagacagauccaucuaagggccuguuagacaaaugggggaauaggcagggaggagggucucuaggcaaauuccagggcuagaggcugagacuuagugacugaggugcuggggguuguggggcugugacaggcagagggaggugucagauaccaggacaaggguguugugaaugcuaccuccugccccuacucuugggauggcuccaagggcugaggugugaauccccagugugcuccaggaauggggcugugugggcugggagugguggcucacgccuguaaucccagcacuuugggaggcugagcugagcggaucaccugaggucaagaguucgagaccagccuagccaacauggugaaaccccgucucuacuaaaaauacaaaaaaaaauuuaucccagcgugguggugggcaccuauaaucccagcuacuggggaggcugacgcaggaguaucgcuugaaccugggagguggagguugcugugagccgagauugugccauugcaccccagccuaggugacaggagugagacuccaucucaaaaaaaaaaaaaaaaauggggcuguaaggucugcuggguggccugagcugagccuguuucccugccuggcccuugcagagaaggccagcugguugggggaacagccccaguucuggucgaagacgcagguucuggacuggaucagcuaccaaguggagaagaacaaguacgacgcaagcgccauugacuucucacgaugugacauggauggcgccacccucugcaauugugcccuugaggagcugcgucuggucuuugggccucugggggaccaacuccaugcccagcugcgagaccucagugaguccaggccccuggaggcuggggagcagcuccacauguugagcugagucgaguucaguguggccguaggcaggcccuggagcucugggccagcugcacagccagagagagcccuugagggagggauuaggggagugugacccuuccuuccuuccuugucagcuuccagcucuucugaugagcucaguuggaucauugagcugcuggagaaggauggcauggccuuccaggaggcccuagacccagggcccuuuggugagaacccguuuucuccuuccuuccccagccugucuugucccaucccugccccuccacagagugcuagagaugacccccuccccagacuucuuccucccucaauuagaaaaauugcagcaggucaucagacccaugggcagcaucaccuguccuggucugguccccugagcccucucugaguucucaccuccucuucccagaccagggcagccccuuugcccaggagcugcuggacgacggucagcaagccagccccuaccaccccggcagcuguggcgcaggagcccccuccccuggcagcucugacgucuccaccgcaggugagagcucucucugggccacaaccucccuuccccgaagugucccuuguucccucuggcucccagcaccauaacucaggccuucuggcaggaacaggaacaggcugggaaguguguccugagagccagcagcgugguugagcagagggugggccggcaggggacuuacucugaccccgccccccagggacuggugcuucucggagcucccacuccucagacuccgguggaagugacguggaccuggaucccacugauggcaagcucuuccccagcggugagucgagggagguccccaagagggcgucccauuuagcaaugcacagggggcccggcucuuccugcagccuuuuccuguagaggggcuacucucccuaacuccccucuugccccuccuugaccuuccaccaccguccccacagaugguuuucgugacugcaagaagggggaucccaagcacgggaagcggaaacgaggccggccccgaaagcugagcaaagaguacugggacugucucgagggcaagaagagcaagcacggugagcuccgggggcacguggguccucccugcgccgggcugagcggcuuccuggggcacugcggguuguugcagguaucccuucucccguuuucucuggccuccgcauggccuuugguaaggcugugcacaagcugggggcucuaugguaucggucaccaccuaauugcagagccuggcuuggugguccuggagaggaggaggaaauaaggcucccagugggaggcucaugguaccagaguccuguccacugacuccaguguccuguccacugacuccaguucucucugcacuuggccacuguccugcccucugggacacccucaaugugaggaggcagcuggugggucuuaggugggcugaggagaaaagcagucacugcaguacccgcacagagggcacugcggggucucuggagaggcuugcugcaugcuguggccaagucagcagugcacuggggcgggcagggcuggcuggccuugggugagaggggacaccuggauggcaaacugauggaggcuggccuugcagcgcccagaggcacccaccugugggaguucauccgggacauccucauccacccggagcucaacgagggccucaugaagugggagaaucggcaugaaggcgucuucaaguuccugcgcuccgaggcuguggcccaacuauggggccaaaagaaaaagaacagcaacaugaccuacgagaagcugagccgggccaugaggugagcuggcggccaggacccucacgauacagccggacauggggacaggcgcucacacucccaccgcccucuuucuggcugccacuuggcuucuugcaacagggcugaguccuuagagugaggacaacaucuggguuggucuacuucauggauuaaaugacaacauggagaaaguauuagccuggcagacagcagacacagugcacuugagcuagcagcaacauuucuuguaucgccugugaggcuuguccucaggaaggcaccuggagagugggaaagggggcaggagccgugcccacccagggccuggcuuucuccucguugaagcacuuagguuguuuuucucugggccucaguuuccuccuguguccaggaguacacuagaucaucuuaagaucccguccagcccuaaaaucauguacuuacuuuuuuuuucuuuuucuuuuuuaaauagaggcaagggucucuacguuggccaggccggucucaaacuccuggccucaaaugacucuccugccucggccucucaaagugcugggauuacaggugugagccaguaugcuuggccuuuucuuuuuucuucuucuucuuuuuauuuuucgagacagggucucgcucugucacccaggcuagagugcaguggcacaaucuuggcucgcuacaaccucugccugccggguucaagugauucuugugccucagccuccaaguagcugggauuacaggcaccugccaccaugcccagcuaauuuuuguauuuuuaguagagacggggguuucaccauguuggcuaggcuggucucgaacuccugaccucaagugauccgcccgccucagccucccaaagugcuggaauuacaggugugagccaccgugcccagcucccuggccuuaaaagucauguaauuuaaugaucagaccccagucacagccauaggauacaaagaagcaaaggcaaagagcccuguguccugggcacgguuacaggccaguguagggaaagagcuucugcuugccagugugaagaacagaggaguuuaggaagugugagucaggcucagcuuagucaggcagagaccagugggcauggguuaccuggggguaacgcgggccaggugggcgggcuggcagccuggggcccauuuccugccaaagcaccucugaccauccuucucuucacccagguacuacuacaaacgggagauccuggaacggguggauggccggcgacucgucuacaaguuuggcaaaaacucaagcggcuggaaggaggaagagguucuccagagucggaacugaggguuggaacuauacccgggaccaaacucacggaccacucgaggccugcaaaccuuccugggaggacaggcaggccagauggccccuccacuggggaaugcucccagcugugcuguggagagaagcugauguuuugguguauugucagccaucguccugggacucggagacuauggccucgccuccccacccuccucuuggaauuacaagcccugggguuugaagcugacuuuauagcugcaaguguaucuccuuuuaucuggugccuccucaaacccagucucagacacuaaaugcagacaacaccuuccuccugcagacaccuggacugagccaaggaggccuggggaggcccuaggggagcaccgugauggagaggacagagcaggggcuccagcaccuucuuucuggacuggcguucaccucccugcucagugcuugggcuccacgggcaggggucagagcacucccuaauuuaugugcuauauaaauaugucagauguacauagagaucuauuuuuucuaaaacauuccccuccccacuccucucccacagagugcuggacuguuccaggcccuccagugggcugaugcugggacccuuaggauggggcucccagcuccuuucuccugugaauggaggcagagaccuccaauaaagugccuucugggcuuuuucuaaccuuugucuuagcuaccuguguacugaaauuugggccuuuggaucgaauauggucaagagguuggaggggaggaaaaugaaggucuaccaggcugagggugagggcaaaggcugacgaagaggggaguuacagauuuccuguagcaggugugggcuuacagacacauggacugggcugggaggcgagcaaaggaagcagcugagacuguuggagaacgcuuacaagacuucaugcaagcaaggacaugaacucagaacacugaggucagaagcauccugcugucaugacaccgcucgagugaccuugaccuugaccaagucuguccuguuuaggacugauuuuuccuauuaggcuaggguuuggaccugauguucucaagaugucuagaauugcauggcuggccuuguggaauagaugguuuugcauuccagccaagugugcuguaaacuguauaucuguaauaugaaucccagcuuuugagucugacaaaaucagaguuaggaucuuguaaaggaaaaaaaaaaaaaaacaaaacaaaauggagaugaguacuugcugagaaagaaugagggaaggaguuggcauuuguugaaaguguagucuuuuucucuuuuuuuuuuaauugcaacuuuuacuuuagauuuaggaggucgugcgcagguuuguuacauggguauauugugugaugcugagcuugggaugcgaaugauccugucacccagguagugaguauagcacccagugaaacuguagucucaugccaggcacugugcuagcccacucuggcucauuuaauccucuccuaagaagagaggagacacagcguccccauuugacagaugcagaaagagguuccacaggugugccuugauucuguccuaaaaccguuucccggaagcuuuuccuggugugggcgcuucuaaccuaauccucaaucgauuccagaacuauuacucuguuuccacagugauacugugucuagguuuuagggaggacaguucauugauguuacuuaagaaugcuuuccagguggaaaguuccuuaaguuugaggcuucaaauuccauacagcacauuaaaaucccauucaugaguuugaaauacugcucuguugucuuggaaauaccaaucagauuguuggcugaagugauguggauaaagaagggaucuuagaaaaacuaaagcuuguguguggauuucuggaaaugcagcuugcucuggagaagcaaggaaugguggaaaaggagaguggggaaguugauuggagaggaaagugaggucaugagagaaaccagaauccuggagccauuuggaaaaaggcuuuuacuuacauuucccuucugaagugugagccaguuagacaaaggggaugcgggccagggcguaggucuagccucagaagcuggggaagcuuucacagcuacuuagucuaaaaaugaccccauuucuuggaaauuaugcauuagacucuggucuaguuucccuagccacaauaucucgggguccuugcacccuuaaaagaggugacccagcugggcgcgguaguucacgccuguaauccucguacuuugggaagccaaggcgggaggaucacgaggucagaagaucgaggccaucauggccaacacggugaaaccccgucucuacuaaacauacaaaaauuagcugggcaugcuggcacgcgccuguaguccgagcuacucaggaggcugaggcaggagaaucacuugaacccaggaggcggagguugcagugagcuaagaucaugccacugcacuccagccuggugacacagggagacucugucucaaaaaaaagaagagaggugacccaguguggccugaagucaccuagccaagaagugggggaggggccucuagagcccgggacaugcuuguucagccucccuugacucccagccucuucagcuucuaaaggagauccuagcagggaggagggcugggaauauggcgcucagccccuucacccucuucuggagggcugggggcaggugcugcccgcugcgugcugaccuuugcccugccauuugcaguuuaugaggcgcuuuccucaucccauuaucucauuugauccgccccacagcucgcugaggagaccagguguccccauuuuacugacaaggcuaguggugggcugaagucacugacugggugagagcggggccagcucacagcaugccugccuccacgcugcagcucagugagaccaccugggcagguggccucugcagggcagcgccugggacagccuggaagacggcagcucugggagggacgccuuucuccccaacaguucucugcccucucaccccucaggaugcugcagaguccuggcacgggccccugggcuggccuccgugcugcccucucugucgggcaccagucacccuuaccccgacucucaccagcccaggggccuccuagcaggagacggcccggucucucgcccaccagagucugcauccccucagguguguccugggcuggggaguggggguggggaggaagccacagggccgggcuguuuauaucccgcccugccggagcugcuggucaccucuuaucugcuucugugggauugggugugucgcugagcaggucagagggaggucaccccucccgucguguuugggugugccugaggaggggcugggguuggcccccugggacaguuccuggcuuaucccacagccccaccugucccaccaauucuggggaagucuggcuucuccugggggaagugggugaagggguugcauuucugaggagucugguuucaaucugcucucucucucugcuguugucuguuuacacaucucucucucucgccgggcugugagcaccucugggcaagugcuggggcuuacucaccucagcaccuugcacagcgccuggcacagaggaggugcucgauaaauauuugcuaaauggccccgugacucucccugcccuggccacuaccucccccacacaccacacacauucauacacacucaugggaaccaaagucacacacacucacacucacaaagauaaauauucacaagcccucacucacaugccccugcacgcacugcagacgcugccugcucucacacacucgcauggaccguauucacaaccucacacacuugcacacaccagcgcacgcaacacacucccaccucacagucucacauagccacacccaggccugccugcacgacucaccuccucccucgggguccuucuaugaagcauuuccugaccuccucuuuggcccuuuucccccaccagauggguucagcccuugccuccagucaggacaggccugguaauuugcagagcccagugcaaagugaaagccugggcccuuguuaaagaauuauuaggcugggcgcaguggcucaugccaguaaucccacacuuugggaggccgaggcggguggaucgccugaggucaggaguuugagaccagccugaccaacauggcgaaaccccaucucuacuaaaaauacaaaauuagcugggcgugguggugugcgccuguaauccuagcuacucuggagguugaggcagaagaaucgcuugaaccugggaggcggagguugccgugaaccaagaucaugacacugcacucccgccugggcaacaagagagaaacuccaucucaaaaaaaaaaaaaaaaaagaacgauuaaaaauuucaaaauggcaacagcagagaagagcaugaaccaugcgcgaggugcaguccuccaagcgcagggcccugugggaccaccgcacagguugcacucaggaagccaccccugccuccauuugccacuggccuauaagagcuccacugaacuacccaccaugccuucuacuacagauauguuugccacagucacaaaaaaaucaacaaguugucaaguuuuuugcuuuuuguuuuugagacggagucaugcucugucccccaggcuggagugcaguggugccaucucggcucacugaaaccucugccucccggguucacaccauucuccugccucagccuccugaguagcugggacuacaggcgcccaugaccacgcccgacuaauuuuuugcauuuuuaguagagaugggguuucacuguguuagccaggauggucucgauccccugaccucgugaucugccugccuuggccucccaaauguugggauuacaggugugagccacugcgccuggcccaaguugucaaguuuuuaaaaguaggaaaauuuucucagaaaaaaaaccugaauuuguggcuugucuuuuuaaaaaauuggcugggccaggugacucacgccugaaaucgcaacaaggggaggccgaggcaggagaaguacuugagcccaggaguucaagaccagccugggcaacacagggagacccugucucuacaaauaauuuuuuaaaaauuagccaggagugguggugugcaccuguggucccagcuacucaggaggcugaggcaggaggaucaccugagccugagaguucaagacugcaguaaccucugauugcacgauccagccggggcaugauuuguaacuuugagcaaguuaccuuccuuuucugagccucaguuuccucaucuacaaaaugaagauuguucuacuuggagugcuuuguccuacaagucaccagagugagaacuggucucaaaaaaauuuaaaaauaaagauaaaugugaaaaaaagaaucagaaaauuuggcccagcuaggucagcucucccuggaccacaaucugucacaguggagugaggcugcuccauauagucuuugcauguaguuuaccaccaucuccaccaugcaguaccuguguggccccagaagcacuaaguuuucaaccccugguuaaaaacaucuaugcuucucucaccuacugcucccagacuaggagcauguuuuguacccccucuacuuggcaaaaggauggcucguugggcaugucaacaaguaaauuaaugaaguggguugggggggaugggaggaugcucaugaguauggaagcccagccaguuccuucuauuaugagggccugggguggacaccagagccucugauacuuacugggaaguauugaguuuucuuacuuccaaaaccauugacuuuuaacccaauucagugcauggcauagcaugggcccucaugcacacuggacuaucucugcauggucuucugggcuguaaauggcugcuuaacccagaguguccaaagaugccaccacugcccagcagucuugucccauccccucucucugcugagggaggagaguuggcagaacuucauuuguccauguaauagcucugcauauauuucccccucaacccaucucuuuucaggaagaacaagcaccuuaaauuaguccuuacaucggccaagugcaguggcucaugccuguaaucccagcacuuugggagacagaggcaggcggaucaccugaggucgggaguucgagaccagccugaccaacauggaaaaacccugucucuacuaaaaacacaaaauuacccaggcgucguggugcauaccuguagucccagcuacuugggaggcugaggcaggagaaucgcuugaaccugggaggcagagguugcaaugagccgagaucacgccauugcacuccaccugggcaacgagagcgaaauuccgucucaaaaaaaaaaaaaaaaauuuacucccuacaucauaacuaccagugauuuguaggacagagcacucaauguagaacacucuucacuuugcagaugaggaaacugaagcucagaaaagaaagguaacuugcucaaagucacaaaucauguugaauggagccugagcuucauguugacagcugaccgcuuacugaguaucuacuaggugccaggcaaugugucaaguuauugcuuuacauacaucauucauucucucuguguucauuaacugucugcugugugcauggcuccaugcugugugcagaagacccaguagggaagaggucacccagggggaguaggaagccuaggcuauggccuggcacgguggcuuauaccuguaaucccagcacuuugggaggcugaggcggguaaaucaccugagggcaggaauuugagaccagccuggccaacauggcgaaaccccaucucuaguaaaaauacaaaaauuagccgggcgugguggcgggugccuguaaucccagcuacuuuggaggcugaggcaggagaaucacuugaacccgagaggagaagguugcggugagccgagaucacaccacugcacuccagccaggcgacagagugagauuccaucucaaaaaaaaaaaaaaaaaaaaauuccuggugcaguggcucaggcuuguaaucccagcacuuugggaggcugaggcggaugaaucaugaggucagaaguucaaaaccagccuggccaagauggugaaaccgcgucucuacuaaaaauacaaaaaaauuagccggguaugguggcagcugccuguaauaccagcuacucggaaggcugaggcagauaauugcuugaaccugggaggcagagguugcagugagcugagaucaugccacugcacuccagacuggguggcagagugagacuccaucucaaaaaaaaagaaaagaaaagaaagaaagccuaggcuagagccuaggaaauuccaaagacaucuauauaaaccucucaacaagguagaggauaagugccucauuucacagaugagcaaacugaggcuucagagagguuaagaaaagcuuaagcucucagagauaguaguaaguuuaggaaaccggagcuugaacccugccuucuuucuucaauuccacagcugacucugcuuugagaggugcugagcaacacaaaugucuccgcuguaugggugccuaaaaccccaccauuagaugugcaguuugaggaaugcccuauggauauacaaacaugccugggguggaggguggauucaaugagcauugcuuuccagggacccuuggauccugcaggguggauggaaagugaguuuucaguucuucagaaccucacaguggccaacccuugggagcauugcccucucauucuuauccuacgcuccuccuccuccuccuucuucugcuacgugcagggcugggcuggggcaccagcagcagcaauuagcccagcucagccgcccguuacuggaaccugcaugucaacucuggagcugauccaagaaaccacacccaguguccugcaugacucaaccucaccugcccccuccacaccugccagccucagugacccaggccauagugcccaggggaaagucc

SEQ ID NO: 12868 - RNA, 3734 nt, Homo sapiens
cugugugguuacugcccuuugcagggcaucuucauuuggggaaagacaugaaaugcuaauggccaaacccccccucacccccaccaccuucaggccgaacaccgcaguggggggaagaugcguagaggugggggaagaagugugcaaagaaagggccuggaugggugggggucccaaaaggaccuaagcagcaggagacccccaggagugggcuuuaggcccagcagcucccccuucucaaggugaguccagaggccauucuggagugggccuggguaccaggcccuggguacuccuuuugguaccaggcuggccuccugauuccugaggcguuggcucggcaccccaugggggacugcccuccuccaggccuggcacaaagccagggggcuaagagcagucugcaggacagagggcaggaccacagcagggagggggcuccuaugccagcucccccucaugccauaugaggccaggccuguggcucgaagccccugagcugggcauguccugagagucugggaccauccaggggcugcaucuucauccucagcccugcguagccuucugcccuccucccagggcucguccauuccuucagcuccagcgccuccuccacacguccaugccuuccaccuugccacauggagcacagccgugcccccacaagccagagggaacaacgaagcuggcaagaaagaacagcaguuagagcaggggcaacaauggagaaaggaguaucuauuaugagcuugggcauuuuacaccagcacuucccagccuuuuccauaaacauggaaaacauuuuuugcauacguacugugguaaaggaaucugcuuccucccaggcccccaagaccugagggaucaauguggaucaauccucagcacagggggucugccuuauaccccacuucucagcuaaacccuaacuacaaugugggagggcauuaacaggaccaucaaagugggguauggcacuagauggggccccaggcucacuaggacucucuacuguugaagacaucugcaggcggguaaggucgccuaggaggugguaguggggagagaaggaucuagguuuccacuggaaaaauuaaggcuagaaggaaggcuaaauccuuucucagcccuacuccuacuucucacaagaagggaguggcaucuggggaagagggcacagggcugagagccagggcuuccagauucuauuccuggccccuccccugggccuuccugaccacaaauccgccccccacucccugcccuacugcucauagaggauuaagacaucacaaauaacaacucaugaccccauccugcugcacccacccacccugccccagugccccaugcccuccuccagcuucuccuucccuggcccagccaggccugacuggcacucaggggcagguagacagcuaggcccccaccccuuggcaucaguggcccagccucuggcgcaguugccuauccuucagcucccuugcucuccuaacagugagcccuagggcucaaaacccacugucaagaauggggaccaggugugguggcuuacaccuguaaucuuagcacuuugggaggccaaggugggcagauugcuugagcucaggaguucgaaaccagcaugggcaacguggggaaaccccaaaucuacaaaaaaaaaaauuagccaggcaugguggcgugugccuguagucccagcuaccuggaggcugaggugggaggaucgcuugagcccaagagguugaagcuguugaggcugcagugagccaugacuaugcuacugcaccagucugggcgacagguagagauccugucucaaaaauauauauauaggcugggugcaguggcucacaccuguaaucccagcacuuggggaggccgaggcaggcagaucaccugaggucaggaguucaagaccagccuggccaacauggcgaaaccccaucucuacuaaaaauacaaaaauuagcagggugugguggcaggcaccuguaaucccagcuguucuggaagcugaagcaggagauuugcuugagcccaggagguagagguugcaaugagccaagaucacacgacuguacuccagccugggugacacagcgagacucugucucaaacaacaacaacaacaacaacaaaccauacacacacacacacacacacacacacacacacacacacacacauauguagaggaggagcuggaucccucaggcccaguccagccaaggcggcccacugaggccccaccuuccacugaggccccaccuugggagccggacuccuuggcucuauuugcaacccuugauggugccuucgccaucugggagauacugucuuucuacaucaauucaaugcucaaacuuuaugacaagcauucaaccuagagggaaagagggucggccuccacgauccgcguccccacccucgguuguccucagcugccagaaagccgaaguccaggagcccugcucugcguggaaagcagaggcccacagccuggggcaaugugcaggccaaccucccucuacuuccuuccaccugagucagggcugaaccaacuugaaagaaggcucaucucacccagguaucccccucccagggcuuccaucuuccucucacacaccuggaucacauucuggaccggccaaccuggugccucaggggaaaguccggaucugcuggguuggccacuggcccaagccucccaugcccucaguuggccccaggaaccuccccccuaagauguccggcucugaaguagaaugcuaguccucauucucucuguaggggaaagagaagggagggaaggagagaagagggcccagucccccgggggcuuaccugccuugaccucagcacugaggugguggguagcaugaaggaaagauggugcgcccggugguuuaggacacgagggucccggucccgaggcucugccgggcccgcacugucuggauggccugcugguucuugaacuugaccaggccuagggugaucugggcguuccagccgggaucuuccagggggcagcggaagucgaucucgccgcccccuucggucaccagcgugaaguagauguggcgcccggugcucuccacgcacuccacggccuugaugcgggcgaagcugagcuccuugggccggccgcccgugcccuuggccucgaagagcugcagcccgcguucggugaggacgcagcgcuuccgcuuccacagcugcagcagcccgccgcugcgcuucuccagcacgcccuccuugagcacgguagccgucgccgccgccgucaugggcgccccgagguucgcggaaagcuccaggcugcggcgggcgcggcgccccucucggccccgcagcgcaggauucuggcgccccgggcuggcaggccgugcgcgcugcccaccugcgcccugacugcuccgcgcacccacaccgcggcccucagcacccggcugccggugagguggugucggugcccccagcgcgcuccgcgcccaccgccccgcuucagccggcacccgcuccuccgcucuaccccagcuggcccagcccgacccgccucugccagaugccuccgcgccucccuaggccgugagccccaccgcccgcccguucucuugcuccccugggcucugucugcgcgcugggcggcagcucgcgggaugugcccuuacauguuccgccgcucgccuccugcgccgcccgcccgcagcgcauuccuacccugg

SEQ ID NO: 12869 - RNA, 19508 nt, Homo sapiens
agaauuuagaauuauugacauugauaacauacuuuuuauaagcuaugaaacauuaacaguaauuauacaucaguaauugcuaacaugauuauuaaaucacagucaguagaaugagaguaccaacuucucuagucuauuaccaacuaagacaaaggaguuuuccccauuagaauaauuccaaaguggguugccuaugacuuaggaaggaucucuuuuguauuuucuuucucuaggauucuuucucuagauuagaagcuaaaagucaguauuuuauuacuuuauacuauaauaucauaucagaaaagaacauuucuagugacagucaucaucuuagaguucuuaucuuuguauuaccauccuuuguguuauuugccaguuuucacauugaaaaacauucacucuuucaacagauauuuauagaaugcuuacuauguucuaggaacuuggauguguagcugcgaauaagacaaacaauguuauauuauuuuuuauuauuaauuuuuuuuuuuugagacggagucuuucuccauugcccaggcuagagugcagugacacgaucucggcucacugcaaccccugccuccuggcuucaagugauucuucugccucagccuccugaguagcugggauuacaggcgcguaccaccaugcccagcuaauuuuuguauuuuugguagagacgggcuuucaccauauuggccaggcugaucucgaacuucugaccuugugaucuaccugccucggccucccaaagugcugggauuacaggcaugagccaccgcgcccggccuuaucauauuauuuuuaggccuuuagguugauuuugauuguuacuuucacguauacccucugggccccauuuuuucucuguuugagacauaaaacauauuuuauuuucuaauuagaucagagucuguagaaggcuucuuaucuccaagucguuguggcagucgaaauggagaaaaagacugggagaaugcaucaacaacuucuucaguggcuucuggaacagaauauacagguuagugucuauacauuuuuagagaaacauuugaauuuaacacacucauaaauggaggguguacuaaagaaaauuuuauuggcucaccuuugggucuuaaacauaggcaacuaauaaacagugaaugcagguggucacuuucagguaguucaguaaguuucuaaacaaaauuagugaugcuacuuauaucucaucccucuaaccaaugcuggccauuucuguguguaguuuggguccgaagaaguuuuagagaaguucuacauaguuccucaguacugaguaaaggcuagaauccaccaaguccucucccuaauacugggauuccagguauccagaauugugcaccuuuagcaaguauuaagaggcucuaaaagauaagaaugcauugaaucuaggaagguaucuagccucacauaucgccaccaaguccucuucuagcuucuagguaggcaugauuggaauaaaagcaaugaagaauagaauguggguuaaggacacuucuaaauaaaugaagcaggagagaaaucagaagaaaugucagcagcacguugagagguaagauaggaaggcaugggagaacauguauggggaagagcagagggaaaaggagaugccuccaucuauccaugauagaguggaaguggaaacccuagaaaggccuaaggagguuagaacuugcuagagacccacucuguggcuuuuaauacuaccuccuaccgccagucugacagccuuuaaggccugggauuugacaguauuuccauguuacucacucugcuucucuauguuaguucaguugaacaaucugaaaaagaaagcuuuuuuuugccuuuugaaaagacuuaaauuacucauggacccauucuacucuaagcuaaccaguaaccguauagauuuaagaaagaagguuaaauaggcaguaugacaguuauagcaauauuuuauuuuuaguacugcucucacaggguacuccaaaaggccauaggaacauccuccauaucucuggguggauaaaacaauguuuugguuggauugcagccaguaagaggccuuuaagcacagaauuuggucuucuauuacaauauuucagcaguguaggaacaauuacaucauuuuaaaauaguaguauuucugacuuaggaauguuauuuuuauuauuguuguuaaaucccuaccauaggaccaaagcucuacaaagaacccagugcaaaauccaauaagcacauaauacaaaaugcuuuagcucauugcuguuuggcuggaaaaguaaaugaaggucagaagaaaaaaauacuggagguaagcauguuugcaugaaaauuaaauuuggcaaacuguagaagucuuuuauccauucaagagaauguacucucaugggccuagacuuucaacagcauguaaaaagaucuguagcuagauguuuuaauuaucagauuuaguuuauuuucacauuagguucuggaagccugcagauuuuauuaaagacuagcaauaggcuuuaagauuugucauugaaauaauguuauaaaaugugacuaagaaacguaacauaauuauauaaacuuuauucagcaaaauaaaggguuuuuauucguguuguuauguuguuuuuguuuuuuauuuuaaaggaaauggagaaaucagaugccaacaacuucuuaaucuuguuccgggauucaggaugccaguucagaucuuuauacacuuauugcccagaaacugaagaaaucaauaaacugacugggauaggcccuaaaucuaucacuaaaaaaaugauugaaggacuuuacaaauauaauucugacaggaaacaguuuagccacauacccgcuaaaacuuuaucugccaguguugaugcaauuaccauucauagccauuuauggcagaccaaaagaccaguaacacccaaaaaacuuuuacccacuaaggcauagaaguugggaaauacuugcuucagaacauucaugguaaauuugcacuucaucuuuccugccuauagaaaaucuuucuaauugccaacaagacuuuuauuaauuaaaacuggacauuaagcucuguugucaugaacaacuggaauguaaaccacaguauuuuggagugcagaacauucucaauuaagugauaaguccaaaugaugaaggaaauguuuuaauucacaaauggagauuuguauguguuaucagguucaccugcuugauauuagauacauuaaagcacugaauuuucauggauauuaguuggauuuaucauugaaauaugguuaagauuacaaauuauguguuuuauuuguugcuuuuuuuuaaccuuuuaauguauauucuugucuucagaugguuugcuauuuuucucuccuggggguuuauucuaagauaccuuuguauuuuauuucauguggagaucaugaaaguaggaaauauaccuuuagaaguaacucgcaccuuucuuaugauguuaagagaaacacuaguguuuaguuuuacaguaacccucauauuuuaaugguguuacagcauuugcaaaaauuauucugcuaaguauuuacaacucuauuuauuauucacucaaguauuaacauucucuauuaaauaagaggagguguuguaaagagcugcuaguagguucgcuuuaaaccacaugagcuuaaccaagaauauguuaugagaaguugcugauuaaaucagugcuguuuuuacaccacuucuggccaacucagaauaauuuagauuguucuuuuaacaaaaaaggcuuucuaucucuuuuaaaguaagucacuuuauaaguuggcagaagugaaugacacuuugagaguagucuuucaaucugaagauguaagacuuccugaaacaaguucucaagaagucuuuacauuauauuuauaacucauauaaaaauuauauuuagaauuuuuaaacauguacaaagggcuacauuuuaauuuuaaaauagcuucacauuauuuuacuuauauuggguuuuucuucauuuuaauccuuuucaaguggaauggcuuagaauaaguauacacuugaaaucuccucuacaugaucuuuguucuuuaacaguguauaccagaggguuaguuggggaaaaacuucauucucaggaaaagacuugaaugauuaugugacccuguuauauuucaguguugugacaaauguguaaacuagcgggggaagacaguauuguaucauaaaugagaugcguaguuuguuuucuuucaugggaaguagagauaaaaauauauacauuucucuaauugaguuguuuagagaaagaacuaaugucucauaugauguauuuacuuauuuuaaaaaaaagaauaggaaugagaugucccugagcuguacuuuucuauuauuauaaggccuuuaggcaucagugcaucuggguuaucaacauuuucucaaaugcugucaauauuuuacuguaauuuauguucuuauauuuauguauauuuguuaaaacuguaaaaaaauuucacagauuuuuuuccaauaccugugcaagauacauguguagcucaaaacuauuugugaucuacuguuugcauguaagagaccaggauauguaacucuuauauuuuaaguguauacauauuguguauauaacauauggauauuaaaaauggggaauugcacauuuuaccuuuuggacaguaauuucuaucacaguuagaaggaaaugauagucaaauacacguuuagauuaaaacuaguuuaaaaaauuauaaaugaaucuaaucaaaaugugaauaguagucaaaaggauaauuuaauaagcauuuuacguuacuaaauuuguucauuucaauauuaacuaaauuucccucaucaaagcaaucuuugugauauuacuucgcuauuaaauaaagaaaauuggaugcaagacaauggagaaacuuuaaaacuaaacaggaccacccuuuauucuuaaauuuguguguguccaacaguugaauugaaugucuauaaggucuaaagguagaaugugaauauugccacagaguucauugcucucaguauaagauuuuacuuuauuaaugcagaaggaauauggauauauuucuuuaagucugcagauuuuuuuauuauggugcagcuuuuuuuuaauuauguuuuuaaaauuauacaguugaaaaauaugccauuucauaaagucugaggauuuucgucaaccuuacugaaacacacuggugcuuucaucaucagaggucaaauuauuaugauaacuauuccauuaaguuugccaaacauuugucgugguuaccagugcagccugucaaauucugcuauuugacacagcuuuggaaagauuuaguucuugguuuuuccguuuuguauuagaaugacuguuacaguuuuauuuggcuguuuaaagccaaauucagcuauuuaauuaugguuucauggacacuguugagcaauguacaguguauggugugcuuaccuguccacucuagagcauugcuuacagguuuuuuguuuuuuaagaugcugugcuguaaaauacugucauacuugcuauuuccugguacaguguaguuuuuccccuuucauuugaauaaaagcauggcaccaaaugacuccuuuucuguuucuugaauaaaauguaguuuuugguaaaauuauuugaacuugagauaacucauacaguuuuucuauccccuaaccuauguuuaaauuuaauaacuugaauauucauaacaggcaacuugaaauaauuagccuuuuaaaaauacuaacuuagggcaauguuaaaaagucgguaacuuucuaugcuuagcacagacggucuacauaguaugauuuauaaaugugcuuaucuuauguuaaucuugcucauacuaauucacuaucuuuuggugaauugauaguuauauuguaccagaacuagugcucuaugucuuugaaacugaauggccagugaacucacugaucuggaguagccaugagaagcuaguucuugaccauuauuuuguaaguuucacuuugauuuugcugauucuacuuacucagaacagaguaaagaaaaagguguuuuuuaagaaaaaagagaucugauaacaaaacuauaaaauaaucgucaugccuaauuauauaccugaagaaauaucugguuaguagacauaaaugugguuuucuagcuugggaccuuuuugauagguucuguaacuucagagcacagcuauauuuccacaauauuuccaguacuuuaauuuucagaaauaaaaauauuuaacccggccgggcgcgguggcucacgccuguaaucccagcacuuugggaggccgaagugggcggaucacgaggucaggggaucgagaccauccuggcuaacauggugaaaccccgucucuacuaaaaauacaaaaaaaauuagccaggccugguagcgggcaccuguagucacagcuacuugggaggcugagacaggagaauggcaugaacccgggaggcagagcuugcagugagccgagauugcaccacugcacuccagccugggcgacagagcgagacuccgucucaaaaaaaaaaaaaaaaaaaacccuaagacccaggcaacauuagaaaaauguacacaaugccagguauggugguggcucaugccuauaaucccagcacuucgggaggccaaggcaggcagaucacuugaggucaggaguuuugagaccagccuggccaacacggcgaaacccugucucuacuaaaaaauaaaaauuagccaggcaugguggcauacgccuguaaucccagguacucaggaacaugaggcagaaaaauugcuugaacccaggaggcggagguugcugugagccaagaucgcaccucugcaguccagccugggugacagagugaggcugugucucaaaaaaaaaaaaaaaaaaaaaaaaaguguacacaaacccuagagcccccacacaauaagaauguguugccuuaugacugaaauugauacuucuuaacuagggcagaggaaaauauucuguagugaauaggaacaaacaccuuuauuucaugaucugucuacacagaaagaugauaauaaaauucagcaaaggaaauguagcuguaauguuaugaccuaggaauuggcuauuggagaaacacaucuauaaaaugagugugaaauucugucgucccuuagaaguauauagaugcuuaagaaauagguaucuucucaaaagaaacaaaugagauauuaaugauuuugccuaauuugaugggggugggggaaguacacagauugguaugucagaguugcucuucaaauaaggagaucuagaaucuaguuucagucacuuccuuuuugccccugugggcauguaggucuucuagcaacucaaggccacaugcuuagacaacacagauuaguuuuguacauguguuuaaaucacuguggugauaugugucacaacaacagcuaaaaucagauaacuuuauuccaucuacaguggcuuauuuaugucaggaaaauagggggcaauuauuuuccaucaaagaggugaaaagcaaauuaagaaauguuuuaagacccacuaagguuuuuuuuuuuuuuuuuuuuuggggacacauuaagcaaagccaccaugguaccuuaggcuacuaaugcauuugauucuucuuaaccccaaccuguuguuuuaggugauugaaccugugauucagccuucaguagguguuagaggcauccaacacagguggcaaguaucgucuacagcaccucuacuucacaguuacauucagcugcugugauuccuggccgacccuauuauucauacuucaggguuuguguguuuauauagaaaaggaaauguggcucucaacccgagaucgcgcugcugcacuucaaccugggugacagagugagacucagucucaaaaaaaaaaaaaauugcuuuauaauuuaaaagauucuuugcuuugcuuucucuuuuaacuuacugcugccugggaggaggugagcauuuacgucuccauucuacagaugaggaagaugaggcuuuaaaagguuaguagcugucccagggacucaaagcuaguaagugacagcauuacaaguggcaccuaagccuucugguuucaaauccccuuacugugccauaugguacaguuucccacugcguuguacauguuguggaauaagaauaaggcucacagcuguuacuaguuaauaacguauucaccauugguagaaaacucagaacuugugguuaaaguggauuuuguucucuugcccaagacuguuaaccaucaucaacacaacagcuaaaaucagccuguuacgcucaccugcuguuuaauaucuagauucauaaagaugagagaauggaaaaacugcaaaaguggugaaaacaaauucugauaauagguuaaucagaauuaucuaggaaacaguuauuagaugaaaggggcuagguaggucacaaagguaaguucucuuccaucaaggaacucuugaaguggaugccauuagaccuuuacaaacaacggauauaccgugugcuguauuagagguauggaaccgaaaguaaaggacagaugcgcccuugucuugucaacaguaagagccucuuguccaucaagagaauucauguacuuuauaggguacuaacucuacuaaaacuaacucuauaaagaacuuaagacugcucuuccuggggaacuugucuacaggcacucagaaugguccagcauuugacauacugucauaggcuuuccuacaauacagccucuaacaaaacuacgcgaaccccugguaauagaauuguuuaccuuuauaccaagaagguugggaaagcaucaaaaucugcguguggcgugugcccaggcagacuuugaaggguuugugcuguaagaccuaaaguucuuaugagguuguccaaaacaaagaaacaugucagcagggccuauguugguuccaugugugcuaaauguguuugugacaggaucaagcgugcuuuccuuaucaaggagcagaaaauuguugugaaaguguugaaggcacaagcagagucagaaagcuaaauaaaaaaugaagcuuuuuugaguaauaaaaaugaaaagacuugcuguauggaaaaaaaaaaagacuaucuuacguugucagccaacaggauaccacauuaauucuuuaaauacugaauuuugccgggcgcgguggcucacgccuguaaucccagcacuuugggaggcugaggcgggcagaucacgaggucaggagaucgagaccauccugguuaacacggugaaaccccgucucuacuaaaaauacaaaacuuuagccgggugugguggcgggcuccuguaguccuagcuacucaggaggcugaggcagaagaauggcgucaacccaggaggcggagcuugcagcuagcugagaucgcucugcugcacuccagccugggcaacagagcgagacuccaucucuaaaaaaauaaauaaauagugaauuuugaauugcagagacaucaguucuguugauagggccuugagguccucauuuaugaugagaacaaaacuaacuaaacugcauccucuuucuuagccagaggcuaaguacagauauuuuuguauacauuacgaaaugaguuuguacuuggauucuuuauccuuauagucucaacacaaucgguauucaauaaauauucgucaaaugaauacaugaagggaggacuaugcaguccuggcccaaaauucaaaaucaaauucaaaacauguucugauuucuucuaggucacccuucauuucuuacuauagauauuuuugcccccaaaauacaaacccaaaguuggcuuuucugcucugacucccccugguucaugccauuucaaaggacccaggugcagcuugaaaaucugaccuauuggucaccgugacacaaugauguacuguuccuuuuuaccucucuccagcuccucucacaaauuaugggccagucucaaggcucaguuauucauguucugcugucuccacucuuuccaagaagggcuucaauaucagcuuugacugacaccuccauucagaaucuacaucuccagcccugaaagcuuccucugggcccacucaugcaucuaacugccaucucaacauuuucaccugggaguuccaaagucauccucaacuuaaucuguuuaaaaaccaaaagucaaccugauuuuacaacuuccuuauaaaagcaacucuccuuccugaaagccagccaccaagacugaaaggucuuaucccuugucuaacacagaagacagccucaugcacagacagccaccaaauccuaucaaauauuuuuacuuugaaacugcuccucaucccugcugccaccagcuucaaguccaggcaccaaaagcuuaugccuaacugcaagaaccuucaaguggucuuacccuaauucgauuucacccuccaaagugucuugcaaaaucuaacuuucuuagacuuaucuuaaaaguucaacauuguuuuuauuuugaauugcggggaggaugggggugggguguugagguggugguaaucuguucagugcuuggaaccacuaaaggucuugauccuguuuuucaggcggcuccuauacacagaccuuuuucuucagaaaagcugaccugcuucaaucuugauagaagucaggauaucacaaucugccuuauaucaaaguuauuuguacauuauagcuaaucuccaauaauguguaagcuuccuguaaggaugcaccaugucacauucuuuguaucuguuacauuacccaauaacagugcuugccccacaguaagaaggggcuguuuacaaagucaacuggaaucaaaugugauauuaagaauugguuuuggcccgggcgcaguggcucacgccuauaaucccagcacuuugggaggcugagguggacagaucacuugaggucaggaguucaagaccagucuggccagcauggugaagccuugucucuacuaaaaauacaaaaacuagcugggcaugguguugcacgccucuaaucccagcuauucaggaggcugaugcaggagaaucacucgaacccaggaggcagaggcugcaaugagccgagauugcaccacugcacccuagccugggugacagagcaggacuccaucucaaaaaaaaaaaagaauugguuucacugaucaguagcaggaucacagcacuguagagggacccucuaccaaugccaagggaaugcugccaaauuccuccugcaaauacuuggaaauuuacacuaacucucugugaaaucacugaaaaguaauggcaaaucauagguuagaagcuccugugggcagaauaauugcuacaaagagaaaacguuacuuucuuuccaaacaaauucuggggccauuuuuauauuggggaugucccuauugcuugucuuuuaaguuucugaugguuuuuuuuuuaccuuuaaaaaacguucgagcuacaggaaccugcaguggaagaaaggagucucacuuuccuugaaagcuacacucuucuccuccagccuccccucccuucccugacccccucccccauguccccuaagaggcaucaaugauguccgggguagauggggggcccugggacaaucacacagcugcaggccacaaggcuuucacauugagucaucuccuuagcagugugggcugaagccgagucucaugucuaacucagaugaugcccuuucccagcuaccccguauuuaguaccugaaaguuucugaaguaaaugaacaucugaaacauucugcagggccucuggcauccaggguggggcuccucaucuggugugugccagcccucccuuagauguugagggugcaggguaggggcaagagcuauuacugucuucuguccucuaauacccugucccuaccacccuccccgccccccgccccccaccccacucacacacacggccucagggcuauguggucuaugggaaaccucaucuugguagccagucaguaauagugaauaaaauagaggacuccccauucccaguucaguguuuaucgagagagguuguaaaaacaaagagauguggcuuugcaagauuuuccucacacucaggacucaaguuacuguuaaccucuccgucauccgcaacugacuuggcauaaggccaccugucugugcuuggguccugucagcaguuucucugcagcauccagacugucaccuuguagaaaucaccauuaggauaauaccaggcaccagacacugugguggucaaaucuugaagagucaaaucuugggagucucucuuuauagauucccaauccaauccccaaaacauuuacuuaccacccacuauguggaaagaaagcacugugaccuggaggguaggagaagcagcgcaagcagcugagucuagcagcaggaccaccagaaacuagagccauucuucacgaugcugccagccagggaacggagugagcccaugagcuccgacccagcaugggcagcaccuuccacaaagggugccucauuugaucuucacaacaccccuaucggguagauacuaucaugccuauuuuaagauguggaaacuggagcccaagaucacacagcuaucaaguuauaaagcugacauuuaaccuggacucugaccacuaauaaucugaucugcguguucacugaucagaaacagacaaaaugacauauaagaaauugauauuggccgggcacaguggcucacacuuguaaucccagcauuuugggaggccaaggugagaggaucgcuugaagccaggaauuugagaucagccugggcaauauaaugaaacugugucucuacaaaagguaaaaaauaacauuagccaggcauggugcugugcaccuguagucccagcuucucaggaggcugaugcaggaggauugccugagcugaagaauuugaggcugcagugagcuaugaucacacugggcuacacugcagccugggcaacagaacaagccccugucuauuaaaaaaaaaaaaaaagaaaugcauauaauaaaaaaaagaaaugcauauaauaaauucuaugucacaacacagagcaagguuuuaaaaauauauauuuuaaauuuaauaaaugauguuaggaaagcuggauagaaauaugaaaacaucgauuacacaccagguaaauuuuaaaauacuaaugaaaauuauuuuuuaaugacagacugaaucuucuuacauugucaaagagaaaguaacauucuaaacucugaaauugcuaauagcaacaaauuugacuauaugaaaaugucaaacuaaaauaaauaauagcuaagaaaagaauuuggaaaaauauuugaaucaaguggaauaaaucaugacucauccuaaauauauaguuuguacaaauuaauaagaaauacauagauuauaauaaauaugugaaggacaugauuagaaugguucacuuaggaaauaaauagauuuuccaucuuauuuauaaacaagugcaaauugaaaugagguaccauuuuaccucacugccuauuacaauggaaaauauauguuaccgaugaacaucucuaagaagacuguguugaaccuuauacucucauacaaugccagugacauucuaaacugcuaaucacuguaaacauuuguaucaagcaauaaaaauuuucauugccuuuguuacaaaauuuguauuuauaacguguuuuacaacauauuuauauaaauguuauauuuauacauauuuauauaaauauguuauauuuguacauauuuauauguauauaaauacauauuuauauguacuuauacaagagcauuuauguuauaaaaacaauauaaaaaagucauaagugcaauuauucauuacaaauuucuauaacaguuaaaaauacuagaaacauccuaaauauccauauuuaaggguuuagaaaauuaagcaacauagacucauguggauuuauaugauauuaauugagaauacuguguacacucuaauuacagauacgacuuugaaacaccuguguaaaaaaugugaagaauaucugaaauggaauauuuaaaaauagaaaaucuaaaaauaaugagauuacaaauaaauacuuuugaaaauguccuucacuggcuaaguuugguuguguagggguagcagguccaagaugacgacuacuucuuuauucuguaauguauuagauggcuuuuaugauuaaacauaaaaaggcaaauacaauuuacuuaaaauguuaagauucuuuguacagaaaaauuaaaauuagaaaaaauaaguuauaagaacuuaaauauaaccuguaaaggggcagaaauaaaccuacucucgaaaacaauuuagcccgaagcauuggauauuuauuuaaaguaucuccucuguuuucaggcuugugcuaaucacccugaugaguagaaagaagcucccccucgcccugagaaguucauaaucccaugggcaaggcaagacggagccacguaacaguugcccuggcuccagcagugcagagagaggaaguccucuuagggauggagguuagagaaggcucccaggggugggauggaggaagagggaagacuucuucugcuuuguccacaccuguuagagagcauggccaggauucccagccuguaagggugaguguuucuauuaguugacuuguguguaauccuguggggaguccuccugaagggugaaagagcagucuugugaaguuggccuuggucacugaaaccgggcugggcaccccaggagaccgggccuaaggcagugucccuggcucugaccuuugcuguuucuucucauccagacaaguucaguaaggcccauggacagcacccaggccucagcagagaaaauucagcauaugcucugggccacagacuucccuuggguaugagaugauggcccaggaagcaaguagcucugugauuuuuaaaauaaccuacuucuacuuccccucaacccccuuccuauauuccccucuuggucugcuugccccauucuuuguuuucacccggcggcuucucugcuguucaucucuagcuuucaggaucacucacacucucugagcccgcagacugaggugugccugaaggggugaaguccagcaacacugggucugucucugauggucucugggcucuggcaggcaagcacugccccugcuagccuucuaggggaggaggcugcagcccccuacuccaccccggaugugggcaccgcucaccagcaaccacaugcucagacauuagaaaagcggcucuggggugggucuucaggggaaaaccaagcccggaggcugaaaagccagugaagggaagguccagaccauucauucccuaggcucuucucuucccugcccaucuuguaauuggugugggagaaauucuugacaggagcagccuaaacacugcauacccaacccucugugagcucuaggaccauuuucuuuuugagauggagucucgcucuuucacccaggcuggagugcaguggcuugaucucagcucacugcaaccuuugcuccuggguucaagcgauucucccaccucagccuccugaguagcugggacuugcgcguaccgugcccggcuaauuuuugcauuuuuaguagagacaggguuucaccauguuggccaggcuggucucgagcuccugacuugaagugaucuacccaccucggccucccaaagugcugggauuagaugugagccacugcgcccggccucuaagaccauuuuccaaauccuuccuggggaucuccgugugccagagggacccugagcgagggugaccuuaugucccaguuugcccaaaauaguccugguuuacggcccagguuaauucugauagugccccuuucacucucagaaacauccugguuagaugauaaauuauuucaugaccccacuucaacaucaaacugaacacauacacacaugugccucucuguguucuuggcaguuaaggggacagcguccauauagucccuaagcagagaaaccccaggcuuaucuuugacuccucuuugugagaccuaugauguuacaauuaucucuugaauauacccucccauuucuguccccacugcucaugaucuauuucagacacaaauaauuacaaccuacuauggggucucccuggcuugagccucucccuucuccauaguucugccagcgaucuuuucaaaacacagaucgaugccuccuggcuccccaugaccuauagauugaaauccaaauccccucaugauccuuuccugcuucaucuccugcccccaccuuccuacccugggcucuggcagacugcuuguccccugaaaagcccacauuccuacucauuuugguauacuuguucccuuuacucccuccuccgagucugacccuuucuucucuuuucugcugcucuuauuugacuuucagcuccuuccugggacugaucucaagugucaucuccucgaaggccuuuucugauucagcccucccgucaaaaauaaucacucccccuccacuaaacccuaagagggcuugguuuuuaacauuuacuacaauuuggccccugcauaagauuacauaagauucugcuuauguaaccaucucuccugccuaugcaacaaacugcgaaggccaagaauggcaucucuugcagugccugaaacagugccugcuucauggaggaguucauuguuaacaagucuuaaucgaacaaaauugauaauccaccucaaauuuuccacaccggguugcccggcacaucagccacucauaccugggaacacuggggacagacucagagggcacugugacaucaguucuaccacaauaucuuguggaagggauaucugcuaagaagaauucagauguaaguggcugcaugccuccuucaggagaaagagcaagcuuucccucacccauccucuccuccuuaggucccacugccuccucagggucagacuucauucccccucgucuuuaugaauccuccccuuacucucaguuucucaguucagaagggaucuugcugccuccaagcuccugacucauaauuuaggacaacuaaucugguguuucauuaggugucaucuuuugaacugagcuuacaucugugucuggcuugacagguuuuuuaggauaggagaagacagggaagaggcagaugugaaucccagguuucaccccuuuccagcaggaugaucugacuacaccccuuccucgcugccuuaaaacccuuucgcguggcuucaugaggaccugacugggucagagaagccacucauagggugaagacaugagccccacaucucaggacgcuaacaacugcuugacugcccagggcgggcucccccacccacccagaucugcugugucccggcaguggagucuuuccuagggaacagguggauuugggguggggcgugccuuaggccccauacucauaaaaucccggggcucugucuucucaccucuaaaacagagaagacagcagccggugggugcaggugggaaggggugaaguggaggcugagaagagguuagggcucucgggcacccaccaccucuugcaacgcgacccugagacaguggggcaaguaucccgauuucacgaacaaagaaacugagcaacuaauagaggaaugggccacgcuccuacugggaggccgggcaggucucccagcccugaagacuuuuccucccaagauuuagaugugaagccccuuuugccugucccugcccuuaccccucgggucagccccaaaucggaggccaccaucucucucacagaagccugccccucccaccccauccccuccucccuccccucuuuccugcccacccauuugccuccggcuuggguggcaggaagggaggugcagggccgggcgugaagagcaaacccccuccugcucagagcugcugccgccugcgcccagggcugcacuccgcgcaggccucauagccaggccauggcccccacagagcccuggagccccagcccggggucagcgcccugggacuacucgggguuggacggccuggaggagcuggagcuguguccggccggggaccugcccuacggcuacgucuacauccccgcgcucuaccuggcggccuucgccgugggccugcugggcaacgccuuugugguguggcugcuggccgggcggcggggcccgcggcggcugguggauaccuucgugcugcaccuggcggcagcugaccugggcuucgugcucacgcugccgcugugggccgcggcggcggcgcuaggcggccgcuggccguucggcgauggccucugcaagcucagcagcuucgcgcuggcgggcacgcgcugcgcgggcgcgcugcugcuggcgggcaugagcguggaccgcuaccuggccguggugaagcugcucgaggcgaggccacugcgcaccccgcgcugcgcgcuggccucgugcugcggcgucugggccguggcgcugcuggccggccugcccucccuggucuaccggggguugcagccccugccugggggccaggacagccagugcggcgaggagcccucccacgccuuccagggccucagcuugcugcugcugcugcugaccuucgugcugccccuggucgucacccucuucugcuacugccgcaucucgcgccgccugcgacggccgccgcacgugggucgggcccggaggaacucgcugcgcaucaucuucgccaucgagagcacguuugugggcuccuggcugcccuucagcgcccugcgggccgucuuccaccuggcgcgucugggggcgcugccgcugccgugcccccugcugcuggcgcugcgcuggggccucaccauugccaccugccuggccuucgucaacagcugcgccaacccgcucaucuaccuccugcuggaccgcucauuccgagcccgggcgcuggacggggccugcgggcgcaccggccgccuggcgcgaaggaucagcucagccuccucgcucuccagggacgacaguuccguguuccguugccgggcccaggccgcgaacacugccucggccuccugguagcugccccgggccgcuggaggugggcggcagcggagcaucgagaggaggccagaggucccggaggggacugagcuccccagacgcgccuguucuggcggcagcaagcugcucgggccggcaucgcauuuccucgcgcgcugccuggacucccaaggccuccuccaucgguuuccccggaaccucagaacaauugaacuccccuaaaccaggcuccugugacuagcuguucccucucagccugcaggguaccugagcuaauuuuguccaguccaagauaggugcuaugagauguagcagacagcaacucggagacccgcagauucaccaaguagacagaagggaaguggguuuccuucucugucccaucgggaagagaacccaccagaauaucuaacccagacccccaaaugccauucugauuucuggcugugcuuucucccgucucccacaauagccguugcuuucagagaaauaccuucuccaagucag

SEQ ID NO: 12870 - RNA, 2469 nt, Homo sapiens
uggauuccugauuaauuuauuuuugcugcuguucuuagauuuuaaaagcuugcauuccucaagaucacccucuucauaaauaccuucaauaaauuucagcacaggaugauggcucaagcccuuuuauccuuugcagaaugauauaaucgggcauucuaaagcaaauaagaauucagugaccccaaaaauguaucggauuaaaaccuaccaauaaaaaaugaaguguuaccagagaaaauacucugcagcuguucuuugcuuuagguacacauaauaacaacaugagugugggguaugaucugguuucaguguggcaugcauuaauucacauuuuaaaaucuuuuacauaugcuuaucuucuuaugagcauagugcaguacuacauuagaucuacuuaaaauccauugagaguauugauuuuuuucuugagaaaaaucaacacagugagauggucucucuccucguauaaagcccauuagagaaaaccagaauuguguugacguaaaggagaauguuuccuaauguacaugacauaucacugugguucacaagacucaacucucuuccaaaucuaauuaacugauucuguuaagcuuauauucuagccccuguucgcaugguuaucacaccucugucaacccaaacuccccuauuuaggaacuagaagugacuaagaaagugacucaugaaaauauaacuaucuuaaagauauuuuacuaacaugguaauauuaaaucaaauaauuacaugaacuguuggaauuucauuugggcaauuuuuuaaaagauaauuuuuaauugcuaugagacuggaguuuaagaguggaugauuuaacugaaauguuuuaguaagacuggguagauaaaccaaacacccugaauucccuuaauagcaguuaucauucugacaucuucuuauuuuaaagaaauugcugaaaauuugacaaaacuaauguggauggcuauaauuaaacuugacaauaucuauaugggggaagaagugaaaucacuauauuuagaaacgaaugcuaccaucccaccccaacuacauguucagguuaaaugcgugcacauccugguagcuggaacaucuguuucuagcuuguuguuccucuuggcugcuuuucaauuggauuuccucgagcaggucccaggcuugucacugcagccagggucuguuaaccaucaccacugguucuacauuaaguaggagguucagggcuaagcuaauaacucgccugccuuucugacugaucacagugauguucgccguggccacuuaucaugcgggcuccuuugggagggugcucuucuuugucuguaccucuggguggaauugguuuuguuuccccugguuccuggaguuacgugugaaagacaaggcucauugucacuuccauggagcggcuguguaaugcuuugcccaugcauccgcugcacucaaacaugaaacucgcucugcccuuucugcaggaccucuaaauacgauauguggugauucucuucuuccuccacucugaaaaacaaaaaagaaacuaucacuguauguaguuuacaggaaacuagguuagaaugaaacagagcacuuuaguguucugaaucaugguuaugauuuggcauaaaaucacaagugggaaauguuugaugcuuauggcauagcaucguaugugugguccacauccaaggggucagguggggguaggguuggaagaaaagaggcaauugcaaagaugcuuagacaauuuucuaaaggccuuuagacaguucaguggcuuccacuuuauaaauguuccaggcugacuguagaaaaggggauguccaaauucaagggcacacaaaaagcauuuagaaaguuugcuaacugacaagggggaauuagugaauuugcuucccauuucuacuuucuagguggcuucugaaacagcaaagaaaguuggguuucaucugggaccugauauccugggguugacaccauccuguugugacucccacagcugauaagcuuugauagaaauuggcggccccaucugucaaacucugccaugacuuuuuuuuuuuucuuuuuuuuggagacagucucacucuguugcccaggcuggagugcaguggcgcaaucuuggcuaacuacaaucuccaucucucagguucaggcaauucuccugccucagccuccugaguagcugggacuacaggcgugugccaccacgcccagcuaauuuuuguauuuucaguagagacggaguuucacaauguuggccagaaugguuucgaucucuugaccuugugauccgcccgccucagccucccaaagugcugggauuaaaggcgugagccaccggcaccuggccaaacccuacccuggcuuuaaaccugaaaaguauugcuuucccuagguuaaggauuuguaggaaauucucucgccaaacccugcccuugucccuuguauggaucuauugcaaggugaaaaaua

SEQ ID NO: 12871 - RNA, 6296 nt, Homo sapiens
cucaacacuguagccacuaaauuucaaaacacaaaugucuuaugaucuacuuuuucccuucauacuuauaaguuuacuaauauauuacauauuuacuaauuuucaguuucugcaucuccauuauuuauagguuuagcucuuuccuucuaauacuuauacucucaacauuuuaaaacauugcugauuuaauaauaccuucauccuaacuaaaaugcucaagacuguuguaaucuaaaucauacugucacuuuauuacaacuuuuuaaguaaaaaguuuuuuuucccaaaacuggugccacaggauauuacaacauuuuugaggcaaaaaaggaugcaccuaaaaccagaagauauuggaaucugauuuaaaauaaagccucaauaaauaauuucucuggaguaauauuaggauggcuaacccaauuucaagaaaacauugauuuauauaauauuaaauuucuauucuuccauauuaugcaccuaaaacauauucaacguucauaaaguauucaauguucauaaaauguugaauguuuucauaaugucauaaaacugaauauuuuaugaacauugaauauguuuuaggugcauagcaauauggaagaacaaaaauuuaguauuauauaaauuugaauccuuuuuuuuuuuuuugaaacggagucuugcucugucgcccaggcuggagugcaguggcacaaucuuggcucacugcaaccuccccaccuucuggguucaagcaauuauccugccucagccuccugaguagcugggacuacaggcacacgccgccccacccagcugauuuuuuguauuuuaguagagacgggguuucacuguguuacccagacuggucucgagcuccugagcucaggcaauccacccgccuuggccucccgaagugcuaggauuacaggcgugagccaccacucccggccuugaguccauuuucaacuaaaauaaaccuagaaacacaaaauaccuaaguuaaaaaaauacaauuaaaauacaagccucuaaacugcagguuauaccacggaugugaauauuuuagaaaauguuaauagaaaauucugaaaaacguuacuggauauuaaguaauaucuccuuucuucaaucuugugauuaacaggacuuuuauugguaguaaacuagagcaaacaaucagaauaauacauaugcaguauucaguacacacaauaaaaguuaaagaaauucaaaaccuguauaaaacaaacuggagaaaaaucauacagcuuaagagauacagugguaaagguccucuccauccuuugauuacagcuuguacucuguacucaauagaacuuaccgcacuuacugaaauaagaaauaaacacuuuuuaguacucagcguauuuaagauuaaguacauuuucuaagaaucuugcaaugacaaguuggugacccuuuagcugcuaaagcuaaagggaggaaagugggaaaaggaaauuaacuaauacuuuguaaccauuuuuaauauuucuuauuuuccaaacacugcuuuuauaacagaaguguuuuacacuugcacaauauuaauuacuuuauuauacauggaagccugcgguaggcugauuacacaauaagacugcaaacaaccagugguacuuuucugacgucagaagaguacauaagacugaaacaucaccaaaaguacauaaaaaacucaucagcauaaacaucaaaguacauuaaaaaauauaaucaggaaaaaaauacaauugcuaaaaagcaguuuuagaguagagccacugccaaucaguagcuucaaauggcaauuagaguucauagcaaguuuugaugacuuuacaagaccccuguacaauacuaaugcacccuuucauuaaaauguacauuaaaggccgcaauuucacaaagagguucugauguuauuacuauaagcagacacauucuuaucccucacaggaguuaugucaccaguuggaauuacaaccuuauuaauaucuauccaagaacacgggguuuuauuacauauggaaaucuguauggguuuuuuuuuuuuuaaagguggguuuuggggauguuuacccuauuguuuuuuauuuggaugcccuaaggcauauaaagcgcauagugaauuaccuacuggaauguaaaugguucuaaaauuaaaacuguuaaaauagaaagagggaaaaggaaggcccaagaacucuuaaagagaggcugagaacaagaacaaaaaaacccagaaguguagguaauacguaacagcgcagacagaaccguuguaggccauguauaauaaauaaugcaugccccaaauuucaguuaaucauauaauuucaacuugaguucuaauacuggaaccagccaaccacuugggcuucaacacuguacuagaugucaguagaaucgcuugauggaauuacagccuuguuacaguugagaucaagagagggugcuuuuuuuuuuuccuucuuuuauuaaagcuaucauuccaggcuuugaucaaagauccaagaauauuuguucuaccaggcuggaaugaaugugguuuggaaguucagaguacauuuaaaagcugcaacaaaauauagguagccaacaaucucagaauuuuggaucagcccagauggagauagcaauuugaaaugucuucgaucccuuacuuaaaugacgaaaugucuaucagcccagauagagcaauuugaaauguuuucgaucccuuacuuaaaugaugaaauguauaucauacuaucuguaaauuggauauuccauuacagugauaacguacagaauucccaugcguuauuacacuuuccugagaguaaagcaauuagaauaaccuuaauccuagcaacaaaguuuuuuuuguagguuuuuuuuuuuugguuuuuuuuugucuuuuuuuuugcguuuaaaacauuugggcuauucccugacgaucuauacauguaaauuugauugcuaaacauugucacuuugaaugucaaacuauuuuuaaucuauugauuuugauuaaaaaucauaauacaaacagagcuaaaaucacgcuaacaaaauaaacuaaauaugaaaaguugcauugaaagggcaucacauuauucuuaauaggaucguguagaaacauuccaauggcaguguucucaaaauaaaacaaaauuacauuagaagaccuccagccuggccacuuuugggaccuuaccuguaacucuggcuggugggugucuuuacucuuguacuacauggcucacuuacaucagacaucauauuuguauacccugagaaaucugacacugaaguccuuacucuaugguccacuucuccauuagaguuagugauaaaggucauuggcacccugcugcccgacuuaaacugagaaccaaacgcuugugcaaaguucucaaucugauacguuguucuaggcucuaugucuuucugaggaucuaucuggcuagcuaacuccugagauggaaucugaaagccuguugaagacucuaaguuuuucuguuccuucuggcuagucaauuucugagaugaggacuggaaggcugaugaagucucuaaguucuucugagaaucuaucagaucauccagcuccugggaaggugucaacugcugauguguagcauccaaagcagacaaauaaagaccuggcugagauccaaacaacaucccaaaaggaggcuuuggcaaugaagauggcaacacugagguaacagauuggccgaaaccacacuccaaaggagacguaguguauauuuguuuuucuggaaacaaagugugguuguggagaggugaagacaaacugacaaauuggaaaccguguccaagaguaaaacuugcauuaguggauuuuucaaaagccuguuggagguauuuggaguauucuugcaacauacuugcuuuaucauuugaagguguuugggugccugggcucaaauuuucuucuugaaccaauucugaguguucuccugagguguguaaauccacucgugguucugcaauauugaaaggauccucuuucuggcuuucugauuuguuggaguauugauccaaaauacuuuguaaaaccucaucaggaauuccagacuugucaugacaagauuuaauuucagcauuuagagcugaggagucaauaagugacaauggugccucauuguccaaaacacugacaccugcagacugaaugacagacuguugggagaccauguguccuacguuuauagaaaaggcacuguugcugcuggcaguugguaaauaucuucuuuucuuugaaaacugcauggcaucaucauaauuacuacuuaucugaccuuguuugccacuuguacuuuggagaagaccaauggucuccacacuauuauuugauacuaugccaagugagccacuugguuuuccagacaaggauuucuguccuacuaugucugguaauggugacacaaaguuaagguaguuuuuaucuguauucuuucugcuuccuuucuuaaagaucaauuuuggcacccucuucugcaguucaucuauuccagugccaauuaugccuccacuggaagacacgguaggcauuucuacugaguaacucugcauguuuauauuauuugaaauuugcgauucauuuguuuuaccggucuucuguuccuuauuuucaauagcuaugcuuuuugacuuuguuuuucuccuugaagaacuuguauuucccugagacaacacagccagauuacccauauugguaugguuugaugacccagguucugcacuaguggcuccuuuaacuaugacuucaccacaugugcgccugugcuucaacaaucuaucaguccuugaaaaauacuguuggcaagugucacacuuauauggcuuuucuccacuauguguccucuugugucucuccauaugguacuucugaauaaacuucaugcugcacugaucacauccaaauggcuucucucuacuaugaauuuucucaugucucuguaguagguauuucugaaugaaacccauacuacacuggcugcacuggaaaggucuuucuccuguaugaaugaggacaugucuccgcaggugauaggagcuucggaaagcagcacuacagugaucacagauaugagguuucugacuuggggagaggauggcaccuucuccaucuccaaccaaagaagguuuggaagaugcacuuggcuuccucuuggcuuugauucccugagauucuggcuuuggccuuuuugccuuuuugacauuaguguccugcuuuggcuccucagugccaugguggucaucaguccugcuacugcugcugaguaauacgucacgguggugcugggcugguugcugcuggacaugcugguggagaauacugagguccuggaugacgccgugacuccccccuucaccgccuccuaggccuggagaccucucuucagcuccagcgaacagccccccauaguggugguggugauggugguggugggacugcugcuccucaggauccgcggguuucuccuguuugaugcuaaccaaagacugcaagaacccccaggagguccucugcgaggggaaggccgcggcugacgccgccggcuccuucuugaaagucauguccggggcuggcggaggggggggcucagcggccggggcugcggagguagaggaggauaacacgcauugcgggggaggggcggccgaccccgccggccgggugaagcuggugaccgggggaagacggugguugaacauaaccauacccuggggaaagguggguuccaucucugcccuccugccgcugcugccgccgccgccgccgccgccacuaccaccgccgccggagccgcuaccaccgcuacugccgguaccuccgccgccacucaggaacccacugccgauuuucauaccccggaggaggccuggcugaagaaaggaggaggaagagggaagagggaggaaaggagguggaaccgggccccgggccgggaccaccgcagcgcuaaggaccccgccgcgccgccgcccagaccgcaacgcgcccagcacuaauucccagcccagucgccuccggcaccggcacgcaugguccugcgacucuuccccaggccucgcccucucccuccuggacccaccggcaauacuuacgggucccgccgccgccgcagccgccgucgccuccaguuaauaaaaauaacgccguccucuccacaauggaauuaaaagccucccguguacugcgcagccgcggcgcagugucugcugggaacuccucgacccggccagaggggagggcuaaggagccagggcgccugcgccgcagcuuccgcccg

SEQ ID NO: 12872 - RNA, 653 nt, Homo sapiens
cuuaggcgaagguggaguuguuccagcccacauuggccgcguucaugucguaauaguugauguagacccugcggggggaggaggccggacucagcggguggcucagucccgggccuggccgcgcgccgccgccccucccccgccccuccgcgacuccgcguaccuguccgggcugaugcgcaggcgcucggccagcaggccgcacagcagcuugcuguaggagcgguucugcgcgccgccgaucuugccgaugcugugcaggcugcagagcgcgcacggcucgcuggagccgccgaaggccaugagcugguccgggaccacgugcaccgcgauguacugcgaggaaagggcgcggucagcccgccccagcgaccucgucgggccccgaacguccacuucgggcccgagccaccguccuccccccgccccgccccccagcuccguucaggagucgccuccccagcucccagcgcggaaccccucguccggugggcaccccccucuuccuguccccucccggcaaaccugggggggcuugccgguggccugcgccagcugcugggugagcucggagaggaacccguccggcacggaggcgcggggcacguugguguuuacgaugaacaucggcaugauggcagaaggaccaggag

SEQ ID NO: 12873 - RNA, 653 nt, Homo sapiens
cuccugguccuucugccaucaugccgauguucaucguaaacaccaacgugccccgcgccuccgugccggacggguuccucuccgagcucacccagcagcuggcgcaggccaccggcaagcccccccagguuugccgggaggggacaggaagaggggggugcccaccggacgagggguuccgcgcugggagcuggggaggcgacuccugaacggagcuggggggcggggcggggggaggacgguggcucgggcccgaaguggacguucggggcccgacgaggucgcuggggcgggcugaccgcgcccuuuccucgcaguacaucgcggugcacguggucccggaccagcucauggccuucggcggcuccagcgagccgugcgcgcucugcagccugcacagcaucggcaagaucggcggcgcgcagaaccgcuccuacagcaagcugcugugcggccugcuggccgagcgccugcgcaucagcccggacagguacgcggagucgcggaggggcgggggaggggcggcggcgcgcggccaggcccgggacugagccacccgcugaguccggccuccuccccccgcagggucuacaucaacuauuacgacaugaacgcggccaaugugggcuggaacaacuccaccuucgccuaag
